United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 17

SEQ ID NO: 60435 - DNA, 830 bp, Triticum aestivum
  unsure (1)..(830): unsure at all n locations
  Clone ID: PAT_TA_60435
gccggccgggtttcgcgatactcatatcatactctttcaactcaaaaaaacactcactcactcacacttacacacacataacaaatacccaaccaacatatactcaaaatggctcccaaggttctcgtcgttcttaccagccagtccaagatgaacaatggcaaccccaccggctggtatttgcctgagctcgctcacccctactatgacctcgtcaacgccggcgttgagatcaccgttgcttctcccgctggcggtgaagctcctctcgaccagggctccgttcagatgttcaaggaggatgaggagtcagtaaagttcctcaacgagaagaagcaggtctgggagcagacaacccctctcaaggagttcctcggcaagtcttccgagtttgacgccatcttctaccctggtggccacggccctatgttcgaccttgtcaacgacgagacctctattaagcttattgaggagttttacaaggctggcaagcccgtcgcttccgtctgccacggccctatcgtcttcacccaggtcaagattgacggaaagcctctgctcgagggccgagaagctactggcttcagcaactccgaggaggacgctgttggcctgaccagcgccatgcctgttctcctcgaggatgagatcaagcgtgttggtggaaagtacgtcaaggctgatgactgggctgagaagttggctgtcgatggacaaatcatcactggccagaaccctgcttctgcacacgctgtcggcaaggccattctcaaggncatcggcgcttaaataatgaatagntatgaataataataaataatctgccatct

SEQ ID NO: 60436 - DNA, 860 bp, Triticum aestivum
  unsure (1)..(860): unsure at all n locations
  Clone ID: PAT_TA_60436
gccggccgggtccgggtgtcatctctaagagcatctagagccgggtgccctatatcggtttcatacgcctgggcaggctgttcagtcactaaggcggtcacaaaataccgacccaactagaactctcaaacgggtctcaaacgcccggcctgactggcacatctcatatccgtctcaaatgtagggcggatacgagatggtctgggcacaccagccatctcagcccggcccaccgctggcccatcccgacctcaaaaaacccccgtccgacagaaaccctagctcactccgctccgttcccctcccattcctttcccgacgctcctatttcttcaatctgccaaatccctagcgctggcgagcatgtccagcaccggcagccactccgccggcagcttcagagacgaggaggagccggcgctccgtatcgcgctcgagcgctcgcgggtcgatacgggcagcagctccgggtccagtgtgacgccccctgtcgcccgtcgcgccagcgccgataccggcaccggcccttcccgccccgcgcatggatctgcgaggcctgccagatctgctcctcccgtcagacggcctccttcacctccgcacactgcttcgcgcgggcagcgctgggttctagtgcctgctcaagcgacattgtggatgcggactctggagtcggaggcacgagatgcctatcgcgagaggcagagggctatngaagatggtgggctattctgcgcagtccgcccgccgccngcgggtgcccgnacgggtctgcgcagtcctcctgccgcccgcgggtgcccgaacgngtctgcgtagtccgcccatcgccgatgngtgcccgacaaggaggacgtctc

SEQ ID NO: 60437 - DNA, 783 bp, Triticum aestivum
  Clone ID: PAT_TA_60437
gccggccggttctcgaaaagaaagatatcctcgcgataattggaaacattccattcaaaaagtctgactcaacacttttgcaacacgattgcatctcctcttataccttcgacttgagctcgtctcccaatccgcccatatgaacgggcgcccctcgatcttcacctcgcaggattatctctctgaccacctctggaagtcccagtcttgctaaagaaccatctctggccaaccgactatcctttttctgaatcaactcaacaaatcaacaaacgacaattaacagaatgttctcccgattggcttccttcgccaaccccgcggccaagtccgcgtcggcttcaggccgaactatgcttcaggtccgatacctttccgagaaggctgttgctggcagcaagggcagggctatgcctttctctgctgttcgagctactgcccctgctgcttctctccctgctactctcactattcgagatggtcccgttttccagggcaaggctttcggcgccaacgccaacatctctggtgaagctgtcttcactacctctctcgttggataccccgagtccatgaccgacccctcctaccgaggacagattctcgtcttcacccagcccctgattggcaactacggtgttccctccgccgcccgtgacgagttcaaccttctcaagtacttcgagtccccccacgttcagtgcgctggtatcgttgtctccgatgtcgctgtcaactacagccactggactgccgtcgagagtctgggcgagtggtgcgccc

SEQ ID NO: 60438 - DNA, 872 bp, Triticum aestivum
  Clone ID: PAT_TA_60438
gccggccgggactaaatcaagaagagctcaagtctcatattgactggcgttcgccatcattgacgtagcgtagactttttggatcggcatccagatgaactgtacttgccaacatgactggaggaaagaaggagggttcaaccaatccgtcagctgtccggattcgtgacaaccaacgtcggtcccgtgcacggcacaaggagtatgtcgagggcctgcaaaagaagcttcaagactatgagcgtcgaggtgtcgaggccacattggagatgcagcaggcagctcggagcgttgctgtcgaaaactcccgtctaaaaattctgctgggttatcatggtgtcactaatgatgacgttgaaaagttcctgcaaagcttccctgatcagtcagtttccgacgccgcaaaggcaaccatttcgcagtcgaccgccggtcaaccacccatcgccctcgcacccaagatgcctcttcaacccttatcaagagcgccgtccgattctccgaggacgttaccgttgccacatatacaacaagagaccagcacaagcactcgagatgtcgtggacgcagttgtagggatcaagagagactctcgaaaagctggtttagacggcagaccaaagctccccttgccgatagaacagcgacagccacttttgcaacctcgacctcaattgcccatactgccagcactgccatctcttgtacttggtcagggcagaccagaaccccctcctctcgataaactgtcggtccttgcgacagccagcgtgcaccaagaacccgattcaaataaacaccgtcgttcacattccaacgccgacagcctccgtgttccgagcccgtcgatatagggcaagctcaccggatct

SEQ ID NO: 60439 - DNA, 856 bp, Triticum aestivum
  Clone ID: PAT_TA_60439
gccggccgggtccgagttttaccctagatagaactcatcaccatgcctttcgcgacagaactcacaaagcgtctgggcatcagagtgcccgtcgtgcaaggcggcatgatgcacgttggcaccgccgacctcgcctcagccgtttccaacgcaggcggcctgggcctcatcaccgccctcatcttcccgacccccgaggaacttcgcaaagagatccagcgctgtcgcaccctcaccaagaaccccttcggcgtcaacatcaccctcctcccttctatggtccctcccaactacgccgctttcgcccagaccatcattgacgagggtatcaaggtcgtcgagacagccggtaactcgcctggacccgtcatcacgcagctcaagaaggccggaatcatcgttcttcacaagtgcaccaccattcgccacgcgcaaagcgccgtaaagctcggcgtcgacttcctcagcatagatggattcgagtgcgctggtcacgttggagagagcgacattaccaacttcatccttctcagcaaagcgcgccaaacgctgggtgtgcccttcatcgccagcggtggcttcgcagacggttatggactcgccgccgctctgtgcctcggtgcttgtggtattaatatgggaacgcgctttatgtgtactgtcgaggcgcccgtgcacatcaaggtcaaggaggagattgttcgcgcccaagagaccgacacgacacttcttcttcgacgatggacaaacaccactcggttgtacaagaacaaggttgcgatggacgcgcttgagattgaaaagaagagcgagtcgggtgaattcgcagaggtcgcgccgtatatgagcggtagcg

SEQ ID NO: 60440 - DNA, 828 bp, Triticum aestivum
  Clone ID: PAT_TA_60440
gccggccgggtccgagaaccaagagtaaaacatctgcttattcaacgcacgaccgatacctttgagcttgagctctgacttgccgttaaaccctttcaactcaagctctgtcttaacataccaaaccaaaatggcttccgctgttgaatctcccccggcgcactcgcctccaactaaccctcctcagcgacctcgaggcatcctcaagaactcgtacaggaaatctccccctgcctcgccagagcaagaacaggcagccagcgaaaaggagctcactattgccaacacgcacatcaacgcgggtcaccgacgttcatcctctggcgctcgccctacaggatcccgaaggcaatctggtgtcaacagctcctctgacggcctcgaacagtctcaacgcctcaagtgggacgaggctaatctatatctcaccgagcaagagcgctcctctactatgaagatcacagaaccaaagactccctatgccaaacactacgacccggccgaagacccatcggacgacgaggatcctctggcggacgctggtgctcgccttaaggattcacgtccaaggcgtgaagatgacattccgggcctttcgctgggcgaaccggaagaggagatcccggaagcgggcgcgccgtcaccccgcagcgaaaagagcgtccacgtcgacgacgagagcagcatcggccacgacgccgaggaagacttggcgggcatgtctcccgaggagcgtgaaaagcaccgaaagtttgagcagctccgcaagaggcactacgaaaatgaagaaatgtgggccagcttctgggccaccccgacgacctcccc

SEQ ID NO: 60441 - DNA, 704 bp, Triticum aestivum
  Clone ID: PAT_TA_60441
gccggccgggttccggcttcggttcagagttcgttcagctgtacccccaccccaccgctcgcgctcgcgctcgcgacgacgagacagacaagcgcggacagagccaaggaaccatgggctccttcctgtcgtccttgtggacccctccgccgctccccggcgacgaccccgactccgccgtcgtcgccgtccactccaagcccgcctgggaccggcactgggaggcgcaccggaacgcgtccaagctgatggtgatcgacttctccgcctcctggtgcgggccctgccgcttcatcgagcccgccttcaaggagatggcctcccgcttcgccgacgcgctcttcgtcaagatcgacgtcgacgagctcgcggaggttgcaaagacattccgcgtagaggcgatgccgaccttcgtactggtgaagggcgggcaggaggtgagtcgcgtggtcggggctaagaaggatgagctcgacaggaagatcaagacgttcatctcatcgtcctgatcctggcttaattaacctgcactccaattgtagtgccaggctctgtcttctcgatcccagtggcagggggctcctatggtttccccaatggtgtagcactaccaatcctcctaaaatgctgcaaatccgacgtaaagtggtaataaaggttctgaaacttggatcgtacaaaaaaaaaaaaaaaaaaggccccta

SEQ ID NO: 60442 - DNA, 768 bp, Triticum aestivum
  Clone ID: PAT_TA_60442
gccgggctcggtgatccaaccccccgcaaaaaccctatgccccatcccctccctccctccccctcctcctcaggctcgccggcggcggcggcgcgcggcggcgatgggcaaggcgaaggggaagcagaggcaggacaagtactaccacctcgccaaggagcaggggtaccggagccgagcggccttcaagctattacagctcgacgcgcggttccggttcctgccgacggcgcgggccgtgctcgacctctgcgcggcgcccggcgggtgggtgcaggtggccgtcaaccacgcgcccgtgggcgccttcgtcgtcggcgtcgacctcgtgcccatccgccccatccgcggcgcccactccctcaccgaggacatcaccacctccaagtgccgctccgccgtgcgcaagctcatggactccaagggcgtcgccgccttcgacgtcgtcctccacgacggctcgcccaacgtcggcggcgcctgggcgcaggaggccaccacccagtccgccctcgtcatcgacgccgtccgcctcgccaccatgttcctcgcccccaagggcgccttcatcaccaaggtcttcaggtcccaggattacaatgctatcatgttctgtcttaagcagctgtttgagaaggttgaggtgaccaaacctagtgcgagtcgtggcacgtccgctgaaattacattatctgtctcaatataaagcgcctgcaaagattgctccagaacttcttggaataaagcacctgttcaacgcccaacctg

SEQ ID NO: 60443 - DNA, 819 bp, Triticum aestivum
  unsure (1)..(819): unsure at all n locations
  Clone ID: PAT_TA_60443
gccggccgggttccgcttctctttttcccttcccccctttccttcctctttcttctttaccaatggaaactccagagaccatcaccagaggcgacaccgccaaaacggcagaggtttgcaaagcacacggcatctcgccggaagagttctcggagctccgtactcgtgcaacagcagcaaaggcgaccgcctactgcccctacagccagttccgcgtcggagccacggttctgtcaagcgagggcaagctcactagcggtgccaacgttgagaatgcgtcgtaccctgtgggaacttgtgcagagcgtgtggctctcggtacggctgtgacaagcggtcaccgtgggttccgggccatcgccgtagctacggatattgcaccgcctgcgagcccttgcgggatgtgcagacagttcattcgagagttttgcaagttggacacgcctattattatgtttgacaagaatgaggattttgtagttgtaaagttggagcagattttgcctatgtcttttggacctgaccagctcccacgtcctggagcagcagtgaccgaatagctgatatactatgattcgttaagcattggataatgctgaaattggcttggatctgactctttatctacatctacatcagcggttggatagactggatgcttctcctgattgttgcatcagtgtgttatggcgttgagggcggtcgtaacgtttggacatgagagatgaatgaatatgagatacatacatcataactagtacagcccggcgaattcagatgtattggacaaaaaaaaaaaaaaaaaggnccctagggccg

SEQ ID NO: 60444 - DNA, 881 bp, Triticum aestivum
  unsure (1)..(881): unsure at all n locations
  Clone ID: PAT_TA_60444
gccggccgggtcgggaagcaagtcagtcagtgacatgaccctcttcctttaaaacctcattgtttaggttttggagaggggaagaagacacccaaggtttcagtacctacgaattactcctcagcctctctctcgtatagagggagagaggcattgttacgggctgccagcccagaaactggctgaggaccagtcagtcccgtcccattgccaacgagatatcccttgcttggggatattatcgtattgatcgaattcctttctccgagctcgcaaatcacgactcggagaaaaaaaaagttgtcccccaaaaaggacagccaatctgtacagtacttgattgtactggacggtgtacactaagaaaacaaactcctgtcctccctttcccctgaagttatctatcaacataacaatcgcaatttgcgacattccgttctctcttggaccgaaacttcctcattgcatcgcgagtaactgcgctttgctcattacaagagtatccattctttaccttgaacgcgcaatcggccttcgtcattcttcgtgatcgataattctgttgcctatataccaaggccataaaagcattcactcccgattcgcttatactctttccacactacaacactttacgatactacctatctatctatctacaccaaacaactcgcccatcatgtctcgcattcaatncccgctcgacgttattacgtctcgcctcaactttggcgaccgcttccagagcctccgatccggacctctcagcggccgcttctctacctgcgacctgttaacgagttcctcgacttcaagcgtctctccagnctaacaactttgttgagatgcagtcgcgagtcaactacaacctgagcactact

SEQ ID NO: 60445 - DNA, 507 bp, Triticum aestivum
  Clone ID: PAT_TA_60445
gccggccgggctcggattgcggttggtgtctgagagatgtgaggacagggtcgaggtcttgaggcgcggaactgacggatcgcgcggccaagacgagttgacaggatatctgactaacatggctttgccgtcgcgtgagctactgatgacgatcctatggacaatacaatcagaggaacgtcgacttgaacgtgataatggccgaatccccgacccacagactcgctcttcatcacacagacaccaacccaccaagaaatctgtttcgccagttatttcggaggcagaggataattggacagaatcgtgaggggtttccccatgataacctgtcataatgtgcttacgttattatttgtttaaaaacccagtggtggtgcaaggcgcaatggatcaatgtcccaggagggaccggtaaagaacctataagatgggtcttttgtaacaaatacaatgaaccgctcaaagaagcgcatgatcgaaaaaaaaaaaaaaaaaaggccccta

SEQ ID NO: 60446 - DNA, 800 bp, Triticum aestivum
  Clone ID: PAT_TA_60446
gtgcggcgctcgaggcggccggttcatcatgatggttcgtcctgcctctgcctggagccggagcgacttgcctcgcccaggcagccatcctgatcctgggattcgaggagccgtcattaatcgggcgtgtaatggtcggagcagcgctgctgctcgaggtcgtcgtgcgttaatgagagaggatgccgttggtggccaacggtccgatgttcgttcattgcgtcgggtcgccatgcggttcgtcgtcctatcagccatgcggtcaatgacggccacaacctcggcgccccgggctacaatgaaagcggctgtggcggggatgggacggacgatgctcctgctgcgtgcggagctcgcgtggaggcggctcatgcatctggtgcgcctgcaggaggcagcggtattgaactcttgatggcgcgcatgggcatggcatatgtcgtgaggcgaagcagcccgtgggcgcgaggtcgcccgctcgatggtgccgtcgtgcgggtttccggggatccgtcttgggtgctggagctatcacgcagccgccactccagtcactgcctccggccgcttgcaagtcctgcggagacaactgttctctaggcccgtttacctgtgggagccgcgccggtgcttggagagagaaggttgcggcggtatggcgctcatgatgcatgccacggtccgcggtctacctcggtcaaggttaagctttcgaggcggagctggcggtgcgctgggggaacgccggaacgagatagtttggcaagatccggatgggaggaatctccgctgctttccgg

SEQ ID NO: 60447 - DNA, 633 bp, Triticum aestivum
  Clone ID: PAT_TA_60447
gccggccgggttgcgaacaccacccgccctttttgcgatcatagcgccgaacctctctccgtctctcacggccccgtgaatatctcatcccgaatttttgtcaagatggcggacgctcagaacgatgcgcctgctactgcgcctttcaaggccgtccaagtcgaggctctggttattatgaagatcgccaagcactgctcttcggctttcccttctgttgcgaccggagctattgttggaatggagagtgaaggtctccttgaagtcaccaacaccttccctttccctaccgttgaccccgctacaaccgatggccaccagagcgatgcttcgcagctcgccgctgctgccccccgacagcagaagaacattacctaccaaaatgagatgatccgacacctcaaggaggtcaacgtcgatgccaacaacgtcggttggtacacaagtgccaccatgggcaactttgtcaatatgaactttgtcgagaaccagttccactaccaaagcgccaacgagaacgctgtcgccctcgtttacgatgccagcaagagttcccagggcaacctgaccttccgagctttccgtctatctcctgctttcctgagcgcccaccaggagggaaagttcacaact

SEQ ID NO: 60448 - DNA, 525 bp, Triticum aestivum
  Clone ID: PAT_TA_60448
tgtgcggcgctcgagccggccgggtcgggtacaacaaaaaccgtctccgactatcccaccttctgcgcatcgccatccacgagcacgatcagcatctctgagtaacttggcttctggaagccaaggagttccttcaaatatggcagaagaaacaccccaagacgtctcaatggaatcacctccccccgcgccgatgcaaacagaccaggagcccaaatatggcggctactcgcgattcgagattgaactcgagtttgttcagtctctggcgaatccagcctatctcaaccacctcgcatctcagaagctcctcagccagccagcctttgtcgcataccttgcataccttcggtattggagcaagccgccatatcttaaatacctgacataccctgggccaacactacgacatctcgagcttcttcagcaggaaaccttccgacagcagataattaaccctgatgtggtaaggccactgacgcaggagggcatgagagcctcagccgactgcgaccgcggagaact

SEQ ID NO: 60449 - DNA, 826 bp, Triticum aestivum
  Clone ID: PAT_TA_60449
gccggccgggtcgggaatattttggcgaaattaattacggctccgacgatgttctgtcagctgtcaatgagttgtagttgatggcgttttatgcttctatgcccggcactagaccgttattctcgagactattgatacgctaagccaatagttccggccataacatgacgtttcgaccaacagtgcaacgatactccatcgtcaagtaattgttataatgaggacatggagcatggacgtttcttttcaatttcgtccatctagtcgctcgttttctcctacgttttggcgtactttcactcgtttaaaatcttgaagatgatctttcacacgcttgcagctactgttgtagctgttgctttagccgggaacgtcagggccagtccttgcaagcctgcctctagatcgacggctattcatttggaaacaagttcaattgaaacgactacgatcgagaatctgccgactaccattcaaattctttcctcggctaccactgtcctttcgatcgagacgtttacatcagaagctgccatcagctcggcgacactcacttctgaaacatccatcacctttgacgagcctactacaatcgtgccctcggcaattgaacagactactctagctgcgacaaccacagtcaatgacttgagctctgaaactgccgcggcgactgataccttgaccacggtaagaggtttctgttaccactacagcttatactacaaccgaacaatcggctattgagaccgttacatcctcttcggcacctcactgtacattcacaggcgaatacaccaactatgtccagaacccatcttttgac

SEQ ID NO: 60450 - DNA, 388 bp, Triticum aestivum
  Clone ID: PAT_TA_60450
gccggccgggctgggtgccttgttatctttctccagtgggccgaggtcgtgcattgggcagaactttgcaatgatagaggccaaggctgtgatcgccgtgatccttcaaaggttctcgttttccctatcacctaagtatgtccatgccccaatggacgtgatcacattgcggcccaagtttgggcttcccatgatcctcaagactctagagatgtagaaaatatgtacggtgttaagtataacacaattttgtattatttgactggattttagtatatgttatgcactagataagcttgtaaaattattgatgtataatgtatcctatttgtgagtgtaaataacaaaaaatagtcactatcaaaaaaaaaaaaaaaaaaggccccta

SEQ ID NO: 60451 - DNA, 815 bp, Triticum aestivum
  Clone ID: PAT_TA_60451
gccggccgggctcgggagacgagacatcaagtcatcatcaactgagtcaatcttgccaattgcagcattctttctgtttactctgtacacacaagtcaatagacaatggaccagcaactcatcctcccttccactcccgcagacggcgtacgcgtcctcgcgttaaacagaccctccaagcgaaacgccctctcgcaggaactcataaccatctttctggaacagctcaagacagcatcccaagacgatggcgtgcgagtcattgtcatcactggcagctcgactttcttttgcgccggagctgatatcggggagatctcacgcctcgatgcggaaggcgcgcgggactgccgctacttgtcggatctttgcacggggatgcaagccgtgcgcaagcctttgatagcggctgttgagggaatggcgctcggtgggggctttgaactggctctcatgtgtgacctgatttttgcagcgcatgacagtcgatttggtctcccagaggtctcaattggtcttatccctggtgctggcggtacacagcggcttaccaacgccgtaggaaagttcaaggccatgcagatgatccttcttggacgtcccatacaagcagaagaggctcagtctgcaggactagttgcgcagctctatgaaagcggcagcgtcttggacaacgtggtgaaagacacggcatcgacgcttgcggcgctaagccccacggccttgggcttggctaggggagcaatctgcaaatcggatgatttgggggttgatcacgagttcgagagggagttgtattactttgcttttgggac

SEQ ID NO: 60452 - DNA, 834 bp, Triticum aestivum
  unsure (1)..(834): unsure at all n locations
  Clone ID: PAT_TA_60452
ggccgcttcgaggccnggccggtttctcagatcatcaacacaaaccaatacccctctaaagccttcaaataccacgatctgcctttgaagcaaaccgcgttttcttttccttttcttatccctaatctctcatacatactctctacacattcaaacacacacatcacacaaaatgggtcccgccgtcggtatcgatttgggtaccacgtactcttgcgtgggtatcttccgtgaggatcgatgtgatatcatcgccaacgaccagggtaaccgaactaccccctcattcgtcggtttcaccgacaccgagcgtctgattggtgatgccgccaagaaccaggtcgccatgaacccccagaacaccgtcttcgacgccaagcgattgatcggccgcaagttcgccgatgctgaggtccaggccgatatgaagcacttccccttcacaatcatcgacaaggctggcaagcccgccatcgaggttgagttcaagggtgagaagaagaccttcacccccgaggagatctccgccatgatcctcaccaagatgcgtgagactgctgagtcttacctcggtgagactgtcaacaacgccgttgtcaccgtccctgcctacttcaacgactctcagcgtcaggctaccaaggatgccggtctcatcgccggtctcaacgttctccgaatcatcaacgagcctaccgctgccgccattgcctacggtcttgacaagaaggttgagggtgagcgcaacgtcctcatcttcgatcttggtggtggtaccttcgatgtctctctcctttacattgaggaggtatcttcgaggcaagtctactgccg

SEQ ID NO: 60453 - DNA, 259 bp, Triticum aestivum
  Clone ID: PAT_TA_60453
cagctgaggttgctgccagcccacccgagttcgagtcccggcacggacgcgtgttgctcacggagtttctcctataaagaaaagtcattaaaaaaaaaaaagagggggggtaggggctctacctctctagaactaacatatccaccgacactcacagaattcaatatcaagcttatcaatacacactacctcaagaatacgacctctacccaaaacccaccataaaaaaccaaaaaatctgccctctcatttccctaat

SEQ ID NO: 60454 - DNA, 748 bp, Triticum aestivum
  Clone ID: PAT_TA_60454
gccggccgggttgggatctcattttcactttgttcgacgatcgagcttttacgcgatcttacccccagatatcgaccgtgactcataaccaccaccaccttagtactcatataaacggcaatctactacgaatttgtccgcaccaatctctcatatcagctgcccgcttcaccaggaccatggcgccctcaagacccgagacaaaaaagtcgaatcctgacatcgcaaaactacttgtcgatgcgcagactcagcttgaggttggaagattagaggaggctgctacgcttgcccagcaggctctcgacaccactggccaaggtggtgactttgagctcagcgctgccaaccttttgggtactatctttgttgaatctggcgaccttgacgaggcccgagctgcctttgaacgtgcggttcacctcgatcaagacggcaccgtggacgagaagattggtggtggccctgagaagttccttcttctcgcccagctcagcgaggagggcggtcttgacaccgttcaatggtatgaacgtggtgcgacagcgctccgaaagcagattgcggtgctgagcgagctccgatcacccacccctgagcaaaagacatctatccaggagaagcaacacaagctaggcggagttctctgcgccgttgccgaggtgtacatgaccgacttgtcttgggaacccgatgccgagtcgcgctgcgagacccttaatcacgaggctatgctcctcgcacctgc

SEQ ID NO: 60455 - DNA, 723 bp, Triticum aestivum
  unsure (1)..(723): unsure at all n locations
  Clone ID: PAT_TA_60455
gccggccgggtcgggatgtcgcagccacttacacaccagatcactctcagtgtgtatatagcctaagagtggactagtaatttcgtctgaattgcttcaagtccctatcctttgtgctacccgcctacatacatcatggagtcagggtcaggaacaggaacaggaactccaaacgcgctggtgcgcaagcggacagacacttctttgatgccccctcctcctccagccaagaagattaagcggccaaagaaggtgctcgacgaggacacctacacagagacgttgtctcaaatcatagcccgagacttctttcctggattgctacagacagagacacaacaagaatatctcgacgcattagagtcaaaagatgctgcttggatatcgagtgcaggaagaagactccagcatgttatgacaccaggacgccaaaacacaccactccctccaaagtcaacaaactctttcgctcctggagaccgcacgccttcgacatatggaggagatacaccagcttcggtcatctcaaatgtttctgattttcagccacggcttaaaaccaacatgagtttatcaaagttccaagagacttatacaagcgaagataacgaaagcttttataagcttgttgacnagcacaaccagaaaaaagctgaaaaatacgcttagctctggcgcgggaacaaattgccttcgaagcaaatgatcaaccaaaggaagttg

SEQ ID NO: 60456 - DNA, 567 bp, Triticum aestivum
  Clone ID: PAT_TA_60456
gccggccgggtctcgtgttagttgaggcccagggcaagaacggccgttacttccgttctttcaccgccaacagcctcgacggcaactggacccccaacgctgccagcgagtccagcccctttgccggcaaggccaactctggagctacatggaccaacgacatcagccacggagagcttgtccgtacctccaacgacgagaccttccccatcgatgcctgcaacctgaagctgctgtaccagggccgcaaccccagcgcttcagctcccggttacaacagctggccttaccgccccggtctgttgaccctcaagaagtaaatccctgggctcttgtcatgagcagtgctttgtgagcacgggttaacttacctttcttctggcggcttgcatttgtgtggatcatggatgtggctaccagtctttgtttttgtgggcggtacatggtgtttttttgcctatgaccctcattcacttgtaaatagttgattctgattgtatattattactatgaaatcgaaatgaagtcattcattcaatggaaaaaaaaaaaaaaaaaaggccccta

SEQ ID NO: 60457 - DNA, 616 bp, Triticum aestivum
  Clone ID: PAT_TA_60457
gcggccgctttcgaggccggccggtacctgagacgacgccctatatcatctagtatttgattactgataatggtgcatgtaacatttcctcctttgcgtccatgttatgacgcctccaaatctggctccgattacagttctaaggtgtggtgttgctactcttgctatctcccacgcatcgaccaggtcgaaagcaccgtcgatcggacgcgcgatgttatgacctatcgccgttatggccacgagttcggacatttctcctcgttccactgaattttgagattcatgaatgtctgtgttgcgattgctctatgcactatccatatccctcaaagttgatcctgttatcactcatgatacccgaaatcaaatactaagattaatcgactttcttatgcaggcttttcatatcaactttctatctctatcattgtctactatgttgccgaaaatgctcatcatctcatatccagcgacgtctatgttgtctgtctccgtctcctacctgactgtgtctcctcagaatacacttgcgggccaggcacctttcgattccggaccccaagtccccaggctgtccaaagatactggtactaccacatctgtcggaattcac

SEQ ID NO: 60458 - DNA, 817 bp, Triticum aestivum
  Clone ID: PAT_TA_60458
gccggccgttctgggaaccttcgtccaccattctcctgccattgtacaatcgccacatccgttcattcattttccctcacaatggcggccccttcgtttgacaccacgccagaaaatcaggctggaattctacatttcttccggcagcagctgagatacaagccccaagctgtcaccggtgtcagcctcgagggaaagacgggcatcgtcactggagctagctcaggcattggacttgagaccagcaggcagcttctcgatcttggtatcagcaagcttattctagctgttcgcaacttggaaaagggcaacgcagccgctgaggatctggccaagggccgaaatcctcctctcaaggagggcaccattgaggtgtggaagttggatctcgacttttatgactccattaccgcttttgccgagaaggccaaatctctaacgcggctcgacatggtgcttatgaacgcagggctttgtcccgccaagcgtgttgtgaatgaacaaacaaagcatgacgagattatccaggtcaactatctatccaccgctcttctcactctcttacttctgcctgtcatcaaagccacgcgcctaaatcaacccggaccaactcgcgtcaccttcacatcctcagaagtggcagcatggtcaaaattcaagtacgacaatggcatgaacatcatcaagacactggattcttccgaaaagggttcagatacactttcccaaatgtttaactctaagcttcttggtcagttcttcatcgccgaacttgctaagcgagtgccatcatctctcgccattatcaacggagcct

SEQ ID NO: 60459 - DNA, 755 bp, Triticum aestivum
  unsure (1)..(755): unsure at all n locations
  Clone ID: PAT_TA_60459
gccggccgggctgcggcctaccactctctggcaaggaccccgagggtgctttccccattgtccttggacacgagggtgccggtattgtcgagtccattggtgagggcgtcaccaacgtcaaggttggtgaccacgtcgtcgctctctacacccccgaatgcaaggatctgcttcacttcatgggcacttccaccttctcccagtacaccgtcgtcgccgatatctccgtcgttgccattgagcacgacgctcccatggaccgaacctgtctgctcggctgcggtatcaccaccggttacggtgctgccaccatcaccgccaacgtccaggctggcgacaacgttgccatcttcggtgccggctgtgtcggtctctcagttgtccagggtgctgccgctcgcaaggctggcaagatcatcgttgttgacgtcaacccttccaagaaggagtggggtgagaagttcggtgctactgacttcgtgaaccccaccgagctcggtgaccagtccatccaggacaagcttatcgagatgaccgacggtggttgtgactacacctttgactgcactggtaatgttggtgtcatgcgcgctgccctcgaggcctgccacaagggttggggtgagtccatcgttatcggtgttgccgctgctggccaagagatttccacacgaccattccagcttgttactggncgagtgtggcgaggatgtgctttcggcggtgtcaagggacgttctcagctgaacgatctc

SEQ ID NO: 60460 - DNA, 750 bp, Triticum aestivum
  Clone ID: PAT_TA_60460
gccggccggtctgggaactgaatcttatactcctattatctcatcaatgcctcctacctctcttacccgagctcggaaatcaccttgcgtctctccacatcaccattgtacgcgcaaccctcgaaccgtgcacctttgaactcttctcacatggcatcccgatgatgaacacaacttctcccagatctgtacctgggagagcacgacccccgcaactactgctccaggctactacgactaccaccctccaccgcgtagttcccatgtttatgggtgacggacatgactttctcgacggttacgaggctggatcaccctgtgcctggggcttcgaggctttcgaggatgacaactttacggtaatccatgaccagcctggtcttctctccatggataatgctgtacccaactccaacgaatctcacgtcttcatcaccaccgttcccacatccttcctctacaatcatgacgttgtctttggctacgtctttgaagggatgtatgtgtacctcaagatggaggctactaatcaccggctaccgcgaaaaggatatgccgaaccttgacgtggacatctctcagtgctaagagatgtacgcgaaccgtacctgttgtgacccttatctactacataatgtctctgccgagggatatacttagaccaaaggagcgcaatccagtgaatggagagaccgagatctgtgaacagtttagatacccgtcgtgaatacgaacctccatgtgcccctt

SEQ ID NO: 60461 - DNA, 562 bp, Triticum aestivum
  Clone ID: PAT_TA_60461
gccggccgggctgcgatatccttcctccttctaaacagacataatgcctcgttcagatgaagcagaagccttcttccacgccgtctactcagccgtccaagaaatcccacatggcaaagtcactacatacggccacatcgccgcgctagtaggaaccccacaaaggcctcgccaggtgggcgtttgtctaaaacaccttcctgctgatccgtctcagcacttcaaccacgataatgtgccgtggcagagagtcataaactccaaaggacaaatatcaccaagatctcaaccaggagaatctcgctcacaggctcaagctcttgaagccgaaggcgtagaggtagaaacaaatgccctcggcgagcactcagtagacttttcacgctatgggtggttcccagaagtactcccatcagaggaggatgagaatgattagaacggttttgaactagtatttaccactatcggtttgagacaaataaggtcccgtatatgtaatgtaatgcgaccccaatcagggccttcataaaagtcggaaaaaaaaaaaaaaaaaaggccccta

SEQ ID NO: 60462 - DNA, 850 bp, Triticum aestivum
  Clone ID: PAT_TA_60462
gccggccgggtcgggaataacaaggatcgccttgtcgtcccttctccctctcttcttcttacaaaacagtcctcccctcgttattgcagaggcgtggtttatcataaaccagcattctttgcgcccgagacctgattgtcatacgtgcggccttggctttgcattcttccatttagaaggcgagacacggaccccgtcttgtcgtcgctttcccctccattcagattcttgatctccagctgtctccaaaatccaacgggtcgctatccgactaccccgccaacatgagtttcgccggcatgctaaacaggcttcacggccaacccgagagctacgataagaaagccaagtacaagttcggtcgaaccctcggtgctggaacatatggagttgttcgtgaggccgatggccctaccggcaaggtcgctgtaaagatcatcctcaagcgaaatgtcaagggcaacgagcaaatggtctatgacgagctcgagatgctgcagaagctcaagcatcctcacatcgtcaagtttgtcgattggtttgagtcaagggacaagttctacattgttacacagctcgctactggcggcgagcttttcgaccgtatctgcgaacagggcaagttcaccgagaaggatgccgctgaaactatcaagcaagttcttcttgctgtcgatttcctccacaagaacaacattgttcacagagatctcaagcccgagaatcttctctacctcaaccgagaccccgaatccgacctcgtgctgggcgactttggtatcgccaagatgcttgacgggaagggtgaatcgctcaaaactatggctgggtcctttggttatgctgcccc

SEQ ID NO: 60463 - DNA, 820 bp, Triticum aestivum
  unsure (1)..(820): unsure at all n locations
  Clone ID: PAT_TA_60463
gccggccgggttgggagtagagaacaacctctgttcttgcgactcaccaagaacaccgtcgccatgaagttgtcaaacccgggcaccgttcccgtatacacaatctcgggcgcatcttcagcacgacctcttcccgactggcttgcgcgacgcagaaagcgaagtttgaaggatgatgccgaataccagaatcgtgtcgagctcctccaggatttcgagttcgaggaggccagcaactgcattcgagtcagtgaggatggtggctggatcatgagcactggcacatacaagccgcagattcacgttcacaacttatctcagctgtcgctgtctttcgcccgtcataccaacgccctcaaccattcctttgaacttttgtcgtccgattactccaagtccatacatctacaaaccgatcgccgtctcgaatttcacactcccatgggctgccactatgaagttcgtcttcccagatacggccgagcccttgtctatgaccgacagtcgaccgaggctcttataccgtccgtcggcctagatggtgatggcaagggtgaagtattccgtatgaaccttgnagttgggacgtttcatgaagtcataccaggtncgatgtcnggtggcgacgacgaaactgactggcggtggtctacaaggaggaattggagtcggtagtgtcaacactgcagccatcgcaacaaacacccacaatctacttgctttcggaacttcgataggnaactggtgagttctgngaccctcgatcaaagtctagagttgccatgttgngcggcattgatggcgaagcacagcacttgac

SEQ ID NO: 60464 - DNA, 653 bp, Triticum aestivum
  Clone ID: PAT_TA_60464
gccggccgggtccggtctctgataccatggcccttcgtgtcgttgttcctcgcaactcacgagccactgcctactgtgctttcgacggcaagggccgtctcgagctccgacaaggagattgtgtcaccatcactgcctctcagtaccctttccctaccgtcacccgcaccgacaccgaatggttcgacagtgtcagccgcactctccgctggaacgttcgcgctgctgcccagaagccctttgacgccgacgttgcagaagatggcaaggatgacgaagagatcgggtgggatatcgacaccgatagcgcatgttacgctagcgaggacgggagtgtcagtgccagccccgttcgtcgacaaatgagcctcctgggtctatgatgcggagcctcatccctatacaagagaaaaaacaactgattaaggcaaggtgttggcggcgtttggcttttttgcattaccagtttattggaaatcaaatatatcatagatcaggcctccactgttgattaagggaggaccagccaaggataattcaagcatgatggcgagcaggtacttagacatctagattcagaagacacatcgtcttcttgtcgatgcaatatacagaatgcatgacttcaaaaaaaaaaaaaaaaaaggccccta

SEQ ID NO: 60465 - DNA, 750 bp, Triticum aestivum
  Clone ID: PAT_TA_60465
gccggccgggtcgggctctatcgcctggttcctatccccctctacctcactctccaatctccagagcaagctcgcgcagcgcacgcacgccggtgcagacacaggaacgtcaaccatggctgcgccgccggccgagcgctcgttcgacgtcatcgtggtgggcgcgggcatcattggcagctgtgcggcgcacgcggcggcgtcccggggcgcgagcgtgctcctgctcgagcgcttcgacctgctgcaccagcgcggctcgtcgcacggcgagtcccgcaccacccgccccacctacacgcggccgcagtaccctcccatggtccggcttctacggcacgccgtcgatggaatacccgggcctgatcaaggtctgccggaacggcgggccgccgtgcgacccggacggccgggactgggccaccggcaccggcgcgggcgggatcgcggagatcgtggcgcggtggatcgacgagtttatgccgggcgtcgtggacacagccggcgggccggtgctccggcagccgtgcatgtgctgcatgacgcccgacgaggacttcgtgatcgacttcctgggcggggaggaattcgggaaggacgtggtgattggcgccgggttctccggccacgggttcaagatgggcccggccgtcgggaagatcctcgccgagctggcgttggacggcgagtcgggcacagcggcggaggccggcttggagctcgagcactacctgatcggacggttcgagg

SEQ ID NO: 60466 - DNA, 845 bp, Triticum aestivum
  unsure (1)..(845): unsure at all n locations
  Clone ID: PAT_TA_60466
gccggccggtttgggcatcaaggagatctacaatgccatccccaagcactgcttccagcgctccgctctcaagggatacggatacatcctccgcgacattgtccttcttgctaccacctttagcatctggtacaactatgtgacccccgagtacatccctagcactcccgcccgcgctggtctctgggctgtctacactgttctccagggtcttttcggtaccggtctctgggtcatcgctcacgagtgtggccacggtgctttctccgactctcgccttatcaacgacatcaccggctgggtcctccactcttctctcctcgtcccctacttcagctggcaaatctcccaccgaaagcaccacaaggctaccggaaacatggagcgtgacatggtctttgttccccgaactcgcgagcagcaggctactcgtctcggcaagatgacccacgagcttgctcacctcactgaggagacccccgtcttcactctgatcatgcttgttctccagcagctcgtcggctggcccaactacctcatgaccaacgttactggccacaactaccacgagcgtcagaaggagggccgtggcaagggcaagcacaacggtctcggcggcggtgtcaaccactttgatccccgcagccctctttacgagcacagcgatgctaagctcattgtcttgagtgatattggtatcggtctgatgggtaccgctctgtacttcctcgtccagaagtttggcttttacacatggncatctggtactttgtcccttacctttgngtcaccactggctcgtcgccattactttccntcagnnacacgaccctacctttcccact

SEQ ID NO: 60467 - DNA, 864 bp, Triticum aestivum
  Clone ID: PAT_TA_60467
gccggccgggctgggatctccatctctctcttctccattcatcttcctctccattgattgcttccatattggtcccccttctactaataatcctccctcatacttccttcacaatggccaatattatcaagagcgcgctgcctacccacctcaagcccaacaccggcgatgagcagggcaacgagcgtcgtcatggcaagacacgcagtcacatggctttcgagaacacctcgaccaacgtcgccgccgctcagatgcgaaatgctctgaccaacctcgccgagaccgtcaaggaccccgagcaaaagaagctgttcgagaccgagatggacaacttctttgccctgttccgacgttacttgaacgacaaggcgaagggtaacgcagtagactgggatcgtattgcacctcccgcccagggccaggtcgtcgactacgatgaccttgccaacaccgagtctgtccagttccttaacaagctcgctgttctcaagctcaacggtggtctgggaacctctatgggttgcgttggccccaagtccgttatcgaggtccgtgatggtatgtccttcctcgacctttccgtgcgacagatcgagtacctcaaccgcacatacgacgtcaacgtccctttcatcctcatgaactctttcaacacaaacgacgacaccgctgccatcattaagaagtacgagggccacaacgtcgatatcctcaccttcaaccagtcccgatacccccgagtctacaaggactctctcctccctgtccccaaggacaacgactctcccatcaacgagtggtaccccctgggtcacggtgatgttttcgagtctctctacaactctggcattcttgacaagc

SEQ ID NO: 60468 - DNA, 741 bp, Triticum aestivum
  unsure (1)..(741): unsure at all n locations
  Clone ID: PAT_TA_60468
gccggccgggttcgatattcgtcttcttccctctagcctttccccttccatgtctttttcaatcccagtcaatattatatggctcctccgcttcttattcttcctattcccaatctcccttcacctgtcgcttcggcctgcttccatggctggaactacaaggtgtcaaatccaacggggatttaattagcggcagggatccacggtggtgttggactggtggaaaaggtagccgattcactgggcatcaccgcttctgactgcctcgattggttatgtcatcgtcagtgtcatcgacattgcggaccaatcggcaccctcaatggcgccaggtagtgtgcaagcgcgggtacagatcgatgggtgccctctaccggcacaactgtatagcatgcatgatccatggcgccgggcaacatgcaagctctgctgcagatcgatggttcatagtagaagcgacaagaaaggcaacctgaaggtctccgcgccttcatgttaggtccgcgattcctcgagtgcttcttcatggagtctgtaggcgaagaactggaggaaggaggatgaaggatggacggtgactgacatttattaggcaggattagatatgctaaattgtttgattaccatggtcaccaaggcacttagatgtatctatgcttggccacagaagtcacattcagttttcatctgtttcataagccgctatganactgtcaaaaaaaaaaaaaaaaaaggccccta

SEQ ID NO: 60469 - DNA, 724 bp, Triticum aestivum
  Clone ID: PAT_TA_60469
gccggccgggctcgtcagatggaaatttggagacatccttttagctgatgttctcacatcatacgccaaggtctttggggacctcttcatcactctgtgcatgtttttcacagctcaggggtcgtctacacaacgacctgatcgcaattgtggaggaacagtcctcgtgcctttcatcatgggagtgccgagtttgatacgatttcgccagtgtttgatcgaatattttcgtgttcgacgggctccgtataaagaatccacaggatggggcggccagcacctggctaacgcactcaaatattcaacggcattcccagttctgatcaccagtgcttggcaaagatcggtcgaggatcccgagtccaaggcagccctccacaaggcttggcttgttgctgtcgtcatcaattcggcctactccttctattgggacgtggccaaggattgggatatgactctcttttcttccagacaagaccgcgaatcccctactcatttctttgggctgcgagatcgcttagttttcagaacccccaatctttattatctagttattgccatggacctgatgttgagatccacgtggtcaatgaagctcagcagtcgcttggacaagttcagcgatctggagggaggcatctttcctattgaatttctcgaggttttcccgccgatgggtatggatattcctcccgcgttgaacagaatggctaagaaacaactc

SEQ ID NO: 60470 - DNA, 889 bp, Triticum aestivum
  unsure (1)..(889): unsure at all n locations
  Clone ID: PAT_TA_60470
gccggccgggctcgggaactgaaacatcttcaccagcactcacaatgtctcaacctgatccgaagcgcgtcaagaccgatgacgaagctccctacgaactcatctactggcccaccattccaggccgcggggaatttgtccgccttgtctttgaagaagccggcgtcccctacaaagacattgcgcagaaccaagaagagggctttaaagccgtcaaggaactcactgccaccgataacatcggcgatgatcacaacccgcctgctctagctcctccggcactcaggcacggcgatttactcatctgccaaactacaaacatccttctctatgttgcacccaaagttggattggcgcccaaggagggcaatgggttataccacctgaaccagattgctctgactatcatggatggtcttgtgaatgaactccatgatactcaccaccccatcgacattagcgcgtactatgacgaccaaaaggaggaggccaagaagagatctagcttctttaccaaagaacggattcccaagtacttcaagtacatgcagcgactgctcgatgccaagaccagtggagaaggaccatggttatacggcgatagtcttacgtacgcagacctcgtactgttccaggctgttgatggtaccaagtttgctttccccaaatctgtcgagaaattagaaaagtctggtgaatacgatggtgttttcaagatatacgaagccgtcaaggagagacccaacatcagcaaatatctccaaagtgatagacgctacgcctactcggatggtatttaccgatactaccctgagctgcaagaagagtanagacgagattttnaattgaagcagcattacagttcctacatgagggaccctcagggtat

SEQ ID NO: 60471 - DNA, 787 bp, Triticum aestivum
  Clone ID: PAT_TA_60471
gccggccgggccgggagcgtgtccccattccgatccccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcgatatcagcaagtgccagttctaccttgacatgctgaacgagtgccgccgtggaggagcaactctttaagctactatctttgcttgattggggcttaattgggcagaacctgttttcagtcatgatgatgatgatatatatctcctaaataattcattggcaatattatgaacctatgccacagcttgtgtctattacctaccctagttcgtggtctctgttgtcccgggagtatttccttgtattgatgttggaattaccttcatggcagtgggtttataaatatggagtttgaaaaaaaaaaaaaaaaaacgaaaaaaaaaaaaaaaagccccta

SEQ ID NO: 60472 - DNA, 694 bp, Triticum aestivum
  Clone ID: PAT_TA_60472
gccggccgggtcgggatcacaccatctagatcaaaccacctatcacatgttaataaatctctactcccactaagtcactgcaaatcactctactgcccccaaaagtcacaatgtctacctcgagctgttgaagaatttctagcgcttactgcctgggcgaagcgataccactgtaaagaaggcagccattggaacagtgattaccaccaagataatgctaactctcgctctattaccctcaatagtaccacatgatcaagaatcaactcgaaaagcaaaacctggttatggaaagtaccattgccgaggagaaccggatgctcgagtggaccaaggtagacaacaactgttctgcgattcagcgccaccactcgagcttgcatcatccttgttgtggctaaagctatatttctgaagcatactagctctctgcgcgcgcactgcaagaaacaccctgataatcccagcgccctaaaaggcccctaagactatcaagaaattcagaatctcacctcatatgcacaacacatcactggtaagagtaaaaagtgctctacttgaaccgcgccactatgcgaacatcttctacaggattataggctcaacctctgactacgagaacagtagtgagaacgttggtactctgttccagattatgaggcacatgatgtccaatatcaactagcaaaagcac

SEQ ID NO: 60473 - DNA, 705 bp, Triticum aestivum
  Clone ID: PAT_TA_60473
gcggccggttctcaaacactcttcatttccgaaccttttctcctcattagtcaataccagtcaatatcactttattggtgttctagtataccactgtactactttctttatcatactaagcatgagatgcctgcacgataataacaccgatgaataggtttgacatagactcatcgcacaccacaagaatgaagacaaagcccgctgctctcgtctgtgagaacgcttcacctatgtgcacatcctctgttcagatcgtgatgctcggtacatctacgtgtgataggtttttatgctccgcctaccctcacacaatgcaatgatgaccggaatgagcacgaactcatcttatggtgcggtggttactctaccgaacttctcgatcctcgcacgtgccatacacaatctcggacgtcgactaggacttactgggagatgtggagaagatgtggaccacaacttctacgacgacgtcgagaccgaccacgatgagcaccgcgccttgaatcgcctacgttgacgtcgacctcaagtgaaactccaacaatatgagcgacattgtcgtcaagaacgtcgactctgacggtgtcaacctctctatccactccgataagtgactgcacggctacgacatgaacaccaaggatctctatggcgtactgccgacgaaactacttcttctgtgctcacgtaccagagtacctg

SEQ ID NO: 60474 - DNA, 182 bp, Triticum aestivum
  Clone ID: PAT_TA_60474
gccgggcgggtatcctaaagtcatcgtgaagttgactgtctctttcgcggctcttgctgctgcagcattccatccatgcggctggcctaacagattactgtgccgtcgactctactacgcgcagaagtggcggcgaccacagcgctaccgccgtctgccgaaactaccttgcgatatacctg

SEQ ID NO: 60475 - DNA, 671 bp, Triticum aestivum
  Clone ID: PAT_TA_60475
gccggccgttttccaacaagtcacagtagtgacatcgtttcgccggtatggccttctcccgtgttgcatggccagacatcactgcaatcttgctggtgcgcggcctgttcgccgccttctcggcggcgtcggccgactgcttcgactgttgatgatggacaggctccgccagcgataagacacacgcaagcggactgacctgagcacggatcaaaggctgccgcgcttccaagggtaccgtcacaacgtgtggtacatctaggacaccaaccggtgcggcgacctcacctactagctcgacgataatgaattctgcgacctcacccaagatgatctcctggatagatacgcgcctccctacgacgctgccggagatgatacaggcattacattgcctgctgtgctgcgcctacgccgatctgtgatcgtccggcgtcgactatggcatctccttggaggatccgcctcacaactggtactgcagatccaagggcgccgtcacacctgtcaagtcccaaagcgcatgatgcgctatctgctgagcgatcctgacggatgctatgatcgacactctgtactggatcacgaccgagatgatggtgcccctctcgaagcagcatctgatggactgctaccagcacaacgacgtctgtaaccgcgagatctatcac

SEQ ID NO: 60476 - DNA, 116 bp, Triticum aestivum
  Clone ID: PAT_TA_60476
gcatgcttcgacgtttccctccgccatgctccggaacgtgctctccgtcctcgtcccgggctgccccgtgttcgcccacgactgcctccagaccggccgcaagtgctacatagggc

SEQ ID NO: 60477 - DNA, 831 bp, Triticum aestivum
  unsure (1)..(831): unsure at all n locations
  Clone ID: PAT_TA_60477
ctgtgcggcgctcgaggcggccggttctcgacccttccattgagcagcaagttaactaccgatcgagagtgcatatataggctatagcacttagtttgcagagcaaacaagcatggagaagctctccatggcggcgactatgttctgcgccatggtccttgcggctctggcggctgctgccggcggtgaggcggcggtcgtggaacacacctttgtagtgcacgagatgaaccagaagcacctgtgcaacacgaccaagatttacgtggtgaacgggcagctcccgggccccaccatcgacatcaccgacggcgacacggttgtcgtccacgtcgtcaaccgtctccctcacgggctaaccatccactggcacggtgtccggcagatgaggagctgctggtccgatggcgccggctttgtcaccgaatgcccaatccctcccggcggtgagcacatgtaccgcttcaacgtcaccggtcaggttggtacattgtggtggcacgcccacgtcacctgcctccgcgccaccgtcgccggcgccttcatcgtccgccccaagggcgggaggtacccgttcccgacgcccgccaaggacgtgcccatcatcattggcgagtggtgggagctcgacctcgttgagttagacaggaggatgcatgatggtaacttcgacgacaatcctctatcggcgaccatcaacggtaagctcggcgacctcagcaattgctctggcaagccggaggagagcttcgtccttgacgtggtgcgcgnggacacatacctgctgcggattgtgaacacgcgctcttctcggatactacttcaggtcgc

SEQ ID NO: 60478 - DNA, 736 bp, Triticum aestivum
  Clone ID: PAT_TA_60478
gccggccgggttccgaacacaagcccacctctctgagcattaccacttgtttctcataattccttaaaaatactctctggcccttctgatgatgggatactttgagtaccttcatctgctcgtaacgccaatcactggaacattaggtcgatgcattgactccatccatgagcgtgacgatgccaacgccacctcagcactcaaggctcgccaagccactgcgaccatggaaagaaaccacatggtgtacttctactcgtgatgatctgatgaggctgcttatgccccataccgaatagggtgaagcccgccactaccacagtgattggtacttcaccgtgaacatatgtgctggtaagacaaggcaaccactgtgtactgcacgaatcatagactatggaggttccttcttccatctaggaacacggataccttgtgcataacttatggacccgatcaccccctcttggagtactactgtgtcaagcagagtacgtttcgttactacgcccgaaagacagtgtcaacaactaagcaccgactactcctgcgtcgactgctacgatctctatatgtccacccgatagccactaccttcgatcgacgtcgataacaacttcaaccaccactgtgccatccgtcgatacaagcgtaacagagactccgtccacctgcagaaccacttcaatgcttgtagatctgctgtgatgaacctcagaaaccactactaccagat

SEQ ID NO: 60479 - DNA, 427 bp, Triticum aestivum
  Clone ID: PAT_TA_60479
gccggccgggtccgtagaagaaaaggacgctgaggatcggcgttggggacttattccttcgataaaaggtgctagcagaggtggagtttgtcattcaaagcatgtaaagtttgaaggcaatgcgtgtcgtcaacgatatgacagacacaagtatacaacatttgcctatttggtgcgaaggtgccaacggtatcatgcaccgagagtcctaggcattggcgttattgttcgatcagcaagcgcgtagttgtaaagagaacaaacgcagggatgggttgcatcaatgtttgcgtgggtggcttttacccagtcacctgaggatggatggaaagacagatgaaaggtagcacaagctgcctaagcaagatagtggatgaatacggcatacgggtttatttttgaaaaaaaaaaaaaaaaaaggccccta

SEQ ID NO: 60480 - DNA, 860 bp, Triticum aestivum
  unsure (1)..(860): unsure at all n locations
  Clone ID: PAT_TA_60480
gccggccgggttcggaattacccaatcactcactctctattttctcactctcactccactgctcccctgctctgctctactctccactccccggcaactgcaagccctgctgctcctcatctccgcctcgccggccggcagcgcagcgcagcccccgccgcctcctcccctgccagaaccgccgtcgcctcccccccactctcccatcaccacggctcccggatcaggaccagccgcaccgtgctgccgccgcgcacagcagcaggtcgcagctagctaggcgtcagcggcaccggtcaccgacggcagaggcaggcagcgcacatcaccggcggacgacctggtgcgcgcgcgtcaacgtacgcaccactcaacccaagaccaatccacaagggaaagtttttgcagctagccaggacattaatttgtggctaccagcaaccaagatttatgtacgatcacatttgactcattccagacagcccgtttgcagctaagaagctaagcctggacctcatctgcacgcatcaaggtgcaggcacgcacgcccatccgacgatgtacgccgccctcagcacggcgcaatgggtggtgggcaaggcgctggcccccgtagcggatggtgtgctcggggcttgggcagccgccaggaactttggtcccactgtcgaggccctcagcacggaattgttgctcgtgaaggccacgctcgagcaggctgccctcaaggagctcagtggccccgccatggagatgctgctgcagaagctgcnggatttggcgcacagtgccgaagatttgctggacgagctggactacttccgcatccacgatgagctgcacagcacatatgatgcagc

SEQ ID NO: 60481 - DNA, 365 bp, Triticum aestivum
  Clone ID: PAT_TA_60481
gccggccgggttccggacacacagatttgagcacctcatcaccacttaattttccccggtttcaacatagccagcacaaccctcacgcatactcaggcctttgggaattcaccatgaaccagcaaaggactcgtcctatccaaaagcttgccaaagcagtctcacaatgctctgtagaggccacgtcttatggtaaatgcattgttgctgactacaacgctgtacacaaagacaagtgtgttaaggagtttatgaggcttaaagactgttatttggcagcatcaaagaaatcatagcttgcttttacgggtagctgtcataaatattgaacactgtcataaatgtattactcattcaatctttac

SEQ ID NO: 60482 - DNA, 269 bp, Triticum aestivum
  Clone ID: PAT_TA_60482
gccggccgggttccgttcttattattttcgtgaatactcttggaaccgtatcatttcattgacagagagtagaaatagaaattacaggggtggctgtcctactactatgtatacaagggcgcagcaaaggatgccggtgagcagtagaaaagggttgctctccattgatctagttataagtgtatgtcacaaattgtttcaaaaaagagtgtatgtaataagaattgcaagtttcactgattcaaaaaaaaaaaaaaaaaaggccccta

SEQ ID NO: 60483 - DNA, 556 bp, Triticum aestivum
  Clone ID: PAT_TA_60483
gccggccggttctcgattgccagagctctactgcctggatgaatgagatctccttgatttgtacatttgctccagctccagtttgatgttctgatgccgacggtgacggatcttaccagttgcggtgaaggtgctgaacatcttctgcagagcaatggagaggtccttgtaggtgttgtacatcttgagatccaccttgcgcaggtagggcgcgccgtccatgctcaccttgacaaagttggagccgttggcaccagcagcagcggcagcagcaggctgctgcttctcggtctcctcctccttcttgatcttcaccgactggacggtcatggcgttcctgcggtacgaccggactggtggccaacccacggcctgtgccctggtcgacgcataacaagcgaaattagccacaaattttacatttaccacttgcaaatcagttcgtaacataatctagttccaagtccaacccactggtgctgtaaaaacaaataagattctccattgcaattgtagctggaggttccacgaaaaaaaaaaaaaaaaaaggccccta

SEQ ID NO: 60484 - DNA, 887 bp, Triticum aestivum
  unsure (1)..(887): unsure at all n locations
  Clone ID: PAT_TA_60484
gccggccgggtctcgattagtttctaccgtttttcataacatctgacttatcatgggttctcgaatgacgccagaggctatcaagcctgttatgctaattgatggccaactggttggggcctcagatggaaactcgtttcccctctttaacccagcaactggtgaaaaagttgcagatgtccctgaagctacagaagatgacaccaacagagctgtcgcggcagcacagcgtgcattcccagagtggtctgccatggatcctgccaagcgtggcagctacctgaagaaactcgcctctctcatcaaagagcataacgaagaacttgctctcctcgaagccaagtcaatgggtcgtcctttggctgagttcttcgagggtcacattgctgcctctagctatgagcactacgctgaagcttggccgcacatccagggccaggcgagtctcaatacacctggctatgtaaccatgaccttacgccagccttttggtgtcgtcgcagctatcattccctggaatgcctctcttctgttcttcgctagcaaatctgctcccgctttgatcactggaaacacagtggtcgttaaatctagcgaaaaggctcctctcggcgctgccaagttcgctgagctcattcacaaagctggtttccctcctggagtctttaacgttctatcgggtcatggaaacccctctgggcgcgacgcttgctttcctcatatggatgtacgggctattagcttcaccggctcntagccctactggccgtgcgatccaagaggcagctgccaagtccaacttgaagaaggtcatcctcgagcttggcggtaatcacctgtcattatttttgacgatgcagatcttgagcaggctgcccaggatacat

SEQ ID NO: 60485 - DNA, 871 bp, Triticum aestivum
  unsure (1)..(871): unsure at all n locations
  Clone ID: PAT_TA_60485
gccggccgggctgcggaatttctgtcagtccccatccattcgttcttttactgtttttatccattcactctttttattcttccttccaagatgaagtctatttccatcctctccgtggcttttgccgcgctggtctcaaacgtttccgccgccggtgtgactggtacacccgagggctttgccgccgaagccactggtggaggcaacgctgagggagcctaccccaagtccaccgacgagctggtctctatgctcggtgacagcacaacccgagtcatcttcctcgatcaggagttcgactttaccggaactgagggaaccgcctccgagcagggctgtgctccttggggcactggagcaggttgccagcaggccatcaacaaggacggctggtgcaacaactaccaggccgacgcccctaaggtcgacgttacctacgataaggctggactgaaccctattgtcgtcaactctgacaagtccattgtcggcatcggtgccaatggtgttatcaagggcaagggtctttacatcaagggcgctaagaacatcatcattcagaacatccacatcactgagctgaaccctcagtacgtttggggaggtgatgctatccaggttgatggttctgatcttgtctggatcgaccacgttactacctccaacattggccgccagcacattgttcttggaaccagcgctaccaaccgagtttccatcaccaacaactacatcaacggtgagagcaagtggtctgctacctgtgacggtcaccagtactgggtcatggtactttaccggttccagcgacatggtcacactcaagaacaactacatcttcaagacctccggnncgagcccccaggttgca

SEQ ID NO: 60486 - DNA, 758 bp, Triticum aestivum
  unsure (1)..(758): unsure at all n locations
  Clone ID: PAT_TA_60486
gccggcccggttctgaacttcagcatccatttgtcgtactctgacatttcagaaacagcttgtcgttttctaacacaccaataaatttgtacccctccttcgtgtcagatacctcgccagttcttgtgaaagccgccatcatgagttccaacaagccttctcgcaaattttcgacgggcgccacctcgcaccgcaagaggcagatgagcctcatggtcgagaaggatggtcacatcaatgctcctcttcagactttgtacctcggtatctccgccgtccttgctgatgatcacactgccgtcattgcccttgcgattcacgataccgtctatctcaatgacttctccatcaagcatgtctctctcgatgaagagatgcgccagggacaagatctcattgctgatcacatcatcaatgaggtcgagacatacgagcatgttaactttgtcaagtttatcggagccggtctccctgttactctcaagtacatgagcccttctctgtgctcacgtctttggcttgatctcgatatcgtaccggtcgtcctccgacctgatcatgaggccaaggagaagaacttctgngatgtcaagcgcgtcgacgaacaggctgattccatggcccgcaagtgtattctcaacttcggtccttctctcgtaccgcatctacaggtcggccaccgaggtatcgttcagacagatgcanngattccgcgttcatctncacaacatncaaaacccacaggacacatgctccct

SEQ ID NO: 60487 - DNA, 632 bp, Triticum aestivum
  Clone ID: PAT_TA_60487
gccggccgggttccgaacacgataatctcattaagcttctacttacatccctgacgaaggatccattggctactcgcgtcttaacacctctgagtctgaccccgctgctgtatattcacttaccgccgctgtctggccagactgctctgaagcagctggcgccagacccctcgacctgatcaaggttaacggtcctgctgacctagcgctacctgccgatcccaggacaacacctctgccatcaccaacaacatggtctgggataataccaccgcgaggcgcgaacaatgcttgacaaagggacagggcgggacccattgtcgactcttccgaaaccgggactagtattgtaacatagcgccacgaataaccccaacccaacgccgctgtcctatatgctcgccgcggaatcctccaagattcgatacacactcactcctaagcgtcgcaacatgactattaagtagctcaattcaagaacctactatggtcaaggagtaataatgtggatgctatgtactgaataactagatctattacaatccgtacacacgtgattatcagatacatatgttgatgctacagaatcataatataagatcactatgtccgactgcttctctataactact

SEQ ID NO: 60488 - DNA, 846 bp, Triticum aestivum
  Clone ID: PAT_TA_60488
gccggccgggtttgggaactcacaagcacaattcatcaaaatggacaagatggaatacgtcaaacttggaaacacaggcctcaaaatctcaaaggtcatactcggttgcatgtcctttggatcaagcaaatggcaaggatcgccatgggttcttgacgaagaagatggtctgaagcttctcaaggctgcttacgataatggcatcaacacttgggataccgccgacacatactccaatggagaatcagaagtcatcattggaaaggctctcaagaagttcaacattcctcgacaaaaggtcgtcatcttgtccaagatctacaacccggttatggatgatggtacaagacctcctagtgtcaacgatggcccgctagtcaaccagatgggcttgagtaggaagcacgttttccatgctgttgataagtgcttagagagacttggcactgactacatcgatgtccttcaaattcatcgtcttgatcgtgaaacaccaccagaggagatcatgcgcgctctccacgaagtcgttcaatcaggaaaggtccgctacatcggagcctcctccatgtacacctgggaattcgcccgcatgcaatacatcgccgagtccaagggctggacaaagttcatctccatgcaacccttctacaacctcctctaccgagaggaagagcgcgagatgctccccttctgcgaggccacccggtgtcggcgtcatcccatggagtcccatcgctcgtggtcttctcgccaagcctctttctagcaaggacgacaaccagtcaatacgcagtcagaacgatagaagactgatacgtggtttgcggatccaatctcgacatt

SEQ ID NO: 60489 - DNA, 853 bp, Triticum aestivum
  unsure (1)..(853): unsure at all n locations
  Clone ID: PAT_TA_60489
gtgcggcgctcaaggcggccggttgggaatttgataaaaagactgaacaacccaggaaagtcgactgccagtgtaccagaattgaagaattgaatcatacgaacattgttgctggttgccgactacctacctacctactacaccttccatccaccatgacaactccaaacccgttccttcttgcagctgacaacaaccccacgctgctgcccctcctgagggagagaccagaactggcgtcatcgcaagatgaacacggctattccctcgttcatgccgctgccagttacaaccatcttgatctcctacgaacccttattcgcgagtttaatgtggacgtgaatctaaaagatgaagacaacgagaccgccttgtttgttgtcgaaactcaggacgctgctcaagtccttgtcgaagaacttggtgcggacatcggtcaccgaggactggaaggattgacggctagagagaagattgaagcggaaggtgactttcccgtgattgcagagtacctattgaagatcgaagccaagcaagccgacgatccggcttcgactgcagcggctgtcatgcctgaagttatccccccgcctccagagggcatgaaagttacagttggtacgatggacgaggccgcggatattcccgaggagatcgaccaagagtttcgaaggagaattgaggaattggcccagcgcgacgatttcgattcaccccaaggccaagccgagctacgaaggttgattgaagacgctgtgnctggncgaagggtggtgtcggcgacgaacgcaacgtacgatcgaagcaggattaagcgccgcatcctatgccttgatctccacatgagatactg

SEQ ID NO: 60490 - DNA, 831 bp, Triticum aestivum
  unsure (1)..(831): unsure at all n locations
  Clone ID: PAT_TA_60490
gccggccgggtccggcttttgagtttatcttcacttcactgaccgtttccccgcaaagttccaactcagtttcaatcttggcacctgttcgagtccttcatcatgtattcttggatccctcttttggctacctttgcgcctcaggcgttggcgtcgtgtgcttatggaacacatcttcaccgacgagctgatgcaatccaagcccccaagtttggctactccgctgccaatggacctgccaattggtacaacctagaccccgaggccaataagctatgcgcaactggcacgcaccagtctcccattaacctgtccaatggcacccacaaggtcctctcgggatcagatctccagatcgaaatacccgacttccacgacggcgccgagttcgaaaacctcggcagcaccgttgaagtcgtcaccgaaggcatgggcggcaaactcaccctcgacaacacagtctaccacctaaagcagttccacttccacctcccaagcgagcatctcgacaacggcaccagcatggccatggagatgcacatggtccaccagagcgaagacaagaaactcgccgtgattggtgtctacatcgatctcgacgacggccttcctaacgctacctacaaagccaaggctgccgctcgcgaggcgaccggcaaggattgcaagaccacccaggctcagagatccactgtcgctaccaccgtcctcaactcggtggataagattgctaccctgngccagactacccacaccaagccactcaaaatgtccgagattgtctctcttctcgaggctggcgagttccaatcatactctggttcgcttact

SEQ ID NO: 60491 - DNA, 765 bp, Triticum aestivum
  Clone ID: PAT_TA_60491
gtgcggcgctcaggcggcggctcggaaattcacataatttaatctttgtattgactaccactctgtttcctcacttgactccacccttgaattgccatcatcatcatcgacatggcatcttccgaccctgtggttatccccggcgaggttcggttgatccttgcagaggtatcaaccgacgcgtctactttcgtgcttcaaccaacaccatcctcagatcccaatgagcctctgaactggtcttcatggcgcaaatgtctcaatttcggcttcaccatcgccgttacggtggctgcctttaccaatctctccatccaaactgtgttctggcagcagatgactgttgatatgggcgttaccataacacagctcacttactcttcatcggcgcagctagcgggtttagcactcggctgtttgttttttatcccttttactatcaaatatggacgacgaccaacttatgtcgtgtcttgtgtggttcttgcgggtgtcacttggtggagtgccaggatggagagctacgcggagttgatcattacacaaataatcactggtcttgccggggctatcaatgagactgctgttcagatgacgattgctgatctcttctttgtccatcgtcgaggctctgcaaatgcaatctacttcactgccgtcatggtaggcgctttcctttgccccatggccgcgggtactcaagctgcccacgaaggctggcgatggtcctactacagtctggccatctgcctgagcatcctctct

SEQ ID NO: 60492 - DNA, 740 bp, Triticum aestivum
  Clone ID: PAT_TA_60492
gccggccggttctggtttgttggtgagattagcagtagtatttcaaagactgtggaccagggctttggaactacgtttgatgcccatgtcattgctggctaccgctttctcatgcgatactacgagcctggcgcgaaaatctacgtctttggcttcagtcgaggtgcctttactgccaagttcctcgccagaatgctcaacaaggtcggccttctctgtaaaggcaacgaagagttggtcccttttgcatttcgtctctatcaacgccatttgcaaggcgagatcaaggacagtgagacagcccagtgctctcatggccacgaggacgatggagatgcacctcactcccatactggtgaaatccgtctgccgggccaggatcccgctgatgtcagtgacgagaccagagaggcttcaaatgagattgatgcttttagccagacgttctgtcgcaaagagacgaacagtgatggcgaagaggagaatatcaaggtattcttccttggcatctgggactgcgttgcctctgttgctgttctagagcgcaaggctcgcatgcctgttcccgtaactggtacagcacaccacgttcgtcacgctgtggctgtcgacgagcgtcgtgtcaagttcaagcctgctcttcttgcacaggacatcagagctgctgttcacaaccacaagccagccgctgaagagacatcaaagaagtctggttccctggtaaccacggcgatgtccgc

SEQ ID NO: 60493 - DNA, 756 bp, Triticum aestivum
  Clone ID: PAT_TA_60493
gccggccgggttcgggactcactggattaccttacaatcccaacagtttccatcttcaacttttacgaacacaccaggtcaacatggaaaccgtccacggtatttgcagcccccagtttcaaggagttcgtgatctcctcgagaactacatcaagtccaacgaggagcttggggcttcgttaactatcaacgtcaacgatgaagtagtcgtggatatctggggtggacacaaagaccaagagcgaaaggaaccttgggaggaaaacactatcgtcaatgtcttttcgagcacaaagacagtcaccagtcttgcagttctcatcctggtggatcgaggcatgattgatgttaatgaacgggtctccaaatactggccagaatttgggcagaacggcaaggaagatgttcttgtacgacacctactctcttatgcgtctggtgtgtcaggctgggaagagcctctctcaacggaagacatgtacgatctggataaaagcaccccgatgttagcacgccaagctccatggtggacaccaggcaccgcctctggataccatgctttgacctatggacatctccttggagagctcattcgtcgagtttctgggaaatcactgcgcgaattcgtcgccaccgagatcgcaggtccattggacgccgacttccagattggtgcctcagagaacacgtgggacagggttactccgatcgtgccaccagaagcttcaggtatcacggcagatttcgacgtcaagt

SEQ ID NO: 60494 - DNA, 637 bp, Triticum aestivum
  Clone ID: PAT_TA_60494
gccggccgggccggaatttttgctagacgcccctgactcacacatactactgattattcttttgtccctgataccatggggcccttctagctagctctatctcctgctggttagatcgtggcggcgaggtgtgctgtgcgcagctggacgatgggcagttcgcctaccaaggattcacgcgcgccaaacttaccctgagaagcgctcgccgcccgacatgcccggagctgtgctcgcggtcaccaacttcactaatgagacaaaagccaacgccttccacccctgcccggtccgcttcatcaccggtgcacgcaactctgcggccccgcgctccttctccacgagcttcgtcgtcgccatcgtgtccggctgacaaggcctcagagaccaccgcatctgcttcgtaggatccccgaccaccgacttcaccaccggctgctcctggcatgaccatgccgctcctcaaatcaacgaacggaacgggcacggccaccatcatggccgcctcagctgcacactatcctcagtccagagttccgagacatcgacatgaaacgcgacggaatctatgataacaatctcaggctagcgtaaggcccagctagctgcgctacgtacatgacgaccgatccatgct

SEQ ID NO: 60495 - DNA, 797 bp, Triticum aestivum
  unsure (1)..(797): unsure at all n locations
  Clone ID: PAT_TA_60495
gccggccgggtcgggaagtttaaataatatcaattcacaatatcacaatcatgacaaagacacttacacccccagaggtccccaatgtggttctctcataccccgagtctcatatccttcttgttaggctcaatcggccggagcatctcaatgcgatgcagcgacagatgagctttgatcttgatcatctctggaaatggtacgacaacgagccctcactacgatgcgccgtcatcacaggcactggtcgggcattctgtgccggagcagacttgaaagaatggaacgtcaagaacagcgaaagcagcacaaccaacttggacaaatgggcagacaacggtttcggaggtttgagtaacagacgaggcaagaagcccgtcatcgcggcagtcaacggtctctgtctaggtggtggaatggaaatgatacttaacctcgacatggtcattgcaagcgaaacagccaagtttggcctgcccgaagtgaagcgcggcgttgtagccatcgccggcgcgctaccacgactgattcgtaccgtgggacgtcaacgcgcatccgagattgcactgctgggacgcatgtacaccgcagagcagttcctaagctggggtgttgtgaacaaggttgtcaaggctggaggaagttgtctccgaggcgctgcgatgggcggtggaaatgtctaacaattcccccgattcggttatcgtgtcgcgcgaggngttgcttgggtgggtggggagcagaagggcccaaggacagcaccaacaggattgagcatgggtgtatttaagacaatg

SEQ ID NO: 60496 - DNA, 371 bp, Triticum aestivum
  Clone ID: PAT_TA_60496
gtgcggcgctcaggcggcggtttcgaaacaccggctggatcgacgatatctcggcgttggtgaatgggtcatggaccagtccgttgcgattgccggatccagcggctactccgaacgaacccgatgagcgacgagacgcatttacaccttcaaggctattgatatcatgaaaacctccactcagactcagccgcaggcttcgattgacgactttgacttacgaacgcgagaatggacaaagactgcctggcacgcgagatgacgcgctggatttcacataggcgttcggatatatatgactatacatgtgaattggatcaacgatactgaattaacgaagctaataaaaaaaaaaaaaaaaaaggccccta

SEQ ID NO: 60497 - DNA, 858 bp, Triticum aestivum
  Clone ID: PAT_TA_60497
gcggccggtttcgaaagagttattttcttgtctttttatgttttccttgtcccatagagacaacataaagacccttggaagcttcgcctaaagcagcttcagacattcgtttacccgcttttggatactacttgttgtttctttctcattacttcttcaactcttccatttctctttactcgtctcttcgtattgtattcaacacatctatcttgtcgacatatataatacatcgtcacaatggcagccgccgaacaaccgcaggtcgagaaccgacccccgccttcacgaatgagagtcgccctggtggtactcttccattcatcatgtgctatctggagcaccattctttccaagtcggccctcaatggtgttgaggcaccagtcacattgcttgcgctgcagaccacgatacaggtcctactactcactgttatcggattggctacaggatggatcaagttataccgacctcttaatgcttggatcgccctactacctcttacggtcgcacgtctcatcggtatcctggccaagacatactgtcttgcttcagtcaacgcctcggtctaccaaatcgcccgtggtcttctcttgccgttcactctcttcctgtcgctgttggttctccgacctcgcccttactaccctcccatttccctcgtcggctgcgccatggtcatggctggtttcggaactggtatgatggccgactacagccagatgctcacttcaggcaagggtgtcctgctcggtgtcggatctagtttcaccactgccgtcgagtctgtcgttgtcaagcgcttccttggtaaaagcaggagggtatgtggcagatggtttggatgtctaactgca

SEQ ID NO: 60498 - DNA, 871 bp, Triticum aestivum
  unsure (1)..(871): unsure at all n locations
  Clone ID: PAT_TA_60498
gccggccgggtcgcgtctccactcttttgtgactgcctaacctagatcaccacgaaaaagatactgtacaagtgtccaaataccacacaagttcattttatcttcaacttataagtttgagatttagatctcataatcatgcagtctgcagatcgtgatcactttttcgagacagatgctgtccaagctcaacgtcaaagaagggcagcaaaggccgacaacaagaatggtgaacccattgttatgaagtctaaagtacttgctgttgttccagatccagcttatcctcttacttctgtgtttattgctgagtctgccggtgctgtccgtcggatcaaccttgaaacatcagagctcaagacaacataccgtggaccaaaggctcctgtaacttgtgtttctatcggaggcaaagacaatcaaacagtctttgcaggatcgtgggacaaggacatctggtcatgggatgttgagactggaaagtctggtcgcaagttcagcggccatttggacttcataaagactgtcgtttgtgctaccatctctggtaaacacatcctcattagcggaggtgccgacaagaagatatttgtttgggacgtcgagtcaggtaaacgactacacaccctgcaagatcccactacgacaatgctcgccgttcaacacattgctatcgatcccgttctaagcgactcgaccaaacttgtctttgccagtgcgagtagtgacccgcacatcnaggcggtggaagattaccctggacagctacgagcagcttcccgagtcattctctgtccgccccgatgctgagcgactcactatcgaggaacacgagaccagcatctaccggctgggttacgatcaatcaagc

SEQ ID NO: 60499 - DNA, 628 bp, Triticum aestivum
  unsure (1)..(628): unsure at all n locations
  Clone ID: PAT_TA_60499
ggccgctcgannggccggccggtttgcagaggcagttcacttgatacgatcgtgtcattatctctctttcgtcatctaaatcctgagtgacgcgcgcgatcagactcgaagcacgaggcaaaggacgacgtatcgatgtcgagagcacgtacgggcggctggtgtgcgctaatggcgggtgtgacctatatcggttactccagggtctgcgcgtccattgggcggagttgtcgcctggagccctacatgtccgaggacgccgaatgcgagaaggtccgctactccctggtgcaagtggagcgacggaagagtggcccatgcccagcttctgctagtatgatagatgaaagatccggcgacatggtgacagagtccttcctacgcacgatttcaaaagctactgtgattcccgctggccattctacctacaactcgatatctgataaatttatgtttcacgctcacgaatatgttatttacgtgacgttggatgtgttccgacaccattatattgtagctattaatcgctccgtctctacttgaggaattatcttaacttccgctgccgctgctggtactccacggagcgtgattttcgacagatgacaaacctaaagaggcctacgag

SEQ ID NO: 60500 - DNA, 642 bp, Triticum aestivum
  Clone ID: PAT_TA_60500
gccggccgggtcgggaacaattcacactctctgaccgattgctcaagatagcctaaacttcattgcctacttaagcctcatgtagattttcgctccgatgctcacgccagaagacgataaaccttgcggtgcagtctccctgaaccattgacaacggcaagctcaagaaacaagactgggaagctatccccccagaccagcctcgccttatctctcgttgccaatgcaactccaatgatggacatcaccctgcaaccactacaacatccataaggagtccgcccttcactaggacctccgccttcccgtcgatatgatccagaagagtgacaacaacgactacaccacccccgataattagcgaacacaagcgcgataaaaacaagctgcgctgtcctcaagcactacaatgtctactctgatggcccgagcgaataactcctacgctgatgacccaaccgacacttactgacgctcggtgtgttctatgcattgccgtggaagaccgccatcactcgcggcaatgccacctgacctacaactgccacaagcagtaaatgcattcagcactcgatcgatattgatgacggaactgatatgcagacatatatgtccgttatcatgctggatcacaaagcacat

SEQ ID NO: 60501 - DNA, 856 bp, Triticum aestivum
  unsure (1)..(856): unsure at all n locations
  Clone ID: PAT_TA_60501
gccggccgggtcgggttgttaggttggtcagatagccccaaagggctcttgctcgtctaccaactcgtgcccgaaggcagccttgaccgacatatacacaccagctgtctcacttgggcacaaagatacaaaattatcattggcctgggatctgcactacgctatcttcacatggagtgggatcaatgcgtgctgcacggcgacatcaaacccagcaacatcctcctcgactcatcgtgcaacaaaaagttgggggatttcgggctggcgaggcttgtggaccatggagccgggccacggaccacccaggttgtcatgggcaccgcagggtacatagacccggagttcatccgcacacgccggccaaccacagaatctgacatctatagcttcggcatggttctgctggaggtcgtgtccagcaggcggccggacatggacatcgacacggagcaaccagctgcagcagttgacaaagtggccatcccgcttctcaagtgggtttgggacctgtatgagaagagtgccatcgtcgaggcagtggacagaagactaaagggagacgagcagctcagcgacggccatgatggtaagtggcaggtgcaccgcgcgctggttgtcgggctgtggtgcacgcaccctgacccgagcgtgtggccatccgtcgtgcagttcatgaacgtcttgcagttgaaggaagtcacactgccgatcctgtcacggccggggccatcgttctatattttccatgggtcacatggctacaatgcatcgtcgtcctcatcggccacgtttgcagcgatgtatcttggngcagcagtggcagatgaacaaacttactttactgggcctgtta

SEQ ID NO: 60502 - DNA, 761 bp, Triticum aestivum
  Clone ID: PAT_TA_60502
gccggccgggctcggaaactgaataatggcttctcctcctcatattgggagtctctcccgtcttcccgccaacttgcgcggtagtattgagtctgtcaagcgtggtggacataatgtgtcttggcctttgctaaacctcgatctattgcgcaacgtccttctcttcctcttcttttggcgatggtcccgtcgcgcattctggcagctcagaggtcgcggtatcatcggctccgtcgtcgagctatacaccaacatccgtcgcatcctctacggttacttccttcgagcccccggcgtacgaggcaaggtccagcaacaagtcaacgaatccttggttaagctatccgataagctggttcccaaagaccagatccgttatctcaccctgccaaaggagggattctcccatgatgtcgtgcgctccgagctcgagaacctcgccaacatggaccacacgcgctgggaggacggttatgtctctggtgctgtgtaccacggagaggatgaactgctggctctgcagactgaggcgtatggaaagttcactgttgccaatcccatccatcccgatgtcttccctggtgtgcgcaagatggaggccgaagttgtgagcatggttctgagcatgttccacgcccctcctggagctgctggtacatctaccagtgggaggaccgatagtatcctcatggcttgtctggctgctcgtcaaaaggcttatgctgagcgtggagtaactgagcccgagatgattctccccg

SEQ ID NO: 60503 - DNA, 878 bp, Triticum aestivum
  Clone ID: PAT_TA_60503
gccggccgggttgggatcttcagtctatctctaatccggtcaacatagctcacttgggactcaacttctgaatacacgaaactgtgcttgccaccacatccggataactcgcaagccatcatgggtgctcagtcatcaaagccgacacttcatgagaaggctgttctcgatcgtcttcatagcctccaacttcaggatgacgatgagtatgtagagattagcagcgactctgagaaggctccgctgggaccactggtccgagacgcacagggtctctctgtccatgtgctcgaatcatggcaagcttctattctcaaggatcccaagaacaaactcgctcttacagcgctgagctcgaccaaccctagacaggttctcacttcactgccaacccagattgcggaccagcaggtattcaacgtcaagatcccgtttgaaggagatcccatcacgaatcaacgctcgagcggccgctgctggctctttgcttcgacaaacgttttccgcgttgccctcatgaagcgatataaccttgagagttttgagctgtcgcagcagtatcttttctactgggataaacttgagaagtccaactggttccttgaacaagtcattgatactgctggagaagacctcgaaggtcagcttgtccagaacttgctgggtgatatagtctcggacggtggccagtgggatatggtgtacaaccttgtcgagaagtacggtctggtgcctcagactctgtacccagacacttggaacgcccaaagctctggaattctgaacaatgtcatcaagaccaagcttcgagaattcgccctcaaactgcgagggttgatcaactccccaaatggtgtttccgctaccgcgctttcgtc

SEQ ID NO: 60504 - DNA, 868 bp, Triticum aestivum
  Clone ID: PAT_TA_60504
gccggccggttctcgaggacaccaccttgaactacctctttgttacctataccaatagctttctcaagtctagtaccacataacctattcatcatggagcccgagactcgagccacttcctttgggaaggatgcccacaagacaaaggacaatgcccccaagggcaagaccagaagcaattctctcttcaccatcagctctggcttcaccttttttgctgcccttcctggaggatccaattcatcgtctttccgggcgtcctctttccgataaatacccaacaccaactcttgttctgttacctgttttctgtccctcgtttatacccagtccttttgtttaattgttttatatcttttcttatacgctgaatctgctggctcagttgcatttaacgacaaaccgcctatttgatacggcgcacttgctcttctgtgtttgatgtctcacgccaggatggaggagttacgatcttacaagcccacccgccggggtcttgactttaaacaactcaatcaagactttcccgacgaacggtacgaattattccttaacaaccttactgtcgaagtttttgttcttgcccagatggccttccttcctggtggtaaaactgggccaatccggatgtctccctggttgatagagtacccggaggaatttctcaaacacgtcgagcttgtggctcatccggatgcccgctcagggaaatgggagaggcttctccgcaacggagacgagagagtcaacctgattgctgccatcatcttcaaaatctttgaccagaagatcttttcgccactgctatttggagctgaatcgaagcatatggagacgctcaagaatctgataccgagctcatcaatgc

SEQ ID NO: 60505 - DNA, 851 bp, Triticum aestivum
  unsure (1)..(851): unsure at all n locations
  Clone ID: PAT_TA_60505
gccggccgggtcgggaaaaaaattcattttaatctcacagaaccatttccatttcaaaatcatgactgtcgacgtgaagaagatcgcgaatttgaagtcagtttctctggcaggattacttgctggacaagccgatgctatcgatgatcttgtatcgtcctgcaaaacttacgggttcttttatcttgattttcaagacccatcaacaagtggtatcctcaagctcgttgaacaactttctgtcattggcaagacagtcttcaagctcccactagaggagaaggaggaatacagcactgagaaatatctgccatccagacttctaggctacaagcgagccggatgctctgttgggccattttctggaaagaaagatggctacgagagtttttcgattcacaacaatggaatctttggcgaagacgcaatgatcgttccggaagaaattgatcaaaacctagcgttgttcaaaatattcatgggtgaggttcatggatatactgattgtatactttccattttgtctgaggctttgcagctgccatacgacttgaaggattgccacaggaaggacaagccgtcgtcagctaacatggcaatgttgaactacttgccctggggtagcagcgatgagagaattggtaacatggcccataccgatatgggaacactgactgttgtcttctccaagtctgatggtcttcaggccatgctgcctggatgtgacgactggtccttcatcccacccaaggagggccatgccgttgtgaacgttggagactcattgcgctttctgtccagtggcatgttagcttcatcccntcatcgtgtcgtacaccgncagatcagtc

SEQ ID NO: 60506 - DNA, 773 bp, Triticum aestivum
  unsure (1)..(773): unsure at all n locations
  Clone ID: PAT_TA_60506
gccggccgggtcgggaaacttccctctttcggtggtggtaccggttctggtttcggtgctctcctccttgagcgtctctctaccgagtacggcaagaagtccaagctcgagtttgctgtctaccctgctccccgaacatcgactgccgttgttgagccttacatcgctgtcctgtctacccacagcaccattgagaactccgactgtactttccttgtcgacaacgaggctgtctatgatatctgccgtcgcaacctcgacattcctcgaccctcatatgagcacctcaaccgtctcatcgcccaggttgtcagctccatcacctcgtctctccgattcgacggtgccctcaacgtcgatctcaacgagttccagaccaacctggttccctacccccgaatccactaccctctcatcagctacgctcctgtcatttctgccaacaagagcgagcacgagagcttcaaggttcaggagcttaccttccagtgctttgagcccaacaaccagatggtcgtctgtgacccccgaaacggcaagtacatggctgtcgctcttctgtaccgtggtgattgtgttcctcgcgactgcaatgccgctatcgcctccctcaaggccaaggcctcattcaacctcgttgagtggtgccccactggtttcaagctcggaaatcactaccaaaagnccatggctgntcccgctcctgctngagctgntggtcttgctccccgtcagcgatccgtctctatgctttccaacaccaccgccatcgc

SEQ ID NO: 60507 - DNA, 867 bp, Triticum aestivum
  unsure (1)..(867): unsure at all n locations
  Clone ID: PAT_TA_60507
gccggccgggtcgggtgaacagtcgttaactcttcattccgatattctcttcattctgtcgctcccatttccattgagctcccaatttgctttccttaagcaaaccatctttcgtcaatcttcaccgtttacgaacctttgtacatcggatataaaccggtatacacacgtaccagtataaaacacaatcaatttcgcttccaagcaccgatacgacatcataatgccttctcttcgcacaattgtcctcgccactgcggcttcagctgtcactcttgtcaatgccgactacgtgatcgaccccgatagcgttcctctgtctctacgtaaggtgtggtgccagaacgaggtagagacgtgtcccatgatctgtggacaaactagtaagggagataccaaggtcaacgaatgcgatcctaaatctctcacttatggctgcatctgtggtgacggaaagcaacctaacatgtctgaatactccctcaccctccccttctacgtctgccaggaatggggtaaccagtgcgttggggattgtgctggaagtgcctcttgtgcttctgactgccgccagaacaacccatgcggtgcccaagaccctaagaaatacaacacaacttccacagctacaggcactggtgctggttctgttaaggccacagctagcgctactgatgatgccaacacggtttacaccgacacacctggaagtgacagcgacgacaacgattctgacagcccagcgtcaaccaagagcaacggcgcttctgtcatcgaggttggccgaacatggggcctgactattgtcttgggcactatgntcgccggctttgccatgctataagcgtgtgaaaacgctgtcaactt

SEQ ID NO: 60508 - DNA, 541 bp, Triticum aestivum
  unsure (1)..(541): unsure at all n locations
  Clone ID: PAT_TA_60508
gccggccgggnctggaaaaccaaatactcgcatcccctctccgatatgtcaatgtcacattcctccaacgatagacacaaccgtcctctcgcgctccttgagatgcgaatatacgagtagactttcagcggtaagaatatcacactccaagtctggtcagctgacaactaccgtaatgttgatgtaccaatgcaggagaatgaaggaatccctcatcaacaacatcgacacatctttggccgaaatcagctggaggatgttcgcacactgcttgactactagattcataaggagcccaccctccacctggagctccatttacatggacctctgcaaattctagactcgaccctaatatgtcacagcatttgcttgtacggggagccctcataccctatcgaacatgagcactgaaacatcccagaccagagagggcatttctcctcattgccagcgcctcatgcttagctgcgaagctgctatgatgatggactgacacagcctgaatacacacatctccatggatacacaccctgcagct

SEQ ID NO: 60509 - DNA, 533 bp, Triticum aestivum
  Clone ID: PAT_TA_60509
gccggccgggtcgggaatacattcaccttaatttacttgctaacctctccttttcaaccaaatgctctctcttgctgatctaccactctactaaattacctaaacctattccacatctcctcccaccgtactgtctctaaaggatgcctctcttcacgagtgcggctcctgcggtcgtgcgtagctcttgcgcgcctgcgctctgttagactgcgacagatcttgatcctcttgctactggaccccaggagaagctgcctgtgacacggcgaacttgaacctagtatgtgctcattcaatcctgccccaactcttggaagctggctatcctagtacaacgcctcctatctgcttctcagatccgtatcatatcaactgtctctctctctcagtagctatctgtctgatgttctgctaccacctgatctcatcttctctttctgatacctatagggttctcgatgtcatcctttacagaaaagatatgatctgctaattgtagcatgaagtactgagtacattgcctctttcat

SEQ ID NO: 60510 - DNA, 570 bp, Triticum aestivum
  unsure (1)..(570): unsure at all n locations
  Clone ID: PAT_TA_60510
gccggcccggttcgggaaccctcccacgcaagtcccaaagcaattntggaagcagcaagcagcgcaagaagaatttgttagagaaactgatatggcgtccatgatgggaggagactttgtggaggcctacgtgctcaagaacgcctacaaggagaagctgaggcgcatggaccaagccgaagcggcggcggcggcgctcgacggcgcgaagagcaggaaggacatggaggccgccggcgccgctggagagaataaggctgctgttggtggtggtgcgagcagcagggggggcttctttggcctcatcaagaagaaggtgcaccccaaacccaaagcagcggcggctacttcctcttgattatattgctgttctgacatgccacgaagttgtaagccacagctgctagagctgccgcgcctttcttctagctaggatcaggagcgggtgtgtagagtttgttgtttcgatcagcttctcttggaggagtgtgtgtaaagcaagttcttttgttatttggtcaaaaaaagttgacaaaaactaaggaaaaaaaaaaaaaaaaaaggccccta

SEQ ID NO: 60511 - DNA, 829 bp, Triticum aestivum
  unsure (1)..(829): unsure at all n locations
  Clone ID: PAT_TA_60511
tccatcaaaaggtcgaaagattcacttggaggatatcgtcttgtcttgtctcgtcttgaaagaaggacatatttctctaggtacccgggcccatttcgtcaatcttttctgttgtgcgtcacactcttttttttccttcttctcttttgctctatatctctacgctcttttcgtcactctctactcaagcccacgatacccaagaaaacccggagtcgttattctccccgtatttctctcgtcgaaatccccgtcacgagtccattctttatctaccgatttcctccgataaaaaccgcagccatgttcaagcgctcgttcaggtcgcaagaccccggccgtgtcgacaagtctgcgagacataagagatcgggctcccaccgggaccaaacgaaaatgtcgaagctgcaaaggtcgctcaatgagcaggactcaattccacaaaagtccgcgcctatccccccacccgcgcccgcgcctgctccctcgcccatcgtcaccttgacggtcggtcgagatggtcggctctttgcagcacatgaggaagtgctccgccagtcgcccttctttgaggcggcctgtcgcggaaacaacttcgagaaacagagcaaaagaatctcccttcccgacgaagaacccgaggtgttctcggctgtcctcgaatatctctacaagggtgactactatccacgtctgcttccaacaagcagcgcaactcttggggactagnaggacaagcccgtacacctcacacatcacccaaccccgaaaaacggaggtggccgcgcagacaacccgtctgaagccactatctatctgtcgagtctcg

SEQ ID NO: 60512 - DNA, 771 bp, Triticum aestivum
  unsure (1)..(771): unsure at all n locations
  Clone ID: PAT_TA_60512
gccggccaggctgggataattgtcgctatcgatcaaacaatacaacatcatgactgcacagattgaacaagcccacgaaccgctggctgcggacacatttgacgatgttgattcagactctactttttcgggctctgaccttgaaagcctggagtcacttcgttcaagcgtcctacagtaccaagtggagaatggccgcacataccacgctatgagctctggaaaatacaattttcccaatgatgaatccgaaagtgatcgacttgatttgcagcacaacctttggcttttgacgcttcatggagaacttggtcttagccccaagatcaaaggatctgccaagcgtgttctcgatgccggtacaggaactggcctttgggctatcgaatacgctgatgcccacccggaaaccaaggtgattggcgttgatctgagtcccatccaaccaaacatggttccaccgaattgcatcttcgaaatcgacgacctcgaaaaagaatggacatggacagagccatttgaccttatctttgctcgcaccatgacgggatcattcgccgacaccgaaaaattcatcaagaacagcttcgaaaacctcgagcctggtggctatctcgaaatgcaagatctcacctaccccatcgcctgtgatgatgacactctcctcccagacagcgcccttgtccgttccggcaagctgagtattgaagccagcgctanagctgggcgcngcattgatctcgctcctcagtacaaggacttcttcgaaag

SEQ ID NO: 60513 - DNA, 589 bp, Triticum aestivum
  Clone ID: PAT_TA_60513
gccggccgggtcgggacccccagctcaatcaccaatcaaaacaatggatgaccgaggaactcctctcgcgagaacgatttgcttccccagatgcggaccgtgaaatagggcacgccccaagccgtgtccagtccatgcggtaagagcgaggacaatgactggctccccgtcaccaagctcctgcgtctctaaagaggacctccagatccatcgcatgcaggtagatctacctgcactctctgcacatcagggaggatcatatccgcaacgacttccgacccaagttcaacgatgactgcctgaagaacaatgcccgtccagaaacaaatacgagccgaactacgaaccctattcaccgacattgtcactcatagacgactcctaacatcacaccctcctctaaatactaactcatctgcgtaggtcgccgccgctatccgtgtcaccatcatcatctttaatgtcatccatctccccggcctgcgtgcctacagtggtacctgccttgttgtctatcgctctctgaccacctacttgacaggaccttgcctgaccaatgcggtccgtatacatcccctgcctacatgat

SEQ ID NO: 60514 - DNA, 835 bp, Triticum aestivum
  unsure (1)..(835): unsure at all n locations
  Clone ID: PAT_TA_60514
gccggccgggtttcgtctccgtctacgtctgcgtctctgtctccatcttcatcaacacctcaacctccatctcgaccgccaccttcgtcgacctcctcccctggttcgacatcgcatcccatacagccacagtcgccgactttattcaactcacctaataatcaatccgataacgcgccagtttctccgcccaacatggctcctaagaaggctgccaacaacagcagcaagtccaacgaggacgatgggttcacagctggtaaaatctactccatctctggtcccgtcgtcatcgccgaggacatgattggcgttgccatgtacgagttggtcagagtaggacacgacaacctcgttggtgaggtcattcgaatcaatggcgaccaggcctccattcaggtttacgaggagacatccggcgttatggttggtgaccccgtctaccgaaccggaaagcccttgtccgtcgagctcggccccggtctgctcaacggtatctacgacggtatccagcgtcctctcgaggccatttccaagatggccaagtccatttacattccccgcggtatcgccgttcctgccctcgaccgcgacaagaagtgggagttcacgccctccgtcaaggtcggcgaccacctctctggtggtgaggtttgnggttccgtctttgagaactctttccttgccaaccacaagattctgttccctccccgcgcccgaggaactgttaccaagatcgcctccaagggcgagtacactgtcgtcgaaacattctcgaggtcgangtcgatggcaagaaagacgagtaccccatgatgcagtcctggcccgtccg

SEQ ID NO: 60515 - DNA, 722 bp, Triticum aestivum
  unsure (1)..(722): unsure at all n locations
  Clone ID: PAT_TA_60515
gccggccgggttgggactctagactccttgacttgcgtcgcaacactagtaccaaacccacgacttacacgcattgcccataatgagtccctcagcagttgaaggtaacggagtcgtggacgtcaagacgactctaaagcccaatgttggtgtttataccaaccccaaccatgacctctgggttgctcctgctgagccctccgccgaagctgtcaagtctggttccgacttgaagcaaggtgaggtcagtgttgctatccgaagcactggtatttgcggatccgatgttcacttctggcacgctggctgtatcggtcccatgattgtcgagggcgatcacatcttgggccacgagtctgctggcgaggttattgccgtgcacccttctgtcagccatctcaaggttggcgacagagtcgccgtcgagcccaacattccctgcggtacctgcgaaccctgccttactggccgatacaatggttgcgagaccgtccagttcctgtctacccctcccgtcccaggcatgctccgccgatacatcaaccaccccgctgtctggtgtcacaagattggaaacatgtcatatgagaacggcgctcttctcgagcccctcagtgttgctctggccggtatgcaaagggccgaggttcgcctgggagaccctgttctgatctgcggtgctggacctatcggattgatcacacttcagtgntgcgctgctg

SEQ ID NO: 60516 - DNA, 777 bp, Triticum aestivum
  unsure (1)..(777): unsure at all n locations
  Clone ID: PAT_TA_60516
gccggccgggttgcatacattctcccaccaaattcgtctctacactcaacacgcctcaatacgntctttgtgaacacaatcaaaatgcctaaggctgctgctcccgccaagcgtgcgaccagaactaagcgggccaagaaggaccccaacgctcccaagcgcggcctgtctgcctatatgttctttgccaacgaacagcgtgagaacgtccgtgaggagaaccctggtatctctttcggtcaagtcggcaagctcctcggtgagcgatggaaggccctcaacgagaagcaacgtgctccctacgaggctaaggctgccgctgataagaagcggtatgaggacgagaagcaggcctacaatgccgatcaggaagaagaggagtcttcttagaatggagcctccgatgtcaaacccaagcgtcgctcgcagaagaagtctgaatcggattagtcccagcaccagcgccgtgttgtagattctggccaggaagtccttcctctttgcattttggtctgggcggtgttgtatgatggcacaggaagagtgccttgttttttactaggaattttctcgggttaaggccgtccccgatgttatgatcttgagggcgatcgattgagctactggcttctatttcagtgtccttggccatgagaaacagatcgtgaactcgaggatcatgggacgaggaaacgcaatgcttgtacaattaagggaactccgacccaaataatcgaaactacgaaaacataaaaaaaaaaaaaaaaaaggccccta

SEQ ID NO: 60517 - DNA, 691 bp, Triticum aestivum
  unsure (1)..(691): unsure at all n locations
  Clone ID: PAT_TA_60517
gccggccgggttggggaccactccaagccactccttcctctctactcctatacccatcacaactacgacccggccactatgatcagctcggcatatcggcccccgaccccaatggcgaaccagatgccattcgtcactagctcaaagacctgcagaggcatccccccatctcctgacacgtctgccctgctcgcggaagatatggtccactgcccagcgacacttctgggtccatcggctaagcaatatgctgacggcgtatatgtgaccactatccacttccccccagactacccatccaacccaccccaggctgcatttaaaacaagggttttcctcccacatatcaacatacaatggtaccatctgtcttgatatctttcaggatgaaagccaccctgtattgacagatccatacatgctcctttcaatctgatctctactaaaggacccaaaccctgaccacccgttatacccgtacattgcagcacatgaaaaaaagatatatctccaaactatgagtccaacatgaggagccgngaccagaataatgcactctgctgatcctggtacccacgccttgaccatgatattacaaccatcttcacttgtaacacctaatgaaacgtccctactgctctgctgctgctataactaatggtactgtccacctgactgaattcaatgtcat

SEQ ID NO: 60518 - DNA, 839 bp, Triticum aestivum
  Clone ID: PAT_TA_60518
gtgcggcgctcaggcggcggctcggataaacacactaaatctccataccattttcttaagctcaattattcatcctaaaaaaacacaatcatggctgccgttcaactccaagccgcacctcgcaaggtcggcgtcttccaaaacctcatcgcctcccaaacagagacgctcgtcctcaaagaaaaagtcatgtccctgactggcgacagcttcgacatcaagcttgccaatggccagcccatcctcaaggtcgagggcaaagtgatgagcatctcgggtcgcaaaaaggtctttgacatgcagggcaaccacctcttttccatcgtcaaggagcacctccacatccacgctacctacgccgtggaagatgcccagggtgccaagatcatggaggtcaagaacagtttcaagctcatgggctccaaggccactgctacctttacctccagtgacggcaccgcagagattctggaaatgaagggcaattggttcgattatgcagctgatatctttggcaagtctgcaaacactgttgttgcgcgcatcgatcgcaagatccttagcggtcgtgacatgatctttggtcagcagacctacgctctgatggtcgcgcctggtgtcgacatggcgctcatggcagcgctgtgtatctgcatggatgagaagaataatgagaagtaagatggatggcctaatgagagcgcgcgcgcgtatgatagataccccgggagtgacgacacatgaggagcaatgctggaaagtcgagtcgaacggttaattgagctgtggctttcgatatgtacttttgccctatttaatgagaaagcagaaaatgatac

SEQ ID NO: 60519 - DNA, 818 bp, Triticum aestivum
  Clone ID: PAT_TA_60519
gccggccgggccgggaaattttccccttggttcaggttccccaagtttccacttcaaccaccgcaaaaccatactcgatttgagtcgttgatgttctcgacatattcctaccgttgccgctcattcacctttaagcttcatcccgtcaccccgaaaccgatcttcaagatgtcgtccatgggcaagatgatccgccgaaagaagaatgtcaagaagggtattcagttttgcctgatggtctgcggtgcttcaggcactggccgtaccacctttgtcaacactctctgcggaaagagcgtgcttgagcacaaggagtccgatgatgctagcggcgcgcacgttgaggatggtgttaagatcaagcccatcactgttgagcttgagcttgacgaggagggtactcgtatctctctgaccattgtcgacacacctggcttcggtgaccagattgacaacgaagctagcttttcagagatcgttggctacctcgagagacaatacgacgacattctcgccgaagagtcccgtattaagcgtaaccctcgatttagagacaaccgagtgcatgctatgctctacttcattactcctacaggccatggtctccgagaactcgacatcgagctcatgaagcgactcgccccccgtgtcaacgttatccccgttattggccgcgccgattcactcacccccgctgagcttgccgagtccaagaagcttgttatggaggatattgagcactatcgtattcccgtctacaacttcccctatgatattgaggaggatgacgaggacacggttgaggagacgctgagctc

SEQ ID NO: 60520 - DNA, 808 bp, Triticum aestivum
  Clone ID: PAT_TA_60520
gccggccgggccgggacccactctcaacagtcgttaccatgaagtctcttctttcgctggcactcttgccactagcattaattgcccgtactagtgccgcccccaactgtcgttgcatgccaagcgacgcctgctggccatcaaataacgcttgggcttcgctgaataagaccgttgatgggaccctcatcaagaccgtgcccattggatcaccatgccacgatcccacttacgacgcggatgcttgcgcagccttgcggagcgcttggatgttgccacagactcatatcgagtcatcctcctcggtaatgcagcagttctttgccaatcagagctgtgaccccttcttggcacagagtcgtccctgtcttattggaaattatcccagctacgctgtcaaagtctccaacgcccggcaagtcgcggctgcagtccgcttcgccaacgacaacaatatccgtctagttattcgtaacacagcacacgactactttggtcgctctactggtgcagcctcccttgctatctggacacaccatctcaagaccaaggaagtcatcgaatgggctgacaacctctactgtggtcccgcgttcaagctaggcgcgggtatccaaggtgccgaagctgtcgagtttgccaatgccaacggcctcactggcgttccaggcgagtgtcctacagttggtcttgctggtttcactctaggcggcggccactctcctctgagcactagctttggcctcggcgccgaaacaccctcgagttcgaagtcgttactgccgccggccgcatcgtccgtgcctct

SEQ ID NO: 60521 - DNA, 718 bp, Triticum aestivum
  Clone ID: PAT_TA_60521
gtgcggcgctcaggcggcggtcggaatccattccaaacacagtgaagcgcggcgtgcagctgagctagctacggtctttcttttttgctttgttgggcgtgctgctacgatctatctattctacgtgccgtggccatgggcgcgcaccccagcgaatacgccggcgaggacccatgccgccgccgccgcaaactccgcggatgcgacccaattccaccgacaccgcatgcgcctaagcccgtcaccggtccggtggtggaggtggaggtggaggctccgtcgagctacgccactgccggcaagctcctgttcgtcgcggccggggcgttcgcgggcgtcctgctggccctcgtcgcgctgcacctctacaacagcggccggcgccagcgcgcgcgcggccgacgcagcctgcccatctccggcgaggcgccttcgccgcgggggctcgaccccctcgaccccgcggtgctccgcgcgcttcccgtggtcgccgcggccgccggcgccggggactgcgcggtctgcctcgccgagttcgagcgcggcgaggaggcgcgcgcgctgccgcggtgcggccaccggttccacgtcgagtgcatcgacgcctggttccgcgggaactccacgtgccccctgtgccgcgccgccgtcgaggcgccggacgacgccgaggcccgtcccgaggtgcgcgtcgatgtggctgccgccgacgccgctg

SEQ ID NO: 60522 - DNA, 805 bp, Triticum aestivum
  Clone ID: PAT_TA_60522
gccggccgggccgggagcactctgaataagagcgattgaccaaaaccataaaagcaaatccaattccgagcttgactcgatactcttccatcggttctcgactcgtactacccaaacaacatcttccgatctcacctatcaaattccaaaatgtctcgacaaatcgcatctcaagcttcccgcgtggcttcgcaagccatccgctcttcgacgccagtctgccgttccagcttccgcgtcgcaaccatggcatatgcttcacgtcttgccatctgcccaaatctctctcagcgcaacttctcgactacagtgtcccgcaggaagggcatcatgcctgacactgatgatcccgccaagcctttgacagaaacagagcaagttgagcctactgctgctgtcgccgacattaccgagcaagagtatcatgaaattgccgatgagtacctcgacaatgttgtcaacagattcgaggagcttcaggaccagcgcgaggatgttgatgttgaattctcggctggagtcctcaccatcgactggcccggtaagggcacatatgtcatcaacaagcagccccccaacaagcagatttggctggcatctcccatctcgggccccaagcgctacgactggtgccttctcggcgagggccaggaccagaaggagggcactgccatgggtgactggatttacagcagagacggttctagcttgaaccaggtctttcttgaggaacttggtgtcgatatcgctattcccagtgaggagtagagcttcctcctgaacgttgataagaaacccataagca

SEQ ID NO: 60523 - DNA, 515 bp, Triticum aestivum
  Clone ID: PAT_TA_60523
gccggccgggttggaccagcctgtcatcgtttcgagagggtcgtccagagaacctcatcgacgttactatgattgaccccggcatgattatcattgagctccgatatgactcagctgtcatgatcatgctacctcgtggtggatgccaagactctggcaggcaatcgtagggggttgtctgcatatcaaatgttgtgaccagcagctgtaaccccagatattgaggcccgtaaggcgtttcgtgtgcaagggttctagagtgcggtgaagcaaaaggcagtgaggtgaaaggccaatgtggagtaaatgctgtatggtgcccaatatatacatgtggaggataaaatatacccagctgttccaaattaagcaagtgctttgatggctgccatgtctatccaagcacacagtgccatctggcataattgcaacccaacatacccagacgagtatctacactggccgaaatacaatcattttaggcatgttaaaacaaaaaaaaaaaagggccctat

SEQ ID NO: 60524 - DNA, 856 bp, Triticum aestivum
  unsure (1)..(856): unsure at all n locations
  Clone ID: PAT_TA_60524
gccggccgggctgcgggactttacaactgttagcatcatcctagcgaaatctcggaaatccgccgttacagcacaatgcgaagcttaatgtccagctttccccgccgactcggccgacctcggtcgacgccgagtacatcttacctctgtaaagtagcagtgactggactggctatattgactacgttcccatctccaagtgtttcccatccttcattgtttcctcgcaacaacttcgcaatggcttcttcggatctcgctcaacttatcccccccgactcatgggattcgcatatgcatattgtcgatgtggagaactacgctctggacccttcagcaatatatcgtccatcctcgcacactcttgagcaggccctcaactttgaaaccagcgtgggtctccgaaacattgttcttgttcagccatctatttatggcttgaacaattcatgtttgcttgatggtctgcgggatcttggttcggagcgtggaaggggtgtcgttgcaattgaccctaaagcttttgacgctgatgagcttcgcaagtggcacgagttgggtgtgcgcggtgtgagactcaatctgcagtcggttggagcagaattggatgcggctgaattggagcaacagttgacattatatgctgacgctgtaagaccattgggctgggtcgttcaagtttacgttcccatgaagatgattgagctcctggagcctatcatcccaaaactcaacatcaagttctgtatcgaccatctgggacaaccgccgctgaaagccaacagggtgttgagatgtatgacctgccnnagttctcatctttaactcgtctgctcaagatggtcttacctatgtc

SEQ ID NO: 60525 - DNA, 544 bp, Triticum aestivum
  Clone ID: PAT_TA_60525
gccggccgggtcgggtgaggctcttattaccagcgctgagaaggagggtgccaagatcctcctcgatggcagagggtggaagcccgagggtttccccgacggtaactgggtcggcccaacagtcatcgcaggtgtcacgccagagatggaatgctaccgcgaagagatctttggtcccgtgcttctgtgcatggaagccgatactctccaatcaggaatcaacaacggcgccaaggcctctttgttccagcaggagatcgacgctggacaagtcggcatcaacgtgccgattcccgttcctctccccatgttctccttcacaggcaataagagaagtgtggccggtactggcttagccaatttttacggcaaggatggattgagattttacacccagtggaagactgtgacatctctttggaaggcggatgatgccagtaccggtgagaagttgacgagtatgcctaccagctcgtgatcggaggacaaagagacaatagcaacctacgatgcgttagaaaaaaaaaaaaaaaaaaggccccta

SEQ ID NO: 60526 - DNA, 681 bp, Triticum aestivum
  Clone ID: PAT_TA_60526
gccggccggtctgggaacagaaaaaagaaaatcatctcacctaatcacgcgacacaaaatggttactaccggccctttattcccaccagacctgattggagctgatgtcgtatcatcgttccctcagggttacacaatccgaccactagaacgcggagattatgcaaagggattcctcgactgtctcagtgtcctctctgatgtagggaatgtatcccaggatcaattcgaagagcggttcgattggatgaagatacaaggccaaggggtgcattttcacgtggtcattgaacatgagaaccgagttgtcggaactggagctattatcgtagagagaaagtttattcacaatcttgggttgattggtcatattgaggaaatcgcgattgggaaagactttcaaggcaagggtcttgggttaaagttactggccagtccgtcgtctatcgcaaagaatgtcgggtgctacaagacgactctggggaccagtccggacaacgagccattctatgtcaaatgtggctacaacaagtcaggaaacatcatgaaccagtactttgaagagccaaaggaaccctattatcggggataagtgcgatagactatcatcttcaaaagttgtagctaccccggatattcatggtgatctcagccgaaaaaaaaaaaaaaaaaaggccccta

SEQ ID NO: 60527 - DNA, 287 bp, Triticum aestivum
  unsure (1)..(287): unsure at all n locations
  Clone ID: PAT_TA_60527
ancntnnccaatgtgaggcctctaggcggtcggtttcgatactctctcattatcatccccataaaacttcaagacctacactcctattcccttacatcttctctcaatgaataactacaagaacctcgctgttgcggtgaccacgctcattgctctcgccgacgctgctcccactgccaaggttaactctgactgaagttattcctgccaaacacatcggcaacctcaagactgacatcgctgcctccaagatcgagagccatctcaactgggccgcacatgcacac

SEQ ID NO: 60528 - DNA, 843 bp, Triticum aestivum
  Clone ID: PAT_TA_60528
ctgtgcggcgctcgaggcggccgggtccgggtgtcagatataccattcctttgtggtccatcacagatcagcaaatcttccacaatggcgcctaccggagacgctatgggcgagaccgttgctgcggccggcctccacgctgagatggttgacgagaagcgagcctctgttgccgctgagaggagatcctctgtggtcaccgacccccaggctcctgctgctgctgtgtcttctggtggtgtcaccgcagatgggcagtttcccactcctgaggagatgcaaagcttgaggcgcattgccaacaagattcccatgaagctctttagcattgcattcatagaactctgcgaacgcttcagttactacggatgcacggttgttttcacaaacttcatccagcagcctctcccccctggttctaccaccggtgccgacgatgagcagcctggtgcccttggaatgggtcagcgagcctcgacaggaatcactaccttcaaccagttctggcagtacctgatgcctcttctcggagcctatctcgctgatcagtactggggtcgttacaagaccatcagctatgctctggtagtcgacatcatcggtcatcttatccttatcgtctccgctgtccctggtgtcattcagagcgacggtgctctcggtgccatgatcgttggtattattgtcattggtttcggtaccggtggtttcaagcctaatgttaatcctcttattgtcgaacagcttggtgagcaatacatgcacgtcaagactctcaagtctggtgagcgtgttatcatcgatcctgccgtcaccattgagcgtggttacatgtggttctac

SEQ ID NO: 60529 - DNA, 842 bp, Triticum aestivum
  Clone ID: PAT_TA_60529
ccggccgggttcggacaggactacaggtgatggtgggctggtggcttctgccttggctagctagatcaacaggtgagttttccgaaacatctcaaccttgagtaagaacttgtacatcaaatcaacaaagcaagtaaaacatgtcttactatttatttatttttgcctttttgaagcctgctttgtagtgtctccatgtcttttctcttattttagtcggagtttataagtgttcttcttacacgagttttgatcaggtgatgctgggattgacaagctgctagattcggctgagcatagctgctctttgtttcattcctcctttgtgatggctgataataccaagttcgtgcttttctttctcctcttgagcggctcatcaccgtgttttggtactgaacaagatatcgggtgcctcaagtctgtacaaggctcattggctgatcctggcggtgtactcagatcttgggactttgaaaatgacacagacggttacatatgccggttcaccggcgtggaatgctggcaccctgatcagaacagggttctcgggttgcgtctcggcaacctgggactcgaaggtccattccctccaggcctccagctttgcagcttcatgaccgctctcgacatgtccggcaacaacttctcaggcccgctcccggaacacatcttcgagcagatggcgtacataacctatctggacctctcgaacaacagtttctcaggcgtgctcccagcaggcatcgggaacatgatgtacctgagcacccctcgccttcagcacaaccagttcgccggcggaaattccgcgcagctgagcacacttcgcagctcatttc

SEQ ID NO: 60530 - DNA, 735 bp, Triticum aestivum
  Clone ID: PAT_TA_60530
gccggccgggctatcgacacaagagagcagctagtactaaatagaagagaaacgtgaaggttagagaggctcggttccatgggagacggcaagaaatccagccccggtttctggtcggtggtggcgtcttggtttgcttgctttcgtcgcccacctaaggtcaaggcggcgagcaccggcggccggaccaccacgtatgaagaatatgatccagccggcgggatggtggcggcggccagacatttctccagtgctcacaaaataaactttggatgatttatgtcatgtctttggttcataggataggattatcgtaggaataggaattttgtagaaaatgagatgacatatatctcaaattttatgagtaggaataggaaacgagatgttatttggttgacatcaaaggaatttttccattgagtctaggctcatttttattttcctatgaaatgtgaaggataggaattaataagaatccattcctatgaaccaaagggctctaaaagaaaaaaccctataaaaatcctatgctctagaattcctatgagattcctagtactatttcaagcctcacagttaactatgtcctgttgagtccaacaactgtttgtattagctgccgccgacccgccgtcgacgtgtacctgctcacacaatggctccactccatcctgttccacaaaagctcttgttttagataataagtcatggtcatcataattcattactacc

SEQ ID NO: 60531 - DNA, 863 bp, Triticum aestivum
  Clone ID: PAT_TA_60531
gccggccgggttggatcttcccatcccatcatcttcacctaccgaatcgaaacagttcaacctcctgtttctctctatccttttttatcccccaagtacaatcactcaaccaagtcatcatgttcaactgggctaagcaacaactggccaatgtcgccggcactcaggagcccatctacggtccctctgccatcaagtctgttgccatcgaggccgaaaagactccctacaccgaagtcactcgagatggcttgaagtggaaggccatggactcgacctctgtcgagactgagagtttctacatcactgccgacaacggttacatcgctcttgcccaggtcatctatagcaacgttgccggcattcgaacaacctgccagttcaactgcaaggtcttcgacaaggaccctacaaagccccacctctgggcctcaacacctctcaacaaccaagactttaacgaggacaagacgagtttctacgccgatgactgcgccgttgagctgtccgaggatggcacctactacaccatcaagagcatgaacagccaggacgccatcgttaacctgaagatcacccgctctacccctggtttccaggctggcaccacaggcacaaccctgtacggcaccgaccacaacaacccatggggatccatcaggcatgctttctggcctcgctgtgtctccgagggtaccatcactaccaaggagggtcccatcgacttgaagggcaaggctcttttcgtctacgccctccagggcatgaagcctcaccatgccgctggtcgatggaactttgtcaacttcccaggtcccacctactcagctatcatgatggagttaccagcacccatcatacgg

SEQ ID NO: 60532 - DNA, 818 bp, Triticum aestivum
  unsure (1)..(818): unsure at all n locations
  Clone ID: PAT_TA_60532
gccggccgggtcgggaccagcagtagtggcgagccacatctccgatgcgcatcgcctttccttccctctttcccaccctcctcctcttatcccccaaagcagaggaaagccggcgagctctctgcgtgctctgcgcagcaggttcgatccatcaacccatccatcgatcgccggtgcgaggctagctgcccagccagcggcgtgatctggttttgatcggccggcgacccccatggcgtccatcgtggtgatcggcctggtgctgctcctcgacatcctcgccttcgtcctcgccatcggcgccgagcgccgccggagcacggcgcaactcggcgaggccgagcctggcggcaggcggtactgcgtgtacgacacggacgcgtccacctggtacggcgtcagcgcgctcgccctgctgctggtcgggcaggccgtggccatggccgccagtcgctgcttctgctgcggccgcgcgctctcccccggccgctggcgcttcttctccggcctcttcttcgtcctctgctggctgacgttcgtgatcgcggaggtgtgcctgctggcggggccggtgcggaacgcgtaccacaccaagtacgtgagcggctactacaacgaaggggcgctcccctgcgccatgctgcgcaggggcgtcttcgccgccggngccgncttcgccttcctcacacactcttcgtcatgctccactacgtcttctactcaaggnccgnngcgcnccccgnccatcatcaacggcggcggcatcggcatgacccgcatctgatcccctgcgctatgatcgtcgagcgatgtctgct

SEQ ID NO: 60533 - DNA, 692 bp, Triticum aestivum
  Clone ID: PAT_TA_60533
gccggccgggtcgggacatgctcatttacatcattatcagtgtctgttccaactatacaatgtttatataataccactctctacatcattcaaatccccatatgactgaatatcctctctcttgacaatgtgactctcctccataatgcctgactcttccatttctttcctgcccactctatccatgattcacaccattacactgaagggatcccacatcgtgctccctttcaccatgcaagatgactatgagaaaaccactatacctacttctgtgagaccgttgcttgtgatagtgacgcagaatctctgacacccgaatccacagcctgactgcaaaggtagcaatgctcgccgtcaacgatgtaaagaaccagtcatccacgacagctgaggcctgagctgcaccacccgcgcctgacacagtacctcgctcctggcaatccataatgctcctggagccaagaggcaagacttcgatggagacaaggtgcttctacaattaccacatatcagggagaaaacccatacactggtaatgcaaagagctcatccactaacacatcgcctgcaaaaacgtcgagccccaaggatgtcactattctcactatgtactaccagaccagatcattgacttcgctgatgatacaaccatcaacatgaccaagcattcttacttcgaccccagcgtc

SEQ ID NO: 60534 - DNA, 776 bp, Triticum aestivum
  unsure (1)..(776): unsure at all n locations
  Clone ID: PAT_TA_60534
gtgcggcgctcaggcggcgggtcggagtatacacctcttcccgcttttcaacactctcttcacggaacaacttcttcacgatgcgctcagccattatcatcgctatcggggccaccctcgcctccgcttcaagccctgtcgaaaagcgtgatgccaaagaatgtgcatcgctcgctcaagacttcctccccaagttgaccgatatccccactcctgagggatcgctcgtcagcttcatcgctagcaagactgagctcgccaccttcaccaacagctgcgaattcccccacgtcaccggcactatggccaaggagtactcctcctacgtcgacaagctcagctcttggtacaaggaccaggtcagcgacgtctctaagctcatggcggcctgttccgatgttcctgaggtcaagactgagcttgacaagctaaaaacaaacggcgctctttgcagcgagctttcctgggcaaaggagactggctctgcttccagctccgacggcgacaaggacgatgacagcaagaagaaggatgagggcaacgctgctggcctcaacaccatcgcagccggtttcgtcgttgctgtcgctggtattgctggtgtcatgatgctttaaatagcgtcactcggtagtttcacgaacgaagccatgtcgggaaagaatattttncggtgttttagttatctagccaaggntgtacgggtgtctataattctttggaaagcctcaatatatgtgtcacggccgaaaaaaaaaaaaaaaaaaggcccctan

SEQ ID NO: 60535 - DNA, 438 bp, Triticum aestivum
  Clone ID: PAT_TA_60535
gccggccgggtcggggtcgtcttccactcccgtcgacagcaacatcagacaaaatggcccccgccgcaaagaagcagaagatcaacggttctttggcccgacagtgccttgccgacctcgaggagaagggcatcatcaagcctgtggttacacacagcaagatgaagatctacacccgtgccgttggtggtaccgactaaatgcaattcaacgaaaaatttgagtctcacgattgtgcgtctgggtggcctggacgatagacaggccacaaggtcggagggtgttgcaaggcgaaaaagaagcctggtttaggacgctattcatgctcggttaagcattgggacggaatcgctttagcaatggcaacggaatgaaaaatcttcgaaacgaccaatttatggttctctctagaaaaaaaaaaaaaaaaaaaggccccta

SEQ ID NO: 60536 - DNA, 824 bp, Triticum aestivum
  Clone ID: PAT_TA_60536
gccggccgggtcgggcctgtcgtccatcatgtcatcctgacgatgtgaactgccctccctgtacgtacctgacgacacgtctgtgtatttgcggcaagaccacattccacaacaagccatgtcaccttcagcaagtgcactgcagcaaggtgtgtgggcagaagttgtcttgcggccttcacacctgcaagaaactatgccaccgttctggagagtgtggagatgcgctggctggctgcgaacagctctgcggaaaggcaaagcctctctgcggtcactcatgccagagtgtctgccatggtcagactgcctgtaacgaatccacagcctgtcaggtgaaaatgacagtcaaatgtccttgcggcaaccataagaaggagttcaagtgcctggctagcaccagcaacccaactccaaatcgtccggaagtccgatgcgatgaggaatgtgaacgcctcgatcgtaaccgccgccttgccgcggctcttaacatcgacccggctacgcataccaacgaccacgtcccgttctcagacgacactatgaagctgcacaagcagttctccaaatggggcgacgagcaagagagccagtaccgagtctttgcagccaacaaagatgaggtccgcctgagatatgagcctatgaaaaacgtctcacgccagttccttcatcttcttgctgaggactttggctttgagagcaagagtgagggtcacgacattcatcgatctgtacttgtttggaagacggacaagttcgtctcagcgcctccaaagacgctctcacaatggtgtaaagattagagccatacaagctgctga

SEQ ID NO: 60537 - DNA, 839 bp, Triticum aestivum
  unsure (1)..(839): unsure at all n locations
  Clone ID: PAT_TA_60537
gccggccgggtcgggttcaatcacttcacatacagaaaaatcacccacagcacgttgagtatctgttctaatctcactgtcgcaatggaagattatctgtttcgacattacgtcgatcagtgccgcgttgttaaagaggagacaagctatgtcgagattttcaattactcggatcccttttacaatgtatgcgaagaacatcctttaccagacgatgagttccataactttgtgaatcaaactggcgcctttgcaccaccagggaacctaagacctgatacgaagctgctcagcggtgttcgattaatagttcaaaagaatgccaagcatcccgatacttttctcacaaaggtcatctcactacctgcggagaaatatggaaccatggttcgtgccatgaaactgccacatcgaggtatcgaaacaaattccgttgttggccctttcttctggtgcgcccatgatcaggatgacgacgaccctcatctgcaaatcatccacagaaaatcagatgttcttaaaaagggcaaaactagaggttgggagatgctcctctctcattctttcaagacaggtatcactactggcttcatcaagggaacacccagctcagagattgaaaagtctttaaaccacctcaaggcatgcaccgaccaaattgggcacccgattcttctacctcttatcatccttacatacgacctatctccctgaaatgatgangaacaacgcanagctcgccattggctccgnncgccttgaaacgccgtcagcctacgaaatggagtcgaggagcaggagcagtatttccaaaatggcttcatcgacattgacggact

SEQ ID NO: 60538 - DNA, 498 bp, Triticum aestivum
  Clone ID: PAT_TA_60538
gccggccggttcggggatcacgaacaaggaagcaagatgactggaccggtgaagctcatcggcgccttcggcagcccgttcgtccaccgtgcggaggtggccctgcgcctcaagggagtcgcctacgagctcatcacggaagacctctccaacaagagcgagctgctgctccgccacaaccccgtccaacacagggtgccggtgctcctccacggcgacaaggccatctgcgagtcgctggtcatcctcgagtacatcgacgaggccttcgacggcccgccgctcctgccaaccgaccccagcgagagggccaaggcccgcttctgggccaagttctttgcggataagtgcctgatgtcggtgtggctggcgctgtggacggaaggcgagacacagaaagttctcatgaaagatgttggccagacaaaagtatgcaaaccatgaattaaagaataaaacaatttaccaaaccaaaaaaaaaaaaaaaaaaggccccta

SEQ ID NO: 60539 - DNA, 841 bp, Triticum aestivum
  unsure (1)..(841): unsure at all n locations
  Clone ID: PAT_TA_60539
ctgtgcggcgctcgaggcggccgggtccggactgtgctattagtagctatgcccctcgtagctgatctaggttaaggtgctggcagctcgcgcctctcgttactcaatcgcaaataccacctccagcctcatttctcttccattgctagagagaaaagatggccttcctcattctcgttataggggacctccacatcccggaccgggcgcttgatatccccgccaagttcaagaagctcctctcccccggaaagatcagccagacgctttgccttggaaacttgaccgataagcacacgtacgagtacttgcgatccgtctcccccgatctcaagattgtgaagggccgctatgacgtcgaggccacctccctcccattgacccaggtcgtcacccacggcagccttcgcattggtttcctggagggtttcacactcgtctctaacgaaccagaccttcttctggccgaggcgaataaattggatgtggatgttctgtgctggggtggtactcaccgctttgacgccttcgagtatatggacaagttcttcgtaaaccccggtagtgcaactggcgctttcatggagggtttcagccaagaggccgacgagcctacaccgagcttctgtctcatggatgtccaaggtatttcactcaccctatacgtctaccaattacgaaaggacgacaagggcaatgagaatgtggcagttgagaaagtgacatacacaaaaccagtagagccctcaggaggagcatcatcataattttcacatagatagggggagtttacattcagcgacttattcaagactaaaaaaaaaaaaaaaaaagcccctan

SEQ ID NO: 60540 - DNA, 800 bp, Triticum aestivum
  Clone ID: PAT_TA_60540
gccggccgggttgggatttttcccgttgaattcttatcacacctacctagtacctatcctattacactttccttcagctcacctctctttctgacatatactttcttctccgctgggggccattccttctcgctgacgctgatattcaccatccatccctgcattcgagaagttgtttacgcacctcaggataccttggcaactccactaagcaacccaaattcacctacacttcgtactcaggccatccacccttacaataacaacaacattggctcttgattttcgagatcacgataccgtcgtcgccaatatggcagccttcgtgaaacatgcgctgacgcgcagagacgaaaatgaggacagttaccagtgggattctacaaacagcgacgacaacgatgtctattggtggtatagtagggaaggatacatcgtcaaatggactatcctcgccgtcttagttctcctattcacactctggattgttggaggatactggcatgcgaagaagaggattcaaaagggtttgcgaccgttggcatatcaccgatgttttgttagtaggagcatgatggcacaggttgatccccgatacgcctatccaccgaacacatactactacgctccaccaaatggttatcaaggccagcctggcggatatcccatgcacaacatgcctcctccgccagtctacgacccgtcgcggccgcccatgtacgatgaagcccccagcggcgccaagattgatccgtcgcaagggcagcagagacgtgaggatggacctgcagactattatg

SEQ ID NO: 60541 - DNA, 767 bp, Triticum aestivum
  unsure (1)..(767): unsure at all n locations
  Clone ID: PAT_TA_60541
gccggccgggtcgggacgaccacttctctagctcatgcccgtctagcttccgggtcttcttcttcgacttcttcctcggctgccgcctgtgtcccgatagatccgtttccattcttgagctactgcgaattcaaggaagacatggacgagcagtggatgatcgggcagacttccctcagcctcggcctcaacgtcggcgggccgcgacgggctcctccggtgaccagggacctcgtggaggaggacttcatgtcctccaagaagaatcacgaggctgaggcgctggtggccgagctccggcgagtgggcgaggagaacaggaggctcagcgacatgctccgcgcgctggtggccaagtacgccgacctgcagggcaaggtcagcggcatgatggcggcggccaacaaccaccaccagtcgtccacgacatcggagggcggctcctcggcgtcggcgaccagaaagcgcccccgcagcggcagcctcgacacgaccagccgcaacccttcgccgccgctcgccgcggccggcagcagcggccgcttcgacgtcagcgtcaccgtcggccccgagcaggcggagtgcacgcccgtccacgagccctgcaacagcaagcgcgtccgcgacgacgaggtcaaggccagcagggtctccaagctctacgtccacgccgatccctccgacctcagnctcgtggtgaaggatgggtacaatggcggaagtacggggcagaggtgaccaaggacaacccgtgcccgagggcctac

SEQ ID NO: 60542 - DNA, 669 bp, Triticum aestivum
  unsure (1)..(669): unsure at all n locations
  Clone ID: PAT_TA_60542
gccgggtcggnaacacaccacaagcccgtcctctccccgcacccttcttccctcttcctcctgctgacctcccgacccaaagatctcctctgatctgccgccgcctcccctacagccgccgccgcgccgtgccttagcgccagccaccgccgacccttcgcccccccccccctaccccaccccctcgtactcgcgcccatcgccgctcccggttgccctcatcgtcacatcgcgtccccgccgtctccgcccccgccgcagtctttgggttctgaggaacataccatggagatcaggccaatggtagccctgcgtgctgccctagtaggcggggtagctgcattcgcaaagatcgccggggcgatgaaagctgcaggcggcgtgaaggttggtgcggcggctgcagccatgacagccgccgcgacggctgccgtatccggaaaagatgcgggtaatgataaccaaaagccgggggcaaaatgatacaacctgccatggatttgctggagaagcagtgttctaaaatgcttctccatagggtgtagaccagcattcagcagtttatcagtgctgaagagctggggaagctaatcggggccttcgggaggagactgcattcacaataaataagggttgccaaaggaatttccatgatacatgtgtgttttg

SEQ ID NO: 60543 - DNA, 691 bp, Triticum aestivum
  unsure (1)..(691): unsure at all n locations
  Clone ID: PAT_TA_60543
gccggccgggttgggggaccggccgaatcttccgccggtgcctccggcatgtaaacgtctcccattagactaagccaaaaatcacgaatcacacaccacccggataactgagctgagatactacttctgatgtcttctccccccttttccgagccccccaccggttgtctctccatcctccagtctccgtcgacgccgtgagggacgcctgggcgactctngcaagagaatgtccaaggacggcactggaaggataggaaggagcggaacataacggacaggatgctctcaccggctcaccgaggatacccagaagcccgacaaggacggcctgcaaggtggaggaggcctacatagccgacctctgggtctacgatgacatcaacgagtacttgcaggcgtcgaactacgaccctccggcctaggagaggatcaaggaagtcatgaaagagcctgacatcgacatggacggcctcctgcatcgcgaggagctcgagtagttcatccgaaagctgaccgtcgagtcactctgctggatcaagctcaagatgatcatcacgctgatcaccggccctgcgatgtcgctggagaccaatagggaagccgaggtagtccccggcgtcaacaaggtagagcacaaggcgcccaatgccatctatgtcgacgacatcagcatggctgccgtggtcat

SEQ ID NO: 60544 - DNA, 754 bp, Triticum aestivum
  unsure (1)..(754): unsure at all n locations
  Clone ID: PAT_TA_60544
gccggccgggttgggatgtccaacgatcgcaagcaaacacaagacgacactgattctacgaaaaccattatccgttacctttttatctttggtcttcctttagtagttctcgtcatctggaacaaattatttagcagcaccaaaacggagaggacgacagaagcaaacatgtcttcaggaagaatcgccccgctcgtatttcctgcagcatcgcagcacactgccacagtcatctttgttcacggtctcggtgacactggacatggctgggcaagcgctgttgagaactggcgccggcgacagaagatggatgaggtcaagttcattctgccccatgcaccccaaatccctatcagcgtgaacatgggaatgagaatgcctggatggtttgatatcaaacaacttggaggtgatgtcgactctctcatccgcaacgaggacaccgagggcattaagctcagccaaaagtacttccacaatctcatccaacaagagattgattcgggaatcgtccctgagcgcattgttctcggcggcttctcccagggtggtgccatgtctctccttgccggcctcacctgcacaagcaagctgggcggtatccttggcctttcatcttggttgctcctatccaagacctttgccgacatggttaagcctacagatgccaaccgtcagactcctgtcatgatngtccatggcgaagaggaccctatcgccccttgcgagcgtggaaagtgagcgccgactgctc

SEQ ID NO: 60545 - DNA, 835 bp, Triticum aestivum
  Clone ID: PAT_TA_60545
cggcctggttgggatcaacatcaaccttcaccatctagtattcacgttcatccataagcacttcatcgttcgtaaacccccctcgccctcagtatgaagctctctagcggtgcactggctcttgggctggccaacttgcccgcaactcttgcctggggcagtcttggccacatgaccactgcctaccttgctagccactttgttgccaatacgaccgaagcgcatttcaagtatattctgtataacgatgaggaggactatcttgccaagattgcttcatgggcagactcaatccgatacacgaactggggccgcttctccaagaactttcacttcatcgacgctcacgaccgcccgcctcataactgcgatgtcgattatgaacgcgactgcaaggacgatggttgtgtcatcaccgccctgcacaactatacccagcagtcagtcgagcccgagctgcccttttggaggcgcaaccaggccgccaagtttgttgtccactttgtcggcgatctccaccaacctctgcacaacgaagatgttgaaaagggaggcaatggactctcagtgatatttgatggtaaacatttcaacctccaccacgtttgggatagctccattgccgagaaacttctgggcggccttcacggcgacccatccaaactagccaacaaatgggccaaccagcttgctgttgagattacggatggcaagtatgcagaggcgaaagagtcctggttgaaggacctggactttgagaagccattgacacggcacttgcctggtcccgagagactaatgcactcgtttgcacacatgttttacccgagggacc

SEQ ID NO: 60546 - DNA, 653 bp, Triticum aestivum
  unsure (1)..(653): unsure at all n locations
  Clone ID: PAT_TA_60546
gccggccgggttgggaaaccccttgccctcttgctctgctctgtgcctctctactgctcctgccatgtcacgctactggaaaatctcttgatatcatatacatatcgatgctgcctgccatgctccacgtgcacacaagtcacttctggatgtaatccgcccgaccctcggggcctctcgctcgacgcagggctgcgaaacctgcatgtctgtgtctgcctacggatcaacttccgcccggacaccacagctacgatcaacgccatccataccccgaaccgcaagaccctgcacgacgctattctatactgatatgagtatatatgacacctgctcgtgtgccgatacactctcggacagtgtaccattgactattgcgtacacttgttggcagctgagggaaatgattactgaagatgccgtatgaccaggaaataaatatgaggatgctcgaagctggtataatatatatagtacaatgangaactctataaatgggagtttatatatgctcccctattggggccacttctttcttgaagctaaatcaacattggctccccccgcaagtctggaatcggacgtgatataatcatttgccttcttcaccatcgcttcaccagatacctaatagacccatcagggtctactgt

SEQ ID NO: 60547 - DNA, 819 bp, Triticum aestivum
  unsure (1)..(819): unsure at all n locations
  Clone ID: PAT_TA_60547
gccggccgggtcgggaaaatcgtaacattgctgtaacctctttagcaatcatgcctctcgacgcccaagccacatctaaagtcaagtctatcatagacaatgcttgtgccgaccaaactagagacattcccggtacaaccattgtagtcgtcgatcgcaatggcgagatattcgctcactcggctggaacgcgcggcgtcggcaccaaagagccgatgacccttgacaatattttctggattgcctcatgcacaaagatgttggcaggcatcgcttgtatgcagttggtcgaacaagaaaagctgaagcttgatgacggggagcacacggagaacatcttgcccgagctaaaaagcctcaaagttctgaagcctgacggaacctttgaagataagaagaatttgatcaccttgcgaatgctgttgacgcacactgctggttttggttataccttcttcaatgaacgacttcgagactggactcatccggcaggcgtagatgagttctctggaagaattgaggatataatttcactccctcttctctttcaacccggagagggttgggaatatggcactggtatcgattgggccggcatagccgttgaacgtgtcagcggtctgagtctcaacgactatctacagaagcatgttttccaaccgctcggtatcacaaacatgagcatgttgcctgacaaggagatgcgttccaaactagcttatatgcaccaacgagatcaagacggcaagcttcgtatccgagaacacttgcagcgacttcctctggtcatcgatccagacaataaangcgaagctgctt

SEQ ID NO: 60548 - DNA, 781 bp, Triticum aestivum
  Clone ID: PAT_TA_60548
gccggccgggctcgggaatcaattgaatcaagtagtaaatcattatcaataccaaaatgtctcggaaaattagaaccgcacagtccgtctccttcgacatccccgccgctgagcaaccatatctacacaacagatggcacccagaggttccaagcattgcaaccgttgaaccaggagagacagtcaagattgaatgtctcgattggacaggcggccaaatcggaaacaacgacagtgccgatgatgtccgcgatgtcgatctcacaaagatccactatctcactggaccctttgaaataaaaggcagtgaacctggcgatttgctcgtcgtcaacatcactgatattcagccctttgaccattcaccctggggtttcacaggagtcttttcaaaggacaacggcggcggtttcctctccgagcattaccccgatgcagctaaagcaatctgggattttgacggtgtttattgttccagccgtcatatccccggtgtccgattcccgggattgatccaccccggtattcttggctgtgcgccatctgctgaaatcctggccgagtggaaccgtcgtgagggagagctagctacttcgatggccgggcctcatcccgataaagtgtttgcgcaacctccctgcgagattaatgctcatggtggactagccaaaggtgatgttatggctaggatcgcaaaaggaggagcgagaactattcccggcagacctgagcatggaggaaactgtgacattaacatattttcccggggatcaaagacata

SEQ ID NO: 60549 - DNA, 643 bp, Triticum aestivum
  Clone ID: PAT_TA_60549
gccggccgggttggggagttcgagttttgaattccgccccgatcgatttgaatcatgttactttatttcttttgaactccactatctttagagatagaaaataaaaaccggccgtctattcgtcatcactgtcgtcctcctcctcggcgttctccagccagtcaaccagcattctgcacttctccttcagcagtgtcatactctctccctcaacggcccgatcgttctcccaccagcctagaataccttcctcctcaaggatatccagtgagtagagctgctgcagcattgctgcgagaagaatgcccacgcgggattgttctggtccttgagaacgtgtgagggccttttgaagagcgatgatgaactcgacctgcgcagcttcgttgtcgtcctcaagaccgatacccacttcattaatgaacttggttgcgcctggacgagagttgagggcacggtctgcggccttgctgggttcgaggctgccatactcaggggtcatgagctctacggcgcgatgagcgaaggcattagccacggcgcggcgcatcatggcatcagaagcgtcgttggaaagacggagccccataaattcgagcttggccgagtcgaaatcgccagactgggcgcgaagcgcgtcgac

SEQ ID NO: 60550 - DNA, 618 bp, Triticum aestivum
  unsure (1)..(618): unsure at all n locations
  Clone ID: PAT_TA_60550
gccggccgggcttgggccaccaagcaacatctaacagctagctcacaagtcacaagcagtagtcttctgatcctgaacaaccgatcacgatgagttcgtcggaggagaagacgtcgtggccggaggtggtggggctgcccgtcgaggaggccaaggcgatcatcctccgcgacaagcctggcgctgacatcctcgtccttcccgtcggctccagcagcgacacgcagttcatcgccaaccgcgtccgcatcttcgtcaacggcaccaccgtcgccgagactcccattgttggctagctctagctcataactagcctggcttgtcgttgctggatcgatgcaagtatgcatatgttaccggctcgacaagtccaataaataaccatgggaattatcatgtgtgcgtttgttatgtatgtgtctacaatttcgttatatacgcgtatatgtactgtgtacactggtaccttattctgtttaccttaggtaataatgaattaatgatgtgtatttggcgtcnnnnnnnnnnannnnnaanaaaaaaaaaaaaaaaaaaaaaaaaaaaaaaaaaaaaaaaaaaaaaaaaaaaaaggaaaaaaaaaaaaaaaaagggccccta

SEQ ID NO: 60551 - DNA, 737 bp, Triticum aestivum
  Clone ID: PAT_TA_60551
gccggccgggtcggacttcattcatggcaaatagactcacccaactaactcaatcctctcagagcgcggccaggaggttcccctcgccgactacaagggcaaggtcgtcctcatcgtcaacactgcctccaagtgcggcttcacccctcagtacgccggtcttgagaagctctggaccgacctcaagggcaaataccccgatgactttgtcatcctcggcttcccctgcaaccagttcggcggccaggagcccggcaccgacgatgacattcaggagttctgccagctcaactacggcgtgaccttccccatcatgcaaaagaccgaggtcaacggtgacggcaccaaccctctctgggtctggctcaaggaccagcagtccggtcttctcggcctcaagcgcatcaagtggaactttgagaagttcctcgtcggccgtgatggaaaggtcaagggtcgatgggccagcaccaccaagcctgagagtcttgagaagcctattctcgaggcccttgctgagaagcctgcggcttaaggatcatgatgaacgacgaaacaagaaaaatgcgtctttgtcaatccccaccaatctaaaacgagatacccagttggggaagaacaagggcgtagtgtgtaatgagaggcttccagactcatggaaaacagctaaataaattaatacaatgatcagtcataatctggtcaatatttggcgaaaaaaaaaaaaaaaaggccct

SEQ ID NO: 60552 - DNA, 547 bp, Triticum aestivum
  Clone ID: PAT_TA_60552
ccggccggtttcgggaaacctgcaattcttcaaaatcgtgtaaatttaggacggcttcgcgagaaagaacagaagacccggcccggcctcacccatttctccgcatacatcatcttcatcttctcctaacagattcagctccaagttgcccagtatggccgctgctgcttctgagagcttcatccacctggcgaggcctttggcgcccaataccgtcggcctccagactaaccttgccccgctcactgtcaacatccagcctcaggctgtcctttccatcctcgaccacgccgtccgacgagacattcgagatacccagtccacccgagttatcggcgctcttgttggcacccgatctgaagatggcaccgaagtcgaggttcgctcatgctttgccatcccccacaccgaggaggaggaccaggtcgaggtcgatgtcgagtaccagaagaacatgcttgccttgaccctcaagggcaaccgtggcgagtccctgctcggctggtacaccacttctcacgagctcaacagcttcagcgccctcctc

SEQ ID NO: 60553 - DNA, 797 bp, Triticum aestivum
  Clone ID: PAT_TA_60553
gccggccgggtcggggtcagactcttcagtcatccctctacacgcacctttgcctcttctgctatcaagatgggagacgctatctctgagaaacctcacaatgcgtggctcggtgccaagggaccagcttctcttgatcttcgaagcgatgtcgtgacaactcctaccccagccatgcttgaggctgtctcatcatgctccttactggatgatgtctttcaagaagaccctgctaccaatggccttgaggcttatgtagcagagcgcacaggcaaagaagctggtctttttgttctctcgggcacaatgggcaaccaacttgccctgagatctcttcttacgcagccaccctactccgtactctgcgactatcgtgcccacatattcacatctgaagctggcggcacctcaaatcttacaggagctcagattcagactgttgtccccaagaatgggagatatatgacgctagaggaaatccaggagaacgtgaccctagacgatgatgttcatggctgccccacgcgagtgatcagtcttgaaaatacccttcacggcatggtcatgcccctgagtgaggtcaagcgtatctccgagtttgccaaggagcacgatatcaagcttcacttggacggcgcgcgattatgggaagctgtcgtatccggagctgggtctctgactgaatactgctctcactttgacaccatcaccctgtgcctttccaagggtcttggtgcacctgctggaagtgtgctcgtgggtcccaaggcacgctgaagcacgctcgctgggttcgc

SEQ ID NO: 60554 - DNA, 664 bp, Triticum aestivum
  Clone ID: PAT_TA_60554
gccggccgggtcgggaccaagcagcaaagcaagccagctaattactagctcctccgcctcttcttcttgctctccggcagcaaagctacctagctcaacttcattaagccaatccttctctccgcctcccaaccttctttgctcataatcaaggtttaaattacctacctaaaaggaatgggcagcttgggcaccaaccccatgtccttctccgccatccccgacgacaaggcggcgttcgagccgctcaaccccgaagatgtccgtgcatacctccacaaggccgttgacttcatctccgactactacaccaacatcgagtccatgcccgtactccctaacgtgaagccggggtacctgcaagacgagctcagcgcatccccgccaacttactctgcgccattcgacgtcaccatgaaggagctcaggacctccgttgtccccggcatgacgcactgggctagccccaacttcttcgccttcttcccctccaccaacagcgcagctgcgatcgccggcgacctcattgcctcagccatgaacaccgtcggattcacgtggcaggcctcacctgccgccactgagatggaggttctcgctctcgactggcttgcgcagctcctgggtctgcccacaaccttcatgaaccgcaccagcactggtc

SEQ ID NO: 60555 - DNA, 747 bp, Triticum aestivum
  Clone ID: PAT_TA_60555
gccggccggttcggggcatatatttcttcatcatggcctccgaagtcgcacaaggtttgaatgagcgtcccgaagacgtccctgacgtactggaagcagaaaatgatgctgcagatagtgattctactctagagagcgaggatgggtcgtcgagttacctcacatctctcaagtctagcattttcagctacagatatgagaacggtcgccgatatcatgcatttcatgagggtacttatctagtgcccaacgacgatgaagaacaaaaccgaatggatttggttcatcacatctacagtctcgtcatgcaggggaagcttcataccgcacctattagtgacaacccccaacgcgtccttgatctgggtacaggcactggtatctgggccatcgattttgctgacgaccacccttcttcggaagttattggaactgacctcagtcctatccaacctgattggactcctaccaattgtgtcttcgaagttgatgattttgaggatccatgggtatacaagaggcctttcgactacatccacacacgcgagttggaaggttgcatcgctaatgaggatcagtttttcgagcgcgcattccaaaacctcagcagtggtggatacctggaaatgcaaggtcagagggcatactttatgtcggatgatgagtcaatcaagaaagccgtaaatgccgaagtctgggccgtggccttgcgagagagcagcatcaagttcggaaagccaattgact

SEQ ID NO: 60556 - DNA, 731 bp, Triticum aestivum
  unsure (1)..(731): unsure at all n locations
  Clone ID: PAT_TA_60556
gccggccggttcgggttttcatctggtcgcgcattccaaaaaccaactccatcgaatactagaagagagagaaactgcatggctgaaagaaaacaaccaaacggaactggcgctgggtctggacaagtgaccatgtccgaatacaagaaggcgcaagctagagttcgggatttggttgagaaacgcagggctctagaacgacgcttgacacaagttgaagatgggatcgcgcagaaggaaaccatctaccttgacagcacaccgagcggcaacatcatcacaggctttgacaactacatgaaaggcatgagcggcgcggcagcacagcgaagaaaggttggcccgatggaacagaaccgcgtcttttcacgatcatcaatctcatatcgaccgaacaatctggagggcatcaccccaggatcaggaggctctacaccagctggcgcgacgccttcttctgccgcttttcgtgacggaccctcgaaccatccgacaccgacatctacaacggcagctaagaatgtgaacaagtcgaagaagaagacggtcgagcatgaggatagcgaaaatgatacatcaacgagcaagaagcgcacgaatttcggagcgcaacgcaagtagacatgcggcaatatactgtataatgggattgngcgttaaagcaaaagaaatgcaactggaagcgtgatctggatggcgttagggtaccatgatagaatatactccttttc

SEQ ID NO: 60557 - DNA, 552 bp, Triticum aestivum
  Clone ID: PAT_TA_60557
gccggccggttccgggaggtacgaaagaccccgacaatttctccctcgcagtccctacctctcttcttgagactacgagcgcttcgactttttacacattcgccgacaaaaggactaacattcacatttcagccatgtcgtcgaccaagaagccctccggcaagactcagcgctccgccattgcggatgtcgtcgcccgcgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggaaaaaaaaaaaaaaaaaaggccccta

SEQ ID NO: 60558 - DNA, 862 bp, Triticum aestivum
  Clone ID: PAT_TA_60558
gccggccgttccggcatcactcttgaatctactttcgagccaaagtcccaacttgcccggttcacatacacagtccccttgacttgttgtcttgatacacaactcttctacctcaactgtgcttcacttcttcacagtcaactcaacattgagccaccacccaaatcacttctcaaaacaatcaattgacacaatcacatcttattctaacctcaatcatcatcatgtcttctcattacacttctgtgggctactccatgcctcttcccgtcccctccaagggctcgcaataccccacctacagtcaatattctgtctcgcctccggaatgtgatgactcggttagctccgcctcgggcatcccctcgtacagcaatggtgggtactcggctacgtcgtccggctacactggcgcatacggcgagtatgagagcactcgctctgctagcggcgtggacttccaggagtacatgcaggaccgctttgccaactccttcgacccaatccctcttgaccgcagcatggccatgcaagctcagacatccggaaagatgaacgccaagcaccgagagctcctggagctgcagaagaaggcgcaggctcgtcttgcgaagacccgagagcgcttccaggagggtatgcgcgatgctcatgaggtccgcagtgaccttgaatggacacaaaagaaagtcagctcgcttaagaccaaggcttctcgcaagcatggcaaggagtacagcaaggctcgcgcccgatacccatctcctgagaactagattcttctagatttcactttctttggagcggcatctcgactttcacaacaaaattttcattcagcgagcaacttttcattcgcgat

SEQ ID NO: 60559 - DNA, 811 bp, Triticum aestivum
  Clone ID: PAT_TA_60559
gccggccgtgccgggatcctttagatcctcacccattctctcttttcaactcccagcacgcccaatctgtcaacatgaaggccggtctcacttccctcctcctcgccgccttggctggctcctccgtcgcccagacgaacaagatcaacgcagccaagttcaatgaggactaccttcgtgcttccagtgcgcccaacgccgttggaatggctgagcttcgccagcgcaagatggctctccatgagagtgaggctgctgctggtgtctttgacaaggaccgctacaaggtgctcggctcttcaacaccttgttctggtggcaaggcaggagaatactcctgcaacaacatcgaccttatgggtttcttgcgtcaccaggatatgggcagccgcacccgtgtcggtaacgatatctggggttggactcactcaagtggtcgcgagttcgctctcgttggacagtcagacggcactgcctttgttgaagtcaaaaaggatggtagcctgacctatgtcggccgtcttcccacccagactgttgcttcttcatggcgcgacatcaaggtcattggcaactacgcctacatcggctctgaagccgctggccacggtctgcagatctttgacctgaccaagcttctcaacactgaccccaagaaccctcctaccttcagcatcaggagtgacttggccgctcacttcagcggtttcggcaacagccacaacattgtttgccatgagcagaccgccttcattgcagccgtcggtacagcctacgatctcaagtgccgtgctggtctctggatgatcga

SEQ ID NO: 60560 - DNA, 784 bp, Triticum aestivum
  unsure (1)..(784): unsure at all n locations
  Clone ID: PAT_TA_60560
gccggccttttcgggaacatcatcatcttcttcattcaatatagaactcaactatacattctgcagctataatgaagttctctcaagcttctcttctggcagcttgtctgcctgccgtatcggctcgcttcatcgaaatcgcagaggtcgacaatgttgttcttcagcccgacgagctgtttctgattgagaccgctcctggcaagacgcaatggatcaccgaggaggagaagtgggagatgcgccgtaatggccagaacttcatggacatcaccgagacaactacgcttggctccaagggtattaatgccgaaagcaccgtcacgttccctaagaagtgtgtcaagcaagacgaggtcgcaaagctctcgaagaagctcgaaaagaaaaacatgcaggccaacctcgagaagttgaccagctttcatacccgatacttcaagtccgattacggcctccagtcctctgactgggttcttgagaaggtcaaccagatcatcaaggacgctggtgccgaagatactgtgttcgctgagagcttccctcacacatggaagcagcactctgttatcgcgaccatccctggtcaatccaacagcaccgttgtaattggcgcccaccaggactctatcaaccttttccttccttccattctcgccgcccctggcgccgacgatgatggtagcggttccgtcaccatcatgggaggtgttccgtgccctcttgaactccnaggatgntgtcaagggtaaggcccccaacnacatcgagttccactggtact

SEQ ID NO: 60561 - DNA, 809 bp, Triticum aestivum
  Clone ID: PAT_TA_60561
gccggccgtgccgagtcgccgcaccaatagccaatccacgcacacccgctcccgttccgtaatctcagcctccgtcctgatccgatccccaaatccctcgcctcgccgcgctcgccgtcgacctcgttctctccggcaccaaatcctacctccggtgaggccgacccacaagcagggcgtgacagcgccctctcgtcgtatctcccgccgcccctcctctccgcccgccgtcgtccccggtcgccggaacccgacaagttggatatctaggcggcaccgcagcgttgcggcgcccaccgcgcggacaggatgtctgcggcgccagccgcgtaccccaccagcctccgcgccgtcgcgtccgggaactccgaggcctccttcttcccctgctcgcaccgcctcaagctctcctcctcgcatcgttttagtagtagtagtattggtaatcgtagtaattgcctctgacgtttgcctccccctcgttgcccacgaccttcggttcgatctgctccttgtgctcgtcctgaggattgtctggttgtgagggctctgtgttacatctctgccttttgtgttcgcgcgggtttggtgtctgtgtctgtgttcgatcaccaggtccgatccagagcgatttggcctgttggaggttgtgattgctgtctctccgaggaaagaggaagttctcttctgaacttcggatttagcttgtggatgggcggacctttggtagactgcagtgctgaaggtgtgagcagcagctcatgtctcagccgcagcacctgtggaaaagcaggttttgagcacagctc

SEQ ID NO: 60562 - DNA, 705 bp, Triticum aestivum
  Clone ID: PAT_TA_60562
gtgcggcgctcaggcggcgtccgggagatcgatgtaacaacagaaatccatccatcgaccatgtctgggtggtgggaggacgagcccaacggctccaaggcggtgggcctgctgctgcgcctgtccgcgctcatcctggccctcgcgtcggaggtcatgatggccacggccgacgactgcgccatcgccggcgcaacgccgcccacggccgtcacctaccgggactacggcgccttcgtatacctggtgtgggccaacgtcgccgcggacgtgctgcaggccgcggtcgtctacctgcagctcagcggcgccggcggcgacgacgatgacgacgggggcagacaggaccccggggtcgtgctggtcgtcgtcgacgtgctggcgcaggcgctgctctactcgtcgacgggcgccgcgtacgggtgtgggaaggacggcgacgacgtctgcgtggcgctcggcgagcaggtggggcggaccaagctgctgtcctttggcgccagcgtctccctctggctcgtcgacgtcgtcaaggacgtctcgctgccgttcaatgtctggcccggatcatcggactgagctgccggacgggcagtccagagaaccgtgtgccgtgctagtgagtatgcgtgcatggcacagtacagagtatacggcaactgtaagcatcgtgtactggttggctattgatcacgcgacttattc

SEQ ID NO: 60563 - DNA, 840 bp, Triticum aestivum
  unsure (1)..(840): unsure at all n locations
  Clone ID: PAT_TA_60563
gccggccggtttcgggaaatcatacacacaacacaagagtacaagaccgcaaagccttcacgtacaacctcgatctcttgttgccaacttttgatctttctcgccacagagaaactacttctccggtctaagctcagtacacagcaatggaggtcaatgtgttgagctccaggctcgtcaagcctgcctacactgccggcgaagtgccgatgccggccaccgagtacatccctctgtccaccttcgacagggtgacgttcgagatgcagatggccatcatctacgccttcgcgccgcccgcgcccaccaccgcctctatcaagaagggccttgccacggtcctcgcccagtaccgtgcctttgctgggcagctcggcgagtcccccgacggcacgccgtccgtcatactcaacgaccgtggcgcgcgcctaattgaggcgtccgtggacgccgacctcgtcgacatggcgccctcgaagcccacgcctgagctgctgaagctacatcctgacctggaggcggagcaccaggaggtcgtgctgctgcagctgacacgtttccggtgcggctcgctcgctgtagggttcacgtccaaccacgtcgtcgccgacggccatgccaccagcaacttcctcgtggnctgggggcgcaccacgagagggctccccatgggcctcccgcccgtgcacaccacaagaacctcttcaagccacggtcgtcgcctcgcgtggagcacgaccaccgtaacagggagtactaccttccgtcgncctccgacgtcgtcggtcaccacggngatgccgccgacaacatcgtcatccacaagcgcacttcaccaag

SEQ ID NO: 60564 - DNA, 510 bp, Triticum aestivum
  Clone ID: PAT_TA_60564
gccggccggtccgggtcagagagatgaagacttttttcacgaacatctcgaaattgctcgcaataaaggcgtcccaatctactggatcaacctacactgcgatcccgctattcttgagaagcgactctcgacccctgaacgccaggagggcagcaagtcgaaattgacagacgtgttcgttttgcgcaacatcattaaaagcaacgaactcatcgagtttaccaataaagaaaacgacgatatatgtttgatttatcgggaattggatgtgagcggctctgtggaatcgtctgtcgatcgtttgaaggacatacttgggcaggtgtcttgaatcatatactgaaacacagagctccaacttgcctcttttctgctttgatttcaagctaaatcacaagactggagacgatattgagatacaatgtattgttggttttgaaggagcaggctacgagtagtaaatgatatcaaaagcccatgttgcaaaaaaaaaaaaaaaaaaggccccta

SEQ ID NO: 60565 - DNA, 504 bp, Triticum aestivum
  unsure (1)..(504): unsure at all n locations
  Clone ID: PAT_TA_60565
gcccggccgtgctcgggnaggcaacactagcaacactagcagaccagaggactcgtggggaagaaatagtcctggcctcttgcttgcgtgcagcagctagataacgatagccggcgatggtgtacgaagcagcagaggccgttgttcacaggggcgcgggaaaaggtggcggtgcgagaaaaagaagccatgagcagaagcatcaggtgcacaaggagagcaagctaagatggatgaggattgttctctggatcgtcaggagggttcatccggcaccttgaagaaataaattcaagtgcatatgtacagtggcgtctcatacatacctcaagttacgatgggaggtttttatgcatgtatatttatttataccaactaacatagatcctggcgtacggtgatttcagcactgtaaaaaaaaaaaaaaaaaaaaaaaaaaaaaaaaaaaaaaaaaaaaaaaaaaaaaaaaaaaaaaaggaaaaaaaaaaaaaaaaaaggccccta

SEQ ID NO: 60566 - DNA, 759 bp, Triticum aestivum
  unsure (1)..(759): unsure at all n locations
  Clone ID: PAT_TA_60566
gccggccgtgtcgggacgatccccgacattatcttcttttgtccaaaacatcgcacatttatggtacaaatgcttcggtgaatttgcttccatgtctggggtctgaccgtcaggtataaagttcagtcatctccgatagtcatctatactaatcgcaataccaccgaaacgtttcgccattcacaaccacgttatgaatacaccaatcaataatagctacgctatgtatgccaacaaagtagccgttgtgaccggcggtacatccggtatgggcctgtctgttgtcaagtacctacttgagaacaattggcgtgtattcgtgatatctcgacggaaccagccagctgtctcgggttcacgatttcttcaggccgacattagctcacaagaagagcttgcaagtgcttttaggaccgcatttgaagacacgggacggctagatgtcgtgtttgccaatgctggtcacgctggcaacgacaactactttgagcatgtcaagagaatcccgtggacctatcatcaatcgatatcaacctcggcggaacgattcgcaccgcgagtctagcccgagaatatttcacaaaaagcccgcatcatgggaagggagcagttttagtcatgaacgccagtatcgcaggattgtatcctatcgacctgttcccagtctacagcgtatcgaaagctggtatcgttgcttttacgcagacattgctcccacgttgttccnggatcatggtattncagcgcatgcaatctgtc

SEQ ID NO: 60567 - DNA, 824 bp, Triticum aestivum
  unsure (1)..(824): unsure at all n locations
  Clone ID: PAT_TA_60567
gccggccttcccggggtaggaatttgtccccttgtaacccaatccatacttcctcattgacattgtgtatctcttgtgtatccgcgtcaatctgcttggccgttcatcatctccccgatcccttgccattcgactctctcaattgctgtttctgaacgccagaaaagatgttggttgagcgcaaagtcaaagtcgttaccgagcagaatgtcatcgacaagccgccagttgaccagttccccatgcgggaatggagcttgaaggttttcatggtcgatgaggacggcaacgagcgcccagccgatgttttcaccaaggttgtctacaacctgcaccccacattcgagaaccccgttcagagctacaccaaacacccatttacgtgtaagaatgagggttggggcgagttcgaaatctcgatcgattgctacactacggagaaaacgaagctagcgcccatcattcacgatctcaacttccaccagaccaagtacgagcaaacacacactgtggttttcaagaacccctcccagagtttgcaggagcgcctgcgcgaaaccggccccctccctaccgatgacgaccatcgccctaagaagaagggaatcgcgaccaagaagagcgcccaaaaatacgactatgagaagatcgctgaatcgctggaaaaactcgaggaggaggatctgctccgtgtcatccagatcatcaacgagaacaaggggccagacacctacataaggagtgatgntgaagtggatgacttggttaaagccggagagntctccatcgatctctacaccatgccagacagtctcacctcaaag

SEQ ID NO: 60568 - DNA, 798 bp, Triticum aestivum
  unsure (1)..(798): unsure at all n locations
  Clone ID: PAT_TA_60568
gccggccgttccgggagacgacctcacttaagatcacgaccagcttcgactccatcaattgaccacccgcagccggtctttccaccctgaggagctccgaatccgaatctacgaggcatctcgtactctcttcacagtcttaaccgccgcaatgtcttccctcgctcgtcccatgctccgctcgccggctctacgtgtcgccgcccgacgcttcgagagcaccactgctcagaaggctgccgagaacgctaagcaggctgccaccagagcccaagaaggtctatcgcgtgtcacacctactgctggtcctgccattgctggttacgcaaagggtgttgctagcactttgggcaaggttggcggacgaacgggcaagatcatcggctttgttgagcgacaagtccccttcgtcgtctactactccaaggtcggcctcgagctcggcaagtttgttttccacaaccagaagatgagccctcctaacatggccactttccaaactacctaccaaaacctcatcaagtccatccagaaccgtaccatcatccagtcttcccagaaccttgtccagcaggtgcggaatatcggccctgcccagcttgctgnctggcggcgtcgttgcggctgaggtcctcggattcttcaccgttggtgagatgattggccgtttcaagcttgtcggctaaccgcggcgaggtctcttctcaccactanacgggtctcttgtattggnnagcagnagtgtaaggatcaatcccgtgctggaccgtgatgagcnaataaggacgaatggactat

SEQ ID NO: 60569 - DNA, 763 bp, Triticum aestivum
  unsure (1)..(763): unsure at all n locations
  Clone ID: PAT_TA_60569
gccggcctactccgggacgaaatctggtctgtctgtttccgtgtcaagtcgcttgcgcaccttcatgctggcgagctctttgttctctgcaaacttggtaagaagaccccgaggaagcaaaaaaccaatgtacggagcaattcttggatctcgacccatctcggccataaaagcaagactcttgagactctcaaaggccagagcaacccaggggtggtaagtagagttatcaagacaaccgaaagactctccaaatgccaagtcaccgatcatgtcaaatgtcgtaaaggtaggctcttgttcaagcatggcctgggcggagaagccatatgctagagcacggcggaaacgagtatgattctctcgatcactaccaacaatgttgtcaccatttgacagtactatgattgggtccttgccatgttcagcctcaccagacgtgcgatggccgcgaacatccttcatggcgtccgggtggttgaacgagagcatgtttggcccaatacggacaactggaccatacttcatatgaagggcaagatgtctctntgtgaggaagtccacaaagcatgaggagtgtgtggnggggatttgtgtcatggtattaagccaaggtcctgaatagtttcgcagggggtgaaaaaaagaggttgtatacgagcatcaccaaaaaatatgcaacccgcctataagatccaatattagatgtatccagacctatgcaaacacaaaaaaaaaaaaaaaaaaggcccctagggccgcg

SEQ ID NO: 60570 - DNA, 820 bp, Triticum aestivum
  unsure (1)..(820): unsure at all n locations
  Clone ID: PAT_TA_60570
gccggccgttccggaagtgaactcatctaattgacgacgtaatattctccgtcactcggtctccgacatcgccaaataacctctcgagttccgagtttgcccattgtcatagtgctgtgggagtgtctttgaacttctgttgactgcactccaatcttcccacctccgcatcactatcccgcctcaaaaatggttcagacttcagctttggtgacggcatccgtcgctactgccgccgccgccattctcggttatgtcgcctactttgactaccaacgtcgaaaccaggccgagttccgccgagacttgaggaggaacgagcgcaagcaggcccgcgccgcgaaggaggaggccgaggcttctacccagcaacaacgccagagcatccgctctagggttcaggaggcaaacgaggagggtttcccctctggtgtcgaggagcgggaagctttcttcaatgagcaggttatggctggagagatgctcagccaagatccttccaaggctcttgagtctgctctggccttctacaagggtctcaaggtctatcctgctcccagcgacttgatccggatttacgatagcactgtccccaagcctatattagacatcctcgctgagatgatcgcattcgactcatctcttgatgtccgaggccccgcctctcctgccggcatcaacctttccgacattcccaacgttggtcttgattanagaggtataagacctatcccgatttcctctccgctcttggcactatatacccggacgntggaaatggttgaaaatataccctcccctaaactgtacatggaaagct

SEQ ID NO: 60571 - DNA, 764 bp, Triticum aestivum
  Clone ID: PAT_TA_60571
gccggccggtccgggaatctacgtaatgcctcttgcgcaagccttctccagcttggttggcggtggagttgagaaaaccacttaaaccacctgcttccttccagctcacctcatcttcttttagatacattaaacttatcgaggccttcttcccctcaaccttattttcactactgactttttcatctctctcatctctcttcaatatacttagtacctataataactcaagaatctcaagtcaccatgggtgctaaatcgggcaccgccctcaagttcctgcaatggttcattcgaggcattcaattcgcttgcgccgctctcatccttgccatctactcctacttcctagcaactctccataaccacaacctctcaatcagcaacaaaatccgtgctgtggagggcatttctggaatcgctgttctctacactgccgctgctctgctcctcctctgctgccttgccggccgcaccctctcatctttactggccattatgttggatatcgcctttatcggcgctttcatctacgttgctgtcgccaacaagggcggtgctagcagctgcactggatatctcgacactccctttggacgtggaaaggctggtaataccgccgagggaagcgacggtttcactgctctgcccagttaccgtaccgcctgcaagctccagtctgcttgtctagctgtctccattgtcgccattatcttcttcatcttgccattcctgtcggagttgcacttgccccgccacatcgc

SEQ ID NO: 60572 - DNA, 789 bp, Triticum aestivum
  Clone ID: PAT_TA_60572
gccggccgtgccgggaacgtctctcttacaagtcacactcattcaatccaatcatccgccccctcttcacacatcgcacaatggcttcagctgctgccaaacgtctcgccggcaagaccatccttgtcactggtgcctcctccggcatcggacgttccactgctctcgagtttgcccgaactgcgcccaaggatgacctacgtctcattctcactgcgcgccgtgttgactccctcaaggagcttgccgagaagatcaagagcgaagtcggtgatggcgttcaggtccttccgttcaagcttgatgttagcaaccctgccgaagtgaagggtatcgtaaacaacttgcccgaagagtggaggaacatcgatgttcttgttaacaatgcaggccttgtcaagggcgtggctcgggctccagaaatcgctgaggaggatatcaacatcatgttccagacaaatgtcaccggtcttatcaacatgacccaggccatcctccctatcttccttgcccgacctgacggcggccatggcgacatcatcaatgtgggttctatcgctggtcgagaacctaccctggcggtggtatttactgcgccaccaaggctgctgtccgcagcttcactgagagcttgcgaaaggagctcattgccagccgcgttcgtgtcattgagattgaccccggccaagttgagactgagttctccgtggtgcgattctatggtgacaagtcaaaggccgatgcagtctatgctgggtgcgaacctcttacacccgaagacattgctga

SEQ ID NO: 60573 - DNA, 350 bp, Triticum aestivum
  Clone ID: PAT_TA_60573
gccggccgtgccggggccgagcgcactagcgagtgcttgtaacctgagcgggggcaataaggtggcgtgaacgttgccgtagcgctgtgggcctggtccagttgtgcacctgctggcccgcccgttccaagttggtagtggaccagctggggcctgtgcgaaagctaggcgtcacgggcttataatgtggcaggcattgcgtgaggctggtttaacagagcagcgaaaactgcccgcttccaacggtgggaggataacgggctgctgcacaactgggccgcttggccctcacagcctactccaacgaaccaccatcttttctataaaaaaaaaaaaaaaaaaggccccta

SEQ ID NO: 60574 - DNA, 768 bp, Triticum aestivum
  unsure (1)..(768): unsure at all n locations
  Clone ID: PAT_TA_60574
ctgtgcggcgctcgaggcggccgtccgggactaaaatattagtcaagagcttataaatcttcagtctcatcaaccaaaatgactgcctttcctcctcctcctgtcaacacaattgactggtccaacgtgggcttcaaggtccgcgaagtcaatggccatgtcgaatctacatactctaaaatcactggcaaatggacgcctctccgcttcgtcgctgatccctttatgcgcattcatggcatggctccagcgttaaactatggccaacaagcctacgagggcctcaaagcattccgtactcccaacgacgaagcaatcaccgtcttccgccccgaccgcaacgcaaagcgtcttcagcactctgcagaagtcgtgtccatgccccccgtgccggaagacttgtttctttccgccgttcgtgctgccgttgctctcaacgcagagtacgtaccaccccacgacacaggcgccgctctgtacattcgtcctcagctctacggatccagcgcacagcttggtctttcgccgccagacgagtacatctnttgcggtgtttgtcatccctaccggtgtctaccacggcgcgcaccccgtcaaggcgttgattcttgaagactttgaccgcgcggcgccgcatggaactggtaatgcaaaggttggtggaaactacgctcctgtgctgcgctggagcgacaaagcgcgtgacgagggatacggtatcacgctgcacctcgacagtgtgcgccacgaggagattgatgagtttag

SEQ ID NO: 60575 - DNA, 412 bp, Triticum aestivum
  Clone ID: PAT_TA_60575
gccggccgtgccgggacaattcacgtgtcgcatagcttctcgtttggaactttggattgtatatagtatatcggcgctgctaaaaatcagtcgcgaagtctcagtcgactggctagccgtccgatctgtagcaccttgtagattcgtgctgggtcacttttgtcccttgtttcggcctgttaaggcgtgggcaggcccgcttttgtttttccccgtcgaactggtaatcccggtacgcgagcgctgctgatgggctggggctgggctgtgttttggtgcgggtcgtttttattttctgtgtttgttttggggctgcattaaagagtgaggaaggggaagcggccaccccgtgatgattaagaagaggaaaacgccaagttaactggaaaaaaaaaaaaaaaaaaggccccta

SEQ ID NO: 60576 - DNA, 811 bp, Triticum aestivum
  unsure (1)..(811): unsure at all n locations
  Clone ID: PAT_TA_60576
gccggccgtcccgggatctttctacaatcaacacagaaaagacctacagttcgttttccaacctaaacaaaaccaatttgagattctttctgcctatcgcgcaacaatgtgttccgccgacttcttcctcgctttccttgccattctcttccccccactgcctgtatgggtcaagtgcggtctctgcagtgctgattctcttatcaacatcctcctctgctgtcttggctatattcccggcctcattcacgcatggtatctgatcgccaagtatcccgagccaccctacgaatatgagtctctgccccaagatcgcgagggcaaccgcgtcacctacgtctacgtccagtgcccaccaggtcctcaccagcacggtcagaacaacaagcagccaaagcctcaacccaagccccactctggcaacaccggaaacatgaactacggtacccagaacgctgccagctcttctcaccctgcgccccagcagcagcaaggcgtcacaaataacggcgagggcagcagctctaatgaccagagcgtacctccttcctacgccgacgttgtcgccggagaccacaagattcaatccaaggactagatgctctatcgaatggtctgacggaaataagagtgtaggcggtttcaaacccgtctccattgccaccaagacaacatgacacaattttgcgcagtcgacttcaacaacaagtgtgggtgagatggccgagttggttatggcgccaggttaaggttaaccttaacaccaatttcctggtggagcaatctcctgngttccagtcccagtctcatc

SEQ ID NO: 60577 - DNA, 462 bp, Triticum aestivum
  Clone ID: PAT_TA_60577
gccggccgtgccgggattcattcagtccaaaccaaaccaaaccagacactcaacactagcatcacacatgtcgcgtgttggagaaatctgcgtccagagggtggagaagatcggaacggagaggcagaagatgcccaccgcgagcgtgcacggggccgccggcgccgtggcgcagcggggcggcatcgacgcggccgcggcggagtatatcaggatgatgcatgagcggctggcggcggaggaagctgcggctgcggcaagacgctactagcttgccaggtgcagcttgcgcccagcctagcgtatgcgtgcgtagaatggaaatgcttcttttttttatgttcttttggttctctgcaagattgctagtagaaagagtactatgtaaatatagtttttcttttcttttaaataaacttatgatatatttattttcaaaaaaaaaaaaaaaaaaggccccta

SEQ ID NO: 60578 - DNA, 716 bp, Triticum aestivum
  unsure (1)..(716): unsure at all n locations
  Clone ID: PAT_TA_60578
gccggccgggccgggttttctaacaaaccgaccaagctatacttttttcaaatcatcatcatgattatttacaaggcaagattccgtcactggtgctcattgaagtgcaactacgacacatcgctgacctcgcattaggatttccttactggcgacgagatgatgtcggactcatatcctatcaaagaagttgatgatgtcatcttcgaagttgactgcgatgcaatctatccagaatcggttgctggggatgatgaacccgttgaattcaacaacgtcatttactctttccgtctccagcctacgacatatgacaaaaagacttatgtgtcttctctgcgttgtacggtttccgttacacctagcaatgttgagtctggtctaatgtgggtctagcttatctcaagattgttaagaacaggcttaagaaaattggaaagaatcccgagtacattgccaatttcgagaaaaatgcgcaagatttcttgaagacaaagctacttcccaacttcgacgacttggaattttacaccggagaaagtatggacctcgatggaatgtatgtattacgggtgtgaatatactaacatcatgcgtctgctaactattgtaggattgccgtaatgggatatcggggaggatggtaccacacctttatttcatgttctggaaggatggnctttaagagatgagaattttgaacatactaagtcaga

SEQ ID NO: 60579 - DNA, 846 bp, Triticum aestivum
  unsure (1)..(846): unsure at all n locations
  Clone ID: PAT_TA_60579
gccggccggtccgggactccgatccttctctcctagctagctgccataccacagcacgtagtacgttctagcctcttctccacttaatagctgttatggaacagacgaatgtcaggttgccccagctggccaagatagcagcgctcctcctcctcttcctcctcgtccccatggtgcctccttctctgagggccccttatctctacctcctcttcaacgccctcgtcgtcggccttggtgtccaggccggcatcacctccgtctcaagccggagcaacttaacagcccagcctcctgcccctgcccctgctgctgctgtaactcccaaccaccatcaccaccttgtcacttcacagccgccgatcatggcggcccccttgccaggacgactcagggaggtaaatctgcttgcagatcgtggtgctgtcaacaacgtcgtggccgtggccaagaaactgaaggagacgatcaagaaagtcccgtccagggcgagcatcttcttcatcgggagcctggacccccatgacgcccggcgaggtcgtggacgcgacgtcaaagacgctccacgacaaggaagggcggcaaaggtaaggtagacgcctcctccggggatctcatgagcaagcaggaactttacgccaaggccgacgccttcatcggcaacttctacaagcagctcaagatgcagaggggagagtcatggaacaagctgcaggacctgtgcagctaccaccccaccacaactacnagggcaggggcttctagagattctcgatccatgtacgtatatctagagtctagatgcatggctagcatctatatatatgtacgtgcatgcatatgcat

SEQ ID NO: 60580 - DNA, 821 bp, Triticum aestivum
  Clone ID: PAT_TA_60580
gccggccggtccgggatcctataacaacccaagcctaacaaagttccctaaacaacttttcaacaacaatcatctcacacattttcgagtaattcctcgtcttcacaaccgacaacatgcctttcaccgctagcgacatctgcaagatcatccttgccatcatcctccctcccgtcggtgtcttcctcgagcgtggttgtggtgccgacttcttcatcaacatcctcctcaccattctgggtaagtcatttgtcaattcaactcaacccctgcacccgatccctccggcacaggctcaagccagcactcaaagccatctctacgtgtcgctcaacagttgactaactcgccctcaggttacattcccggtattatccacgctctatacatcatcctgaagtactaagccttaccgcacttgacttctcagggccacggcgcttccctaatggcttaatgagtaccccgctttccaaccatcgtcaataagtggtcggtcatcggttgtcctggaccatgcgacatgctgtctgacggccaagacaccaatgactgccgtgtcgaccgggtacgcgcagtcggctggaagctctgtgtttctatttgcgcaaccttggcttcgctttgatacctcacgccggtgatccgcgcttacgagtttggacgccgattttacgacgggcatggacgcaatgcgatatcagttccttatttcctttgtttacttgcggatggaggcgcatgctggattggctctcaagcataatgcactgggctttttataattaattcgataccatcaatccacgtttccttacatc

SEQ ID NO: 60581 - DNA, 616 bp, Triticum aestivum
  Clone ID: PAT_TA_60581
gccggccggtccgggattcattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatccgacggagcagggcagcgccgccgcccaggtcgccgccgtggtcgtcctcggcgtggcgcctgagaacaaggcggggcagttcgaggtggccgccgggtagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgagagatttacctaattaactactcctaaatcgccaaaaaaaaaaaaaaaaaaggccccta

SEQ ID NO: 60582 - DNA, 729 bp, Triticum aestivum
  unsure (1)..(729): unsure at all n locations
  Clone ID: PAT_TA_60582
caatgacgccctgccctgaaggggcgagcgctatatcaaaagcagagtccgctcccggcgaaaaaggtcctgtgtatgaacagttcatcccgaccatcaagaacctctcatctctacccaccgcggacgaccttaatgccatcgtcgactctttctttggccggcgctcggcgttgtagccacccgaaccattctctcatccttcattgcggcacttcgagagatagagaaccaggacctgtggatcgaggtcggaaaccgcacgctagacacaattgctgcccagtcttcttcatcctccttcgtcgacgttgttgtcacactccgagagcttattgctaccgcccacgagaaaaatgaggatttcctcgacgcagccaaaaccttggctgacattcccctcgatagctcccagcgcaagatcaccgatgaggaaaaggctcgaacatgggctcgaatcgtacgaaactacctcgaagcagacgactctaccgccgccgagatgtacatcaacaagctcaagaacatcatgcattcggtcgccgaccaggaactgaacctccacttcaagctctcgnaagcacgtatccttgatgctcagcgtgacttcttgtcagcatctcagcgatatcacgaaattagcttcttccctgccattgacgaggacgaccgtgcgcatactctcagcatggctatttaaggtgcagtgttggcccctgcgggtcccat

SEQ ID NO: 60583 - DNA, 688 bp, Triticum aestivum
  Clone ID: PAT_TA_60583
gccggccggtccgggaacagccttctattatcatattctagttaatacgtgtgcttgggagtccttgcaatttgaataaaccaagatcttaccatgactgcaattttagagagacgcgaaagtacaagcctgtggggtcgcttctgcaactggataactagcactgaaaatcgtctttacatcggatggttcggtgttttgatgatccctaccttattgaccgcaacttctgtatttattatcgccttcatcgctgcccctccagtagatattgatggtattcgtgagcctgtttctggttctttactttatggaaacaatattatctctggtgctattatccctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaacttagtttccgtctgggtatgcgtcctttggattgctgttgcatattcagctcctgttgcagctgctactgctgttttcttgatttaccctattggtcaaggaagcttttctgatggtatgcctttaggaatctctggtactttcaactttatgattgtattcccagcagagcacaacatccttatgcatccattccac

SEQ ID NO: 60584 - DNA, 717 bp, Triticum aestivum
  Clone ID: PAT_TA_60584
gccggccggtccgtgatcttccttttctcttcttcacctactccttactcggagtacaagtcgaagatgaagatctcgtacttgtccgttgggcttctcgccctcttcagccccttggctgctgcttggagcaaagaagatcgcgaaatcttccgcatcagagatgaaatctcaaagtacgagaccgacccggccgccaacttttacgatattctcggtgtgcccaactctgcttcgctcgacgacattacaaaggcctaccgcaagcagacccgaaacttgcatcccgacaaggtcagacagtcaatgcgatccaaagctgaaaaggacaagaagtcgggcgcaaatgtcaagcctcctaccaatgctgagatcaggaccgctgtcaagaaggccggcgaggctcaggcccgtctctctcttattgctaacatcctccgtggccctgagcgcgaccgttacgaccatttcctctccaatggcttccctctctggaagggcaccgattactactacaaccgataccgacccggcctgggcacggtcatcgttggtctcttccttgttgtcggtggtggtattcactacctcaccctctacatgagctggaagcgtcagaccgagtttgtcgaccggtacatcaagtttgccagggaaactgcttggggggtggtggtttcaacatcccccggagtccaggctgctgaacccgctcct

SEQ ID NO: 60585 - DNA, 779 bp, Triticum aestivum
  Clone ID: PAT_TA_60585
gccggccggtccgggacctacttcgacagacgtcatgttagttggccgcttcgctaatatatctagctcgtttgtttccactgtagacttttctttctcctcaacaatatcctttactagttgagtcgtagcgtctctagtgcagcctttttttctacaactagatttcggagacgacaccgagaaaaggcccgcaagtcggatgttaaaaagattggtgccgtgattctccccaggcgaggcaaaaaaaaagtccagaaaaatgcaaaaaatctgcagagtgatggagtctgccctgggccagttacaagagacaataaacgtgcagaaatgcctgcactggttttcgtacgacaccttgattcgttatcccggcttggaacccgtcgactcgaggctagtcctgtaggcttcttctttttcgtttcatcccattcgttacacatgagttgagctgcagcatgcaaggaataatcgaatactacctagtatgtatgtacttcgctgtaccgacttggcaggttaaaattgtcgacgttgatagactggccaaagagggtcagggcaatcgtttcctccaatctcatctcatcctctctgtccagaacagacatgtccttttgccagaataagacgagatgacttcgtcaaggttggtagcataaactcagccttgttacaaatttggtcttgtaaatgctggagaggccggaatgtttcctactggatacgaactgggtctcgaacaatccgatgtcttatcccagatactatacaat

SEQ ID NO: 60586 - DNA, 326 bp, Triticum aestivum
  Clone ID: PAT_TA_60586
gccggccggtccgggacaccatggcgtctgcaggcaacgtgttcgaccatggaaggcacggcaccagccttgccaaagtcgagcaggccacgaggtgctgtgcgaccagtcccgtcgacgcgcagtctcctccgaagccgctgctggtagccgccccgtgcgacgcaggggagtacccggtggtgctgttcttgcacggctacctctgcaacaactacttctactcccagctgctccaccatgtggcctcccatggcttcatcgtcatcgctcctcagctgtacacggtatccggacccgacaccaccggcgagataaactcggcg

SEQ ID NO: 60587 - DNA, 798 bp, Triticum aestivum
  unsure (1)..(798): unsure at all n locations
  Clone ID: PAT_TA_60587
gtggcggcccgctcgaggcccggcccgtttccggaaaaaaaaacacaataatcgaaccaccataaagtgagcccagaagctgattgttgagtggctgccttatttctcaagtcggacagacgcgctcgttgtgtagtatttgttgccgcatttccccgtcccgtccctctattatatatctccatcatggccggacagcgtctcttcggattgattgtggctcaggttctctttgctggacttgctctatttcttgctaattcaccgtatctcaacatgtctgtcgcgccgacaaagcagccctgggctgacggtcctatgaaactggtgataacgcctcaatatgagacgaaaaagaccgatctttttaccacaggagccactcatatggcccttttgcacaacgccatcattcggggcttcaactccatctacctccaggctccccacgtcaaggatgccgacaaggctgactttattggttattcccaaacctggttcaagtttgtgaaatcgcatcacgacgatgaggaggacaacctcttccccaaggtccaagagctgcttggcgaagaccctgtctgggaggaaacacaccatgagcatgagtctttccttgcgccgcttgccgagttcaacaattacctctctggncttgcttcgcccaccgacttagacggagctcaggttatcaagctcatggaagnccttcagactgactttgagcaccacttcacagcgagatttctaccatcgctgctctttctaccattcaaggctcccaaggagactcgcccg

SEQ ID NO: 60588 - DNA, 792 bp, Triticum aestivum
  unsure (1)..(792): unsure at all n locations
  Clone ID: PAT_TA_60588
gccggccggtccaggattctgtccctttttctccttgtcagttacttctccgaagcgtctcagcactttgtgatatctctacattcaagatggcctctgctacccgacagtttgcccgcgcggccactcgtgccactcgcaatggcctcgctattgctccccgacaggttatccgtcagcagggtcgccgctactactcttccgagcccgcacagaagtcctcttcggcatggatttggttgacaggtgctgccgttgctggaggtgctggctactacttctacggcaacagtgcttcttctgctaccgccaaggtcttcaaccctagcaaggaggactaccaaaaggtttacaacgagattgccgctcgcttggaggagaaggacgactacgacgatggcagctatggtcccgttctagttcgtcttgcctggcacgccagtggcacctacgacaaggagactggtaccggtggcagcaatggagctaccatgcgattcgctcctgagtctgaccacggtgccaacgccggtctggccgctgcccgtgacttccttcagcctgtcaaggagaagttcccttggatcacctactcggatctctggatccttgccggcgtttgtgctatccaggagatgctgngtcccgctatcccttaccgacctggccgttccgaccgcgatgtctctggctgcacacccgatggccgtcttcctgacgcttccagcgccagatcatctccgcggtatcttcggccgtatgggttcaacgatcaagaatcgttgccctctc

SEQ ID NO: 60589 - DNA, 488 bp, Triticum aestivum
  Clone ID: PAT_TA_60589
gccggccggtccgggactactcctggaacacagaggccaaccttatgttcctggagtccccggtgggcgtcggcttctcctacacaaacacgagctccgacctgctgcaactcggcgacaagatcaccgctgacgacgcttacaagttcctgctcaactggttcaagaggttcccgcagtacaggtcccacgacttctacatcgccggcgagagctacgccgggcactacgtcccgcagctgtcggagaagatcttcgacggcaacagggtggggcccaaggagagctacgtcaacctcaagggcctgatggtcgggaacgcgctcatggacgacgagacggaccagacgggcatggtcgactacgcctgggaccacgccgtcatctccgaccgggtgtacgccgacgtcaaggccaggtgcgacttcactatggccaacgtcaccgacgcctgtaacgccgcgctccaggagtacttcgccgtgtac

SEQ ID NO: 60590 - DNA, 779 bp, Triticum aestivum
  unsure (1)..(779): unsure at all n locations
  Clone ID: PAT_TA_60590
gccggccgtgccgggataattcactgactctggaaaactgactttggacacttcaatcaatgagcttcgcaagagcagtgcaacgcattaagtccattcaaaacttcctcacccgaccaactgttccacatatctctgctgctgctgctggacaatccagattaatcaacatggcttcaactacagagacaaacaactataagttcaatcattctatgattcgagtcaaggaccccaaggcctccactaaattctatgagttcctgggaatgagccttgtcaagaagctcgaattccctgataacaagtttgatctctacttctttggctacgactcgcccaatgccctgtctcacaataagagcacttttgacagacaaggtctcatcgagttgactcacaactacggcactgagaatgaccctgaatacaaggtgaacaatggtaaccaggatcctcatcgtggctttggccacaccttgtatcgcggtcgacaacatccaggccgcctgccagcgaattgaagatgctggttacaagttccaaaagaagcttaccgatggccgcatgcgaaacattgctttcgtccttgaccctgatggtacntggggtcgaggtcgtcgcccgaaacgactacaaggagaccgagaacgtgaaggagactgacgtgtcgacttacaccatgaaccacaccatgcttcgcgtcaaggatgctgaaaagtcccctgagtactacccaagaagtcttggcatgtctcgcctccgcaccctgagaaacc

SEQ ID NO: 60591 - DNA, 836 bp, Triticum aestivum
  unsure (1)..(836): unsure at all n locations
  Clone ID: PAT_TA_60591
gccggccggtccgggaacctcataaccgacccaacctctggccaacacacagggacacatccctgaagaaacagccaaggttgtccatgggatttacaagggcgttattggaaccgaccaatctgaattttctcctttgctcaaaactgatggcacaaacgacgacaaacaaccctacctagctgttagcgaatggtacactgactttgtccgatctggattgattacactatcaaacggcaaggtcgaaacccttgaaggctctacagcaatattgtccgatggcacaaaggttgcggatgttgcagctgtggtggcagcgactggatttgatgcttcaccttgtataagctatctccccagcgatgtacttcaggcacttcagttctcgccaaagcacattgatcagcctgttgctttagctttccatggaactcaccacccacaggttcctgacttgggcttcgtcggtttctatcgatcaccatactggggtgtcatgcaaatgcaagctcgatttgtagcggcactgtggtcagataatgtttcgccggggcgcaattccgaggtcttcaagtgcaaacttcgtgatgatgtgtccatccagcgaactctcgacctacgagatgacccccgtgtatctcaattcccgatgggagactacccttacctgatgaacgaaattgcagaagcgcttgaaatacaaatcagtgaacctctcacaccaccggttcttgagctaccacataacaaccttcctttggatatgctgacgccagcacggtactcanaccctagcgatgaccaagaatcgaaggacgccgcgacacatcgct

SEQ ID NO: 60592 - DNA, 782 bp, Triticum aestivum
  unsure (1)..(782): unsure at all n locations
  Clone ID: PAT_TA_60592
gccggccggtccgggaaacaacatacctaactaactagcaaacatggcggacaagatccaagattctcacacgacacccgtcggccctgcataccgtactcaccagcagaagcccagtgccaccgtctctgtcgacgtcaacctagacaatgttcatgttctgccccagacccctcagctcattgccctactgtcgatgatccgtagcaaagagacggagcgagcagactttattttctactccaaccgaattattcgtcttcttgtcgaggaaggtcttaaccatttgcctgtcattgagcatactgtcactacgcctatcggtcgtacctacaatggtctcatgttccagggcaagatttgcggcgtgtctatcatgagagctggcgaggccatggagcagggtctccgcgactgctgccgctctgttcgtatcggaaagatcttgattcagcgtgacgaggaaactgcccagcctaagcttttctacgataagttgcccgaggacattngctgaccgatgggtgcttctcctggatcccatgtttgctaccggtggctccgaaaccatggctgtccaagttccaaggggccgaggtgtgcctgaggagcacattctgttcctcaacttgattgcaagccccgaaggtgtcaagaacttttctgccagttccctcgcttganggtcgtgactgctttcatcgacganggcctcgacgagaagaactatatcgttcctgggctgggagactttggagacagattctacaccatctaagggc

SEQ ID NO: 60593 - DNA, 719 bp, Triticum aestivum
  unsure (1)..(719): unsure at all n locations
  Clone ID: PAT_TA_60593
gccggccggttcgggacgactttcagatccattactcggactctgccttgtcacaacagccaacatgcttggccatctcgtctttacactatgcctagccagctcggccatcgctgctccggatggcgcgggtttagtctcagcaccagttgttggcaaatccctcaaagtccgggctcttccaaactctccaagtggtggttatgcgccaaaagtggttgactgcccctcgacacgccctaaagtccgccttgccgatggcctttcagaccaggaagaggcctgggtccgacgccgaagaaacaacacaatcgacccgatgacagatttattatcccgagtgaaaatctcaggttttgatgccaaaacgtggatcgagaaacaaaaacaacgcgactgcgcttcccaacatcgccatcgcggcttctggtggtggctaccgagcgttgatgaacggagcaggttttatctctgctgctgactcacgcaacaacaagactggccccatcagcggcctcttacagtctgctacgtatctggctggtctgtcaggaggtggttggctcgttgggtctatctttgccaacaactactccacaattccagacttgcaaaaaggtaacagggattcggatatctgggcgtttgacccgttcatcttcaangngcccgaaaagtcangtctncgcgtctttgacacagctgaatactgngatgac

SEQ ID NO: 60594 - DNA, 819 bp, Triticum aestivum
  unsure (1)..(819): unsure at all n locations
  Clone ID: PAT_TA_60594
gccggccggtctcgggagcaagatcttgacgaagttcgaacagctcatgcgggaaaacgaagccacggtattggaagactacgaccgcgatttgtgctttataatgaatataacccagacgaagaagctattggaaatgtttcaagtgcagatctaaaggcgcgtcccgatgcagtggtggtcgttggtaccactctcaaggttcccggaacccgccgactcgttagggaaatgtgccaagtcacacgaggacgaaagaacggtgttgccatttggatcaacttggacgacgagcccaaaggtgtcgatctgaagaactgttgggatatcgtggtgcgatcaaaatgcgacaacgtcgctcatctcgctgaccttactcattgggatttcaacattggtgaaggctacgagctcacgaaggaagaggaacaagagcgagaaaatcgtttggctaagggcaagaaacagttgaggtcaatattcctgcgagctcgccctcactcgacccagatgcggatgaaaaggctgctgtcaaaccaaaacaagtcgaacaggctcaaggaatcccaacccccaacgcaagccctaagatctcagcagccaagaagccaggaaagaagcaaagcacactttctttcaacggacaacaacaaccaccaaacactgctacatcggcccccaagccacgcaaacgcggtagaaagcctgctcaacccaaacccgacacaccagcagttgaatttcaggncaaaaagtttacaatcangataagggaaagaaacctgaaccaactatccccgcaaacgaaaagcgacggtt

SEQ ID NO: 60595 - DNA, 775 bp, Triticum aestivum
  Clone ID: PAT_TA_60595
gccggccggtccgggaaccttcactcaagctgcaccgtcaggactcaacacctctcaatccataaaattcctgcataatgcggttgtcaagcctcatctctcggcatggctccgtcctgcgccgctgctccggagccagagctcggccgatctgttctcatcctcaacgtcgactcatgagctcttccttggctggcgtgaaggagctcctcaaagtctcggatgagattgccgacggtgtttccactaacaagcccattgttgctctcgagtcaaccatctacactcacggagctctgggcaatgagcttgctcggcaacattccgaccttgttcgcagcaatggaggaattcccgctattattgccattgttgacggtgtgcctactgttggtgccacagcctctgatattcttcgcatgattgagagcggaagcgctgttaaagcatccaggcgagatattgcctatattgcaggaatgggcttgactggacagaagattcatggtggaactaccatctctggcaccatgctactggcaagactagcaggtatccgtgtctttggaactggtggctttgggtggtgttcaccgtggtggccatgactctatggacgtttctgctgatctgactgagctcggacgaacccgagttgctgtcgtcagcagtggctgcaaggggtttcttgatattccaggaccctcgagtttctgagacaagggtgctcacgtctcaacgttgccgatggcgatccggaagattgagtccctgc

SEQ ID NO: 60596 - DNA, 791 bp, Triticum aestivum
  unsure (1)..(791): unsure at all n locations
  Clone ID: PAT_TA_60596
gccggccggtccggggatacaccaaacaggcttttcttctcctgaaancaacagttggtgtccacaccagtgttagcgttgccggatttcagtaagcaatttgcaattgagacagatgattgcgaccgaggctttggggcagttctgcaacaagaaggacaccctattgcattcatgagcaagggactcagcccgcgttaccacgagctttctacctatgaaaaagaatacctggccattgtggtggccgtggaccagtggcgaccctaccagcaacacaatgagttcgttatctatacggatcagaagagtctcatccaccttgaagagcaacggttgactaccccatggcaacagcgagctttcaccaaactgctcgggctctgatatgtcatccgctacaaaaaaggcttggaaaacacagtcgcagacgctttgtccagtgcgcaatcaccgatctcctgtttgacatcatcacatgccgccccagctggctcgaggatgtggctgccagctatcacaacaatcctcaatctcagaaactttctggaacagttagccatcaaagaagaccccaaacaaagattcactctagagcaagggattttgcgattctgcaggaggatttggctgggcggcactgcagtgatgcagcanaagattatctctgctttgcatgacagcctcatgggagggcacagtgggtttccggncacctttcagcagatcaggcgtctttttgcgtggcccagatgaaagcacacgttctgcagtatgtgcgctgctactct

SEQ ID NO: 60597 - DNA, 820 bp, Triticum aestivum
  Clone ID: PAT_TA_60597
gccggccggtccgggatctccccatcgctcttgctccaatccttagttttgcgattcacttgctcccagttcccggtgtagtaattctttgcccctgtgagtagaactactattatcaagggtgggaaacagagcagctacttagagaatggagtgcagcggcgacgaggtggtggagctgaactgtgcccgcgccggcggagaccccggagagtacgccgccgtgctgaagaggaagctgcaactgtactgcgccgccgtggccaagaccatggaaggtaaacctcaagaatcttcgttgaactgcctcagttcacaagcttcggacacttcgccattggtttctcaagcttcttttgattgtgacggtactgttgttcaaggaaagccagctaatagttgtacatcaaaggagcagtcagatgatgacgatggggatctcgaggaaaatacagaccctgccagtgccaagcgcgtgaagaggatgctgtcaaatcgagaatctgccaggaggtcaaggaaaaggaagcaagcccaccaaaatgatatagaatcacaggttacccagttaagagctgagaatgcatctttgctaaagcgcctgactgacatgactcagaaatacaaggaagcttcccttggcaacaggaatcttacagttgatattgagactatgagaagaaaggtatatccttttcttgataactcttaactgtatcctgcaacctgctgtaactattttgaagggcgtgctagtgaatctgttgattatagcatggcataatatgtgctcatatgtgcattactagttactttttta

SEQ ID NO: 60598 - DNA, 558 bp, Triticum aestivum
  Clone ID: PAT_TA_60598
gccggccggtccgggatatagacgcttgctcactttgctggactcttcatctcatgtcatgcacgtcccttgccaatgctcgatatcatatgcatatgctgctgccctgacgccatgctcaacggccacacaagtacatctggatgtaagccgtccgagatcatcgttcctctcgtcgacgctatgcatgcgcatacgcacggatgcgctgcaagatgccataacgcgcatgcagaagcccttacgcctgcatccgctagaccctgcagcgctttattctaaattgatgtgaggatatatgaccaacgcaagggctccaccatagtcctggaaagcttatcattgagtagttacaaatcacctattgacaaggaagtgagatgcacgatatcttataagtcccagcgaccgtaaagaattaggaagatgatgtatgacaatctataaatatgccagaaggttgcactgaaggaaaaggatctcaaggcccctgagcatcgcttgcggtctataactaatgtagcccccgaaccggcaggaagtccatataaagctgat

SEQ ID NO: 60599 - DNA, 524 bp, Triticum aestivum
  Clone ID: PAT_TA_60599
gccggccggtccggggagcacctgatttggcccacggccattgtcgccatggacatggaccaactctgcttgatggccttagccacgattctcctgacgtttattctgaggcaggttctgggcggtaagggcacaggagccaggcttcctccgggtccatggaacctccccgtcatcggcagcctccaccacctggtcgccacgaagctgccgccgcaccgcgcgctgttccgcctgtcgcgccggcacagcccgctcatgctgctgaggctcggcgaggtgcccaacgtcatcgtgtccacccccgaggcggcgatgctcgtgctcaagaccaacgacctcaccttcgcgacccgtaccagcggccccacgctggacgtcgtcggcagcgccagcgagggcatcatcttcgcgccctacggcgagcactgtgttaggattaatcttgtctagccgagctgagagagtcagttagtttgttagctgcgtgagggtcgtgtgcctagagtgattctaggaggaac

SEQ ID NO: 60600 - DNA, 743 bp, Triticum aestivum
  Clone ID: PAT_TA_60600
gcggccggtctcgggcatctccactcttctctgagtgagttcggtgcccttggtttcgagtacggttactctctgtcatctcctcatgctcttgtcatgtgggaggctcaattcggtgactttgccaacaacgctcaatgtatcatcgaccagttcatcgcctctggtgaagttaagtggatgcagcgaacaggtcttgtcatgtctctgccccacggttacgatggtcagggccctgagcactcctctggacgtctcgagcgatacctccagctcagcaacgaggaccctcgagagttccccactggcgagaagctcgtccgtcaacaccaggactgcaacatgcagatcgcctacttcacctctcccgccaacctgttccacgctctccgccgacagatgcaccgccagtaccgcaagccccttatcatcttcttctccaagtctctcctccgtcaccctcttgctcgcagcgacattgaggctttcactggcgagaacgccggattccagtggatcatccctgaccctgagcatgagactggtgctatcaagtctcctgaccagattgagcgtgttgttctgtgcaccggtcaagtttgggctgccctccacaagtaccgagctgacaacaacatcgacaacgtcgctttcactcgcattgagcagctgaaccccttcccttggcaacaactcaaggagaacctcgaccagtaccccaacgccaagaccatcgtctggtg

SEQ ID NO: 60601 - DNA, 773 bp, Triticum aestivum
  unsure (1)..(773): unsure at all n locations
  Clone ID: PAT_TA_60601
gcggccgtccgggtttgttcctccccccactctccacttgacaacatcaccctaaacaccaaccttacacttcggccatgtacttctccgccattcttctgaccctcgcagccactgcatcggctgtcgatgttagggcttacagtaacagtggctgcaacgggggctgggtaggctgcgcgggaatcaatcccggcgtttgctgtgtgtttagcaactcagcaagcagcggcagactgagcgtttctgtgaacgctatcccaagcagctggcgcattcgcggcgaggctaacactggtggtggctgcacatacctcgccaaccagcaagattccaacggcaacacagacatctgcatgacatactcgtctcgcggtgaccgtaccggtggtagctactcgttcgtcggccgcaagcgcgctgccgacaactcttgccccgccgagcagcctgatggcggaaagtgcgaagctggtgtcaagcccgacctgcttggcctttctgatggcaccgtctacaacattgccaacaccggcgctggtgccgatgctgtccctgccgagttcgagccccttcgccgctaaatcgagggttaaaactaaatggatggtccgtgatgagggtatatgtcgggacgggaggtttggatacaacaaggataggctggaagtatatatcggactgaaggtatcctanataagagcaccttcggttgattacatatacctcagattaagaatatatacatttattcaactaaaaaagtcttttct

SEQ ID NO: 60602 - DNA, 651 bp, Triticum aestivum
  Clone ID: PAT_TA_60602
gccggccgggtcaggagcccataccaatcgcaccacctgccgacgactgcggcatcgacggcgacggcggcgccaacaacaggaaccccgcggcgaccccctccggccgcccctctgctccgcgccgcatcgggaaacccagccgcgatcctccagccacgccgccccccgcgtggccgctcggctcgttcggccaaatccagtccaccgcccgcggggtcccgatttgcggttagccccgcggattgcgcggcgcccaccctggagagagagagacgggtgttgacggacggctgcggcgcgcagtggtgccaccaccatgttgcagtgcctggacggtcgtgatgctcctgggcgatgtgctcctcatgggcagcctattcgatctctcgactctcaagagcctggaggttgcccacggtatcattgcgctgatctggattggcgcaatgtcgtggtatactggctatgagcttctccaatactaccgtattcatcctcaggtgcttaacatcgtcgacatgacccgtttcgtctgtggaagaacccttgagagtatcgccggtgtcatgatgatgattcaggtcattttcgtcgctgcttcagctatggtcaccctctctattgccctcaacaccatcagcgaacatg

SEQ ID NO: 60603 - DNA, 792 bp, Triticum aestivum
  unsure (1)..(792): unsure at all n locations
  Clone ID: PAT_TA_60603
gccggccggtccggaaacactcatggtgaaagaatcttggattatacagtcgttccgaccacatctgttcactgagttgtgtgtcaacatattacttcaacatgttgagcacgcaaggaagccacgctgatcgagcgggtacactcgaccccagagactacagaattgcctggattgccccacttgagatcgaagctaaagccgccctgtatttcttagacggacgacatcgcggccggtttcccgtcgaccgtggggatgactatgtcttccaagcgggtgtcatgggcggccataatatcatcatcgcaactctgccggcaggccaagaatatggcacgggctccgcggctgcactcgccggccaggtgaagaagtttttccccaacctctggttcggcctgctcgtcggtgtggcagcaggactccctgacctttctcgagtcccagcgcgcgatatacgactgggcgatgtgcttgtcggccttcccgtcggcgataacgcgggactggttccgtatgacctcggcaaagagacagaagacggatttcaaccgcttcgacttggccacagcctcgcgatgactgaacctatcgtgcgatcagctataggtagcatcaaactccaggcgcctaatgataccgagatcttcttaccatactatgagaagatacgcgattgtgaacatgaaactggtacattcgctgatcccgggcagacgatgacatattgtacctagcttggcacatggnacaagacgaagtcgctgaccgtcctcgacgatcaacggt

SEQ ID NO: 60604 - DNA, 709 bp, Triticum aestivum
  Clone ID: PAT_TA_60604
gccggccggtccgggaaaaaattctctcttctcatcaatccctttattctctcctccacctcatccatcatgtctgctcccgcccacaaattcaaggtcgctgacctttctcttgccgcctttggccgcaaggagatcgagctcgctgagaacgagatgcccggtctcatgcagacccgagccaagtatgctgccgaccagcctctcgccggtgcccgcatcgctggttgccttcacatgaccatccagaccgccgtcctcatcgagaccctcactgctctcggtgctgaggttacctggaccagctgcaacatcttctccactcaggaccacgccgctgctgccattgccgccgccggtgtccccgtcttcgcctggaagggtgagaccgacgaggagtacaactggtgcctcgagcagcagcttactgccttcaaggacaacaagaagctcaacctcatcctcgacgacggtggtgacctgaccacccttgtccaccagaagtaccctgagatgctcaaggactgcttcggtgtctctgaggagaccaccaccggtgtccaccacctctaccgcatgctccgtgacaacaagctccttgtccccgccatcaacgtcaacgactccgtcactaagtccaagttcgacaacctttacggctgccgtgagtcccttgtcgacgggatcaagcgtgctaccgatgtcatga

SEQ ID NO: 60605 - DNA, 708 bp, Triticum aestivum
  unsure (1)..(708): unsure at all n locations
  Clone ID: PAT_TA_60605
gccggccggtccgggagattcttttccactgcaaaaatggctcttcattcagcagatacctcgaagctcatctttgcccctgcgggtcatcaagctacaggccaggcagagcagttcacaaagggcactcttgtacgctctcagcttaactcggaatctcccatcccccagttccattcttggttctcgcgtgcccaggaaaacgattctggtgtcgaacacccagagacatgcaccctatccactgcctctcttccttcgggtcgcatctcatctcgcactgtctatctcaaggagctcgataaccgaggattcgtcatctacaccaacctcggcacctcacgcaagtcggcagacatagcgtccaacccgcgcgcggcaatgctcttcttctgggaagctctgcagcgccaggttcacgttgagggacgtgtggagagaatctcaaaggaggagagtcagaagtactacgacacgcgtgcgagggggagcaggatcggtgcgtgggccagcaaacagagtcaagtactcgagccgcagggtgaagatgacgatggacgcaaacagctggagaggtgngtgaaggacgttgagcagcgatttgaagggcaggagaagattcccgtacctgactttctggggcgggnttgagggttattcccgacaggattgagttttggcaggggagggagagcagacttcacgatc

SEQ ID NO: 60606 - DNA, 626 bp, Triticum aestivum
  Clone ID: PAT_TA_60606
gccggccggttcgggaaccatcacatcctctcttctttcctctccttatcactcactctctctctccgctgtcggctcaacgtactgcccgcgattcctacgaccaacatgcgcggcacccccgtcaagtaccccgtgtcctccaggaacgccacaggccataccaattggtggcttatagaacattctctccatcttcgatcactccaaaaacaagcctgacccgaagccgaagcccgcccccgtgctcacacaccaatgaagacatcaacgactacctcgacaacgggcacagacccgatgggaagaactacatgcccaacatactgctatgaaacaacaaattcgctcaccatacctcaacgaagaacttcacgcagactacgactatgaatcattagctgtggtgaacaagccaaaagacatctccaagaaccaggactgttagctcatccatgacacataggacatgctcaattacctcttattcatcaaaccctgtgatgtcagatggctcgctatatactggatgcccgatggcttctgaatatctactgtcacacttctccttgacaaaacgccctcaagtacttcggcgatctaatactcatgaatctgacgctctg

SEQ ID NO: 60607 - DNA, 776 bp, Triticum aestivum
  unsure (1)..(776): unsure at all n locations
  Clone ID: PAT_TA_60607
gccggccggtccgggtcttccgtagtatagtggtcagtatgcaagctgtgaaatggaagtgcgatgcggtgacgtttgggaatttgaggacgaaattacacaacgggtcccacgccgatgttacgatcgccagtgtgacatggtatccctggggcgatcgagcggtggctgttgacaccattcttgtgccgcccaccgaccagtggccagactggcatattcggatgcatcgcatacgctgcaacaaaagcattcctcctcttcatactattgaaggtggatttgctatccatggccgaaaggccgccgatggcatgatcctaccaacgatcgacacactcgacgacgccacgccaggcaaatctgaaggaatctactcagataatgtttcaacactgatctcctcggaagatggatgtagtggtatctcgattgaggctctactggaccgattcaaaacaccagtcgagagctacgcgctgaaacccgattcaaacaccaatatcgttcgccaacgaacactcatcccagccgcagcggtgtcaatttcggggggactggaaccccagcaagaacttttgattcagacttccgtgttttccatctcgtcaaaggccaacgggggtatctcagatgacgaatcttgtctcagagatcgctggctaaaccgcccttcagttgatgtggcaggttttgaacacatgtaatcaacagccattctctcagcattgagaatgggtaaganngattccccacactcaaactctctgtctaac

SEQ ID NO: 60608 - DNA, 500 bp, Triticum aestivum
  Clone ID: PAT_TA_60608
gccggccgttccgggagttttgtaggacagtcacttgttctactctcagaccgatggattttcctcgcccaaggaaatgctccacacgatgaacgcaattttcagagaaccactcaaactccaaacttccggttcttcattcgttgttcaaccagacaaataatctagaattccttatgccattcctctaaccatatatggatcacaaggtaatatcccgagctgcagtaattgtgtggaccttccaaacgaaatgcagcctgattctctcacctgtaatgcatgtcgccaataaaagggcagagacaaaagaaatgatctatcatatggtctgaacattggtgaatggcataggtagctggaggtgatgttgtcagtgatgcttttgtcacaaactttattctgtattgtaagctggtagcccaaaaaaattattctagaattcaatcaaagatgggcttgggccttttatataaaaaaaaaaaaaaaaaaggccccta

SEQ ID NO: 60609 - DNA, 857 bp, Triticum aestivum
  unsure (1)..(857): unsure at all n locations
  Clone ID: PAT_TA_60609
gtgcggcgctcgaggcggcctttcgagatctcattcccccgtcataccttcaccatgacgggcttcaagaagagcgccatctttggcctcctctcttcccttgcggcagttaccgctcagaagttcacaaaccccgtcatctgggaggatcttcccgacaatgaagtcacccgtgctggagacgcctactacatgacctcttcaaccttccactactcccctggtgctcctgtccagcgatcttatgatcttgtcaactgggaacacattggccactctgtccctgttctggactggtcgcctgactacagtcttgagaatggcaggagagcctacgtgaagggcatttgggcctcgtctctcaaatacagagagagcgacaagaagttttactttgtcgcgtgcatcagcggtaccggcaagacgtttgtgtacagcgcttccagcccaatgggtccatggacaaaaggcgccaccatcaacaagtgctactacgatgccgggttgcactttgatgagacggatactccttacgttgcgtatggtcgcgacgatatccacctcgctcagctgagcaaggatatgaacagcgaagtcaaggaacaggtcgtgctcagacctcctctgactctcgagggagcgcgtctctaccagcgaagcggaaactggtacatcttcttgactcgtcctccggatggtcaatacatcgccaagtccagcagcggaccttggggaccatacgataaccgcatcattgctgatagactcaaactctctgctgtgcctagagctggatctccctcacagggaagtcttgtacnaactcagaagggcgactggtactacatgggcttttc

SEQ ID NO: 60610 - DNA, 674 bp, Triticum aestivum
  Clone ID: PAT_TA_60610
gccggccgtccgggacttcaccgaacgctatatatctaaccatgtctgaaaggcacatcatggtatccatgccacttggcaaccagcttcttccaccaatcgacaaggtagctccagagccaagcgagcttcgcgtcgaaggaaaagttcgccatcatatcacgtcacaagctcaccattgcgcatcggtcgtgccactgcccatcagcacgagcaacgcggcgcgagagctctggatctctgcgacttatggcgatactcatcttgaaacgcacaagaaagatatcaacgccgcgcttccaagtgtggaaattcacacgagatgtttcgacgccctcgatgaagataaggtcaaggaggtaattgaccacgcgatgaatcgctacggtcgattgcatgtcttctttgccaatgtcggacattgtagcgagaactacactgttttctgatctcagcaaagactagttcatgtggatattgaacaccagcacgtccagtgacttcctaccagcccaatacctatctcccgatatgatgtagacctcgccacacaaaccccattctggaggcagcattataggcacagtctcatcacgcgtcatccgatccaatgccggttccacgtcctactcacactcagaggctgagtctgtgtgcctcgcgcacacgatatc

SEQ ID NO: 60611 - DNA, 756 bp, Triticum aestivum
  unsure (1)..(756): unsure at all n locations
  Clone ID: PAT_TA_60611
gccggccgttccgggaaaaacctacgcaaaataccgccaacacagtctgcaccacaatttttgctagtaactatggactcatcatactcaggactcgtggcccaagtcgcgtctctccctccaccgccacaaatacttctcttcggagactccattacacaaggcgcattctcacttcaaactgagctgacaaaacggtacatgcgtcgcctcgatgttctgaaccgcggtttcggtggatacaacaccaactcggccttaactctcctcccatcattcttctcagcagtggtcccctcgaaaactgtgcctcgcgttgcagttatgacggtacactttggcgccaacgactcttgcagtcctggcgagcctcagcactgtgatctcgaaacgttcaagtcgaatatcaggcgtatcctagactgggagggtgtgaggcttcatgaaacaaaagtcattcttgttacgccctctccagttgaagagtatcggctaccacacgacgaaaagggcagggcagaaagagtagccatgtatgcacaaatgattcgggatatcggcgagagtgaaaacgttcctattgttgacctttggactgctatgatgcgtacaactggttggaaagaaggggacattctgcgtgggtctttanaaacggtgccgagtgttgaactgnggcggcttttctatgacggtcttcatttgaatcaggatggttatgaaatctacatacnagagcttttgcgtgttttggaa

SEQ ID NO: 60612 - DNA, 847 bp, Triticum aestivum
  unsure (1)..(847): unsure at all n locations
  Clone ID: PAT_TA_60612
gtgcggcgctcaggcggcgttccaggaagctggttatctctacatcttgattttgccatccttttatttcgcatcaactcaatttggctaaaccttggtcgctgtcttccacgcaccatcagaatcgacactctcttcagtacctacgtgcgacaatctccatcaagagaaacgacctacctcgatcgacaaccgcgaatcatatactttattcaagatgaatgcgccagagcctgagcagactcccttcgaggctgtcagtgtccacacctcgaggatccagcgaaaatatcaagctttactggaccagtcaacccctttcgttctctacagatgggtcggcacagttgtctgtctcgtgcttttcttcctgcgaatcttggttgcgcagggctggtacatcgttgcctatgcgctcggcatctaccttctgaacctgttccttgctttcccgcagcccaaattcgatccctccaacgaagaggccgacaatgatatggaggatggctctgtaggcaccctgcctaccaagtccgatgaggagttcaagcccttcatccgccgacttcccgagtttaagttctggtactgggccacccgagccattgtcatcggcttcacctgcagttggttcgaggttttcaacgtgccagttttctggcccgtcctggttatgtactggttcatccttttcttcttgaccatgcgcaagcaaatccagcacatgatcaagtaccgctacgtccctttcactggtggcaaagaagactacgccaagaacagttcgtnaacaccagagctttccagataatttttttctccagcacgacaggtggctcgacccgcg

SEQ ID NO: 60613 - DNA, 772 bp, Triticum aestivum
  unsure (1)..(772): unsure at all n locations
  Clone ID: PAT_TA_60613
gccggccggtccgggaagcagcacaaaccagagctcctcaggaagagctaagcaatcgcatcgcatcagatcaccaacatccattcctagcttactagctagctgatcccaatggcgagcagcaccgctctctcctgcctggccgcgctcctgctcctcgcggccgcagcggcgccggcgtcggcggccgagaaggagacccggctgcgggtgtactggcacgacgtggtgagcggcgggccgaacgcgagggtggtgcaggtggcgcaggcgccgtcctccaacacctctgccaccggcttcggcaccgtgcttgtcatcgacgacccgctcaccgaggggcccagcctgacgggctccaggctactgccagttgcggacccactggttcgacgccaagaccggcgacgccaccgtggagtacaagatccatctccgccacgactgatgcattatcagctgaactaataataaaagggttcttggatccaaaaaacttattttagtctgactaaaaatagtctctttaagaggctaaagttcgaagcaccctgattanagaggggctaaaattagtcttaagactaaaaaaatttagtccgggtatgccaattaaaatgtggattagtactttctctactcatttaactcctctcctttacacaggcaaattctggattggagggtttggagaataataatgttcattaacttaaattttagccttttagtatttggattcaatatgggcgaggctatcatattttagtcc

SEQ ID NO: 60614 - DNA, 744 bp, Triticum aestivum
  Clone ID: PAT_TA_60614
gccggccggtccgggctcgcggaaggacttggcttgaggcattcgatggcttgggcatttccctcttgttgacatgcaatccttctattcagtacaccgtgtttgaccagcttaagcagaagctaattctgaggcagacgcgtaaaaacgcagaatcagcgggtgattcttccccggttgctctttctgctttctcggcatttctccttggtgccatctcaaaaagtgttgcaacaatcttgacttacccattaatcaggtgcaaggtcatgattcaggctgcagaccccgatgaggacgacgaggacgaatctgaaaagccaggcaattcaaggcctcccaaaacaatgttgggcgccatgcatgcaatgtggaacaaggaaggcatcccagggttcttcaaagggttacatgctcagatactaaagacagttctgagctccgcattactgctgatgataaaagagaagatttcaaagttcacttggatctcgctgcttgccctgcggcgatatctctttgtttctcggaagagaatcaagagtgcatagttgtatcatgcatatgtcagacctgagaaaaccagtctaatcgaccactggtatttcaagatcgtattataccaaataacagaagtacagaagcagaacagcacgatcatcttgagagcgccatggaatgttctgaataaatttgtttgtttttccatgtagtagctctgagcatctgattcgtacttggaat

SEQ ID NO: 60615 - DNA, 691 bp, Triticum aestivum
  Clone ID: PAT_TA_60615
gccggccggtccggggcagcaaaaggccatttccatcaaaagcagttcagttcaatcccacttcccgttgcatacactgatacaccacatcatctccttctccaagatggccggacgcatggcgcttgcggtggtcctgctgaccgcggcggctgccgcggcggcggcgcagtcggcgtcgaacgtgcgcgccacctacaactactacagcccggagaagatcaactgggacctcaacgccgccagcgcctactgcgccacctgggacgccggcatgtcgtacgcctggcgctccaagtacggctggacggccttctgcggccccgccgggccgaccggccaggcgtcctgcggcaagtgcctcctggtgacgaacacggcgaccggcgcgcagatcacggcgaggatcgtcgaccagtgtagcaacggcgggctggacctggacttcgacacggtgttcagcaagatcgacaccgacgggcagggcgtggcccagggccacctcaccgtcagctaccagttcgttgactgcggcgacaactaagtgattaattaactggtgctcaggcgctatggaaaataagaagctgcaaataaaagtactactaatgtgctacttgcattgatgcacttcgtaataaataaagtggaatgaattggacgtggaaaaaaaaaaaaaaaaaggccccta

SEQ ID NO: 60616 - DNA, 816 bp, Triticum aestivum
  unsure (1)..(816): unsure at all n locations
  Clone ID: PAT_TA_60616
gccggccggtccgggaagcacttccttctacacagttcatacattctttcgaaacaacaggccggtcctcttacagacgcttgtctttcattcttcttctagtacctgtctccttcccagtcagagtttccacaaccccatctttcacattttcaatatgaagttcttcacagctctttctttcgtagccggcatggccagcgctcgtcctgctggggatgttgaggcccgccagtttggtaacggccttggtagcggccttggtagcggccttggcagtgatctaggtagtgacctcggtagtggttttggaggactcagtggcggaggcctaggtggaggtcttggtggtcttggtggctctacgcgcaatgacctcgagcaaggcgctgctggtagctgtcccaaggccatctttatctttgcccgagccacaaccgagcaaggtaacatgggcatgtctacaggtcccgctgtggcaagcaagcttgaagccaagtatggaaagggtggagtttgggttcaaggtgttggtggcccatacacggccgatgttcctggcaaccttatgccggatggctcttcaccagctggtatcaatgaagccgtccgtctttataacatggcacacgagaagtgccctgatactcccgttgttactggtggatacagtcaaggaactgccttggttgctgccgccatctccaaacttgacccaaagttatggaccaggtcaggggtgcgttctctttcgatacacaagaacgcccagaacatgaggccatcctaatacccccangacgtactgtatctact

SEQ ID NO: 60617 - DNA, 852 bp, Triticum aestivum
  unsure (1)..(852): unsure at all n locations
  Clone ID: PAT_TA_60617
gccggccggtccgggatcttcatcagccttttgagcgcgtcctttgattctcctcgcaatggcagccgtaacagccaacggcgatgccgccgcatccgttcttgacgacatcaagcctcccgctggcgtcgtccttcctcctcgcgagattcgaaatgtccttgagaaaactgccggctacgtagcgcgcaacggcgccgtcttcgaggatcgtattcgcgacaaggaacgttccaacccaaagtttagctttcttaacccttccgatgcctatcaccccttctatcaatggcgacttgatgaagtgaagaatggacgtggcacagcaattgctgctggccgtgcgaatgaacctgccgctgaacctcccaagccccagggacctccgaaacccgtcgattttcaattctctgcgcgaacgcctcgcatcgcccgaaaagatttggatgtaattcaacttgccgccttatttgttgctaaaaacggacggcaattcatgacacagctggctcagcgagaagctggcaacccgcagttttcgttccttattcccaaccatactctccacaactttttccagcatatcgttgatcagtatacaacacttttgcgcgcgagcggtctgagtggagaaggtggaaagcttcaagaagagcgtgtaagagaacttgaagccaacatcaaggataagttccttgttcttaaccgcgccaggcaacgagccgaatatgccaaattcgtcngagtccgaacgtncaaagaaagaagaggaggaagaaagcagaaggaggatttgctcaattgattggagcgactttgntgtcgttgaaccatcacttttcacgaggccga

SEQ ID NO: 60618 - DNA, 707 bp, Triticum aestivum
  unsure (1)..(707): unsure at all n locations
  Clone ID: PAT_TA_60618
gccggccggttcggagctggtcctggtgacgttctgcgacaagcatactaaatacttcctaaagactcaatatatctctcgtaccaccctcatccccttaattccccatccgttaccacctgaagataaccgcaactcgccaatatctctctgaaacttatttacacctccccccaaagcgaccgaatcgaaaccgacatcatgggcatcaaagatctagctatcagctatgtggtgttcaccgtcattcacttcttcctcttcgcccttgctctggccacttgtggtctgtatggcactgacgttcatcatgcgaaccagcagggcaagtactccgactcgaaatgggtctacgctgtggtagttggtagcatctctgccgtgacatgtgttctctacttcgtcccctttgtcctgcgcattgccggtgtctttgttccggtatgggactttattctattcgtcctctggattgccctctttggcgtgttcggcaagatgtatatcaatgaggacgccgagggtgatggagatgtcagacgcatgaagaacgctgtctgggttgacctcgccagtgctcttctctggttcatcgctgcattgngggctttcggatactggtggaagcaccgcgaccacagatcgcgctttactggncgcgctcacgtctaatcaaatgatgggcccagacatgcatgtcaacaccc

SEQ ID NO: 60619 - DNA, 574 bp, Triticum aestivum
  Clone ID: PAT_TA_60619
gccggccggttcgggatcaagctctggctacccaagatcatcgaccaatcttatcagtcttcacgtttagttcaccataatgtcacacctcacatattacaactatgaaggagtaggcaaaaccaacaacaaggatactcctactcccaagccgtacgcgtgggcaacacaatcaagtgctctggccaaggtggctgggatgaccaaggcaatattgacaaggaagatctcaagggtcaaatcgatctcgcctttaagaatgtcgaaaagaacctcaaagatgccggcgcaagaggctgggcagatgtccactcggtcagaagttaccacatttcgctctctggttctttcgacttgatggtggaggagtttcgcaagtggatgcctgaccatcagcctacatggacctgtgtaggtgtcaccgagctgggcatccctggtatgatcgttgagatcgaggtggaagccaacattgcacaatagtggtattatacgacggaatatttgagcgttgtcactatttcacaaattccatggttttcttgtccaaaaaaaaaaaaaaaaaaggccccta

SEQ ID NO: 60620 - DNA, 805 bp, Triticum aestivum
  unsure (1)..(805): unsure at all n locations
  Clone ID: PAT_TA_60620
gccggccgttccgggacctttggtgtgttcctgcccaggttcgtgaaataaccctgcaggcgagacaaaaacaaagccatttcatcagatcccagccaagtacatcacgcacccacgagcacgaccaggcacgcacggcagaagcgatgggcgtcgtctcggcggtggcggacgcggtggtcgtcctcttctccctcaccatcgcggtgggggtcccgctcatcgacgcgcaggccgtcctctcgcacgacgcctacccggcgcagctgcgggacctcaagcgctggtacgccgccgagttcgacgactacctcatggcccacccgccgcccttcttccgcggcctcttgtgcctcgagctcgccttcctctggccgctctccgtcgccaccgtctacggcgtcctcgcccgccgccgatgggccgccaccacctccctcatggtcggcgtcaccaccctcacctccctgtcggcaatatttggcgagatgctgggctcagggaaggcaacgacgaagctgcttcagatgtatgttccatacgccgtgtttgccgtcattgccatcctgcgcggtctctgctcatgctcggcgccggcgtcgccggcatcttctgctcggaagaagagggtctagatttgatttgcatttctgacatttttcatcgataaaacattcaagtttcactaggtgtaagatgctttcttctgaggctgtaccgtccaacctatcattcaacacccagtgggaaatggaatgtccatactgccattgttaaaaaaaaaaaaaaaaaaggnccctanggg

SEQ ID NO: 60621 - DNA, 694 bp, Triticum aestivum
  Clone ID: PAT_TA_60621
gccggccggtccgggatgctcgccatctttgtcagacaggtgttgtggaagccatgcacgcagtatctactggagtaccactgggtgcaagccatgcgattgggcatcagcttggccctttgggcgttggccacggcgagacaagttgcatcatgcttccagctgtatgcaagttcaatgccaagaagggagtcaaccaagaccagcagaagtgtacactagatatcctggtaaagcaacagcctgtaaagtcgctcatggatgaagtgaagatgatggacaaagaatatgatctggccgacgttcttgacttgatcatcagggagttgggcatgccaaggtcattgagggatgttggaattacctctgatcatcttcctggccttgctgcaaatagcttgaacgatatctggatcaagactaacgcttataagatcacaaagaaggaggaggtcatggagattctggaagctgttattggtaattgaagggcagaggatagcttcacgagctggtttatgagtttggacttgaaaatccagcccctagttcggtgggaatcaacgagtcctgggtgcagcaatccatatctgtgacatccaacaacgacacgatgcaagttgatcgtttggaattgccaacaatatacccacagaatattttgcatggcaaaaaaaaaaaaaaaaggccccta

SEQ ID NO: 60622 - DNA, 633 bp, Triticum aestivum
  Clone ID: PAT_TA_60622
gccggccgttccgggaacatcaaacagaatgatttgagatccccagaacaacacaacatctacaacaataaccagttagacaccaacaaaaccaaatccatggagcaactgctcacatcctcctcctagccgcaaattctcctgggactggcttccgtcgagcctgatgggcagcaaatgcccaccttcaccacctctggtatcccaaacagccgatccaagcgctaattacacgctcaacggcgcagacactcttgaagggtgtcttgaactccaaccagaaaggatccgccccgcccacgacaacccccgctggcctcctatacaagataaccaaaccgccgccgattgtctctgctttgccttcatggtgcgtggtcatcttgaaggcacgaatgcccacaatgtggacacatccgtatctggccaagcgcgtcatggaccgcatccccaacgctgcattgactacgagagctctgaaaaccgtctacttgcactccgagttcctcaagatgtaaatgaccctcgactgcaagctcactcacactctgataggtgcatccgcgaccatacatcacctatgaaagataacatatcccgacagaaactgtctaataaaatgtactgaatccg

SEQ ID NO: 60623 - DNA, 783 bp, Triticum aestivum
  Clone ID: PAT_TA_60623
gccggccggtctcgggacccaagcggcccagcaccaggaaattcctcgtcgatcttctgagccaccccagacccaagcgccgagtgtcgaagccatcttgttgcaccatggtgttaacccagctacactcaccccttcacaactccagcttttcaaggttgctgagcctcctcagcaagagagacttattgagctttggaacatctgcccccctggaagcggcggcgatatccctgctcttgcatggagcagcactactgtcgagaacgaggagcaactagcccgcatccgctacgatagactgtcccaacaacatcaagtcatgagtttggacggcacacaggtccaaacaaacgatggtagatgggttagccagcaagagcctgagatggagccatacatggcatctggctacgaggagcttatgcgaagagagcaagaacgagaggctcgagattctcagcctagaagcacctatggactctactcccatgctactgacccggtctacatgggccccgactatgcccgcgagcaacagctgctggcgatggcatcccaatatggcgcctgccatgggttccgagcacccgagatggacacgatggatgttatgtaaatgaacaacacttttatcgtgctgataaacagaacagcactgcttctcaaatccagctacccaggtcaggagatgaagaatggacttggagtctttttttggcgatgtatgagctacatgtgccaccaaacgcacatgaaaggaacgcgatgaatgcatgaacg

SEQ ID NO: 60624 - DNA, 805 bp, Triticum aestivum
  unsure (1)..(805): unsure at all n locations
  Clone ID: PAT_TA_60624
gccggcctttccgggtattctggtgtcctaggcgtagaggaaccacaccaatccatcccgaatttggtggttaaactctactgcggtgacgatactgtaggggaggtcctgcggcaaaatagctcgatgccagaataaagctaagctaaagcaccctgttggagataaacccccagtcaattggtgatcgcgacaagacgagacgagcaaccacgtacgcccgaacgaacgagcaattgctcaagccactcctttacaaatcaattaatgcctcttgtcgaccccgtcaccatgtccacgactctcatcaagagcgggcctgcccagcaacagcccgcgcccaaggccgccgttcccgcgattcctcttgtcaactctcccctcgccctgccagcatcaattgctcattcggtactccttgctggcctattctactggcggttcgatgccctggtggccgaccctgtcacatctcttcagactggtcttcctgtagtcgctgctatccaggcagtctacttgatgctgagtcttcccccagcgggatcctccttgtcatctaagaagccgcgtcccggtgagaagaagaagtcatcggatggaagggaagcaaagtctttccctaccgctgttatttctttacttctagcgctcatcctaacgcccgccctccatattctacttgtccttttcggcgcgccgttcctcactcacgttccccacaccttcttgtgctgtgctcacatcgccctcctcgcgatatatcctgtctttctacgtcgaggntccgatcccgtcccctgca

SEQ ID NO: 60625 - DNA, 822 bp, Triticum aestivum
  unsure (1)..(822): unsure at all n locations
  Clone ID: PAT_TA_60625
gtgcggcgctcgaggcggccgtccggggacagctttctttccctcaacttgccaacatgaagtttctcttaatcagcctagccgctattgctgccgctctccccacggacaagggcattatacccggcaaatttgtcgtagcgctcaagcctacggacgatcttaacctccacgctcgatgggtatccgatgtcaacagagagtctttgtcccgtcgcggcgttgagtccgttggaattgataagacctttagtttccctggtttcaagggttactcggggtctttcgatgaggagactatcaagatcatcaaggctaattccactgtcctgcgcgtggagccagagcaagaatacactgtcgctgcgcaagtcacacagcaaagccccccatggggcctttcggctatttccaacgccaaaccaccatcttcaaaagcctcttatacttacgactcgactgcgggtgagggagttttcgcttatgtgctggacagcggcatttaccttgagcacgaagaattccaaggtcgcgccgtctttggcgcggacacgtcgggcgttaccagccagaagcagcacggtactctcgtcgctgccatcgtcaacggtgccacgtacggagttgctaaaaaggctactgttgtcgatgttcaggttttgggtgacagcacaggtaccactagcggtgttattgacggtgtggcctggacggtcaacgatatcgtgggcaagaagcgtgctggaaaggccgtcattaacatgangtttgtcggggcgtcctctgaaatcatgaaacgatgcgtgcagaagcgatcgatgc

SEQ ID NO: 60626 - DNA, 684 bp, Triticum aestivum
  Clone ID: PAT_TA_60626
gccggccgttccgggcaggctcagaggaccatcactcggactaaaacgacatcaacttgcaagttgagcgattcagcattttcaatttttgagctacgactgtcgaagaatggctctcgacgacctggcgataagacaacagtctaatcgaccgacattatttacatttaatcgtcctgtttttatcatctgcaaacattattgcaacacggcttagcgcggcatagagaaatgggccagaaaaggaagaggaatcatggatttggagcaaaggcgaggagctggggtgtatacgattcgagtctatcgcttacggtgcattgggtcttattcgtacccaccatctcaggttttttatgatattgggtcttttgggatgggaataggcggagtgctggaccgacctaccgatacccttccacacggcgtttatggagttgactacgtttgtggtcctattattctgcatgttcaggcacgcgctgccttgcgttctacttcgaagcgatcgcttatgtccatatttcaggacaatgttgacattacctcggcgagggtactctttgagttagatgagagagggtgtcaggcattacgaatggatctgaggaggattgtactattagtttcacatttatggtcacgatatacccgtttcgaaaaaaaaaaaaaaaaaggccccta

SEQ ID NO: 60627 - DNA, 852 bp, Triticum aestivum
  unsure (1)..(852): unsure at all n locations
  Clone ID: PAT_TA_60627
gccggccgttccgggagagaacctcttttctagagtttcaattcaagtaccccttgaccgctcttcgtcatctccaactcaaaacgtcttgtaatcgcctcttacgaaaacagcaaacctctctcttcagacactcagaaacaaacatcatcgtcagttcgtatattcatcaatatgggttcccacgactctctcaaccaagccgaaggtgctcctcgcttctggtaccgcgataacttcttcctcacaaacgacaagtcttatctatgccctcaaaccttcaacaagtctctcgatgacaactggtggagcagccccttgccaaacggacaactccagagggtgctggataactgtctgaccctggcggtgtactatactccccaaaccgccgaggagatgaagagaaacggcatcgcttcaccaaaagatggctccccgcataagatggtcggtttcgcccgcgtggtgactgactatgtaaccctagcctacctcacagacgtcttcgtcgtcgacgagttccagcgacgaggattggcgtcgtggctgatgcaagctctcaaggagatcgtcaacgagtggaagcacatgcgcggactccttctcatgacccacgaccaagccgcagcgaggctgtatcaaagggaactgggtgctcaagagttcgaaaagggtccgtcagctggcctagtaatgctcgaaatggccggnccagncgagaaacctgcacccaagcactgaaatgcatnntcgcttttatgttatttctttcctttttttttttttttttttggtatctagcgatgcatttaccccacgctttacgtctgggtgactttttgtttctgc

SEQ ID NO: 60628 - DNA, 713 bp, Triticum aestivum
  unsure (1)..(713): unsure at all n locations
  Clone ID: PAT_TA_60628
gccggccggtcncgggaagagtcgagagacgcagataaagtcacttatcatctcatgctcaccctcataccgttgcgcgtgcgtcgcgagcatgatgcctccctcctgtgattgggttttgatagtttcttggctgtgcttgataatggaagtcgctcctgcgttcgagatacgttcgacgatgacgcacatctgacggttcctcctcataatcatattcggtaatgaggtcaagatcgcggacaacgaccaggcgccgatcttgcccatcggtcgcgtggtctatggcatcgactgctctgcgatgtacttcgagattaggaacatggtgcttatcatgaagatcgccgacgctcgttcgacaacaacatgaacaccaagggcacgctcgggcagatcaatctcctcaggcatgtccaccatgagatcataataggcctccgagatgagatcacgcctactatttcgcagtccatcaacaaaaactacgtccccactgagctcatggacacgagacctccaccacatcatcgcgcttccaaccgaaaactctcgtaagtacactgccagtacttcctgtaccaaatgctgcgcgaactcaattacatccactcggtcgacgtgatctagcgagacctgcaaacgaataacctgctgctgaacgacaactgtgacctccagatctacgacttctatctgccgcggncgtcatc

SEQ ID NO: 60629 - DNA, 845 bp, Triticum aestivum
  unsure (1)..(845): unsure at all n locations
  Clone ID: PAT_TA_60629
gccggccgttccgggacaccatctgcaaagtgtaggcttttcatcatggttcgcttcagttcactgttggctgctgcggcatgctttgttgctgccgagtcggtcagtatcacggttggcagcaagggcggtaacgctactagcggtcaccaatatggtttccttcacgaggatatcaacaactccggcgatggtggtatctacgccgaattgatccgcaaccgagccttccagtacagcaagaaataccccgtctcgctttctggctggcggtccatcaatggcgccgacctgtccctcaaccgactcgacgagccgctttccgacgtccttcccgtctccatgaaggtcgagcctggcaagaagggcaagtccaacgagattggtttcctcaacgagggatactggggcatggacgtcaagaagcacaagtacactggctctttctgggtcaagggttcctacaagggccacttcactgcgtctctgcgctccaacctcacagacgatgtctttggcagcgtcaaggtcaagtccaaggccaagaaggacaagtgggttgagcacgagttctccctcaagcccaagatggatgcacccaacagcaacaacacctttgccatcactttcgaccccaagggtgccgacggagctcttgacttcaacctcatcagcttgttccctcccacttacaagggacgcaagaacggtcttcgagttgaccttgcagaggcactcgagggtctgcaccccagtcttctccgnttccctggcggtaacatgctcgagggcaacacaacnagacctggtgggactggaaggacactattggtcctcttcgctac

SEQ ID NO: 60630 - DNA, 826 bp, Triticum aestivum
  Clone ID: PAT_TA_60630
gccggccgttccgggaagctgcccatcatgtcggaacatcttgccgtgataagctcaaagagccagttcgactcgcttctcaagtcttcgcgcatcgttgtcgctgatttctacgccgactggtgcggtccttgcaagcagatcgctcccctctacgagagcctcgccatcacactatcgcgccccaacctggtcacctttgccaagatcaacagcgacgagcaagccgagctctcccaagaatacagcgtctcaactctgcctacattcctcgtcttccgcgacggaaaagaaatcgacaaggttcagggagctgaccctaacaagcttaaggccatcatccagaaacttgtgaccgaggtcgactcccttggcgagagctctggttcaggaagcggcgatggagtcaactggaagggtgccgaagccccccgaggctacagcgacatcaccgaccaaatagagctccgagatctcgaggttctcaacgccgatgaggctgccggtggtgtccgggttcttttcgaaggctccaagccaagcggtcttggtaacggcaagggaacatccaaggactacgttcagagcggagccgacgaccagctacttctctacgtccctttccagtctatcgtcaagctccacactctgcagctcacctccctccctcccaaggacgacgaagatgtgatgcgacctggcaacgttcacctgtacatcaaccgcacccacaacctcgactttagcgaagccgacgataccgaccccacgcaggcaaatcgagatcggtcccgaagactggaacgctgacggaacagtcaacctg

SEQ ID NO: 60631 - DNA, 743 bp, Triticum aestivum
  unsure (1)..(743): unsure at all n locations
  Clone ID: PAT_TA_60631
gccggccggtccgggccgctgaagagatgaactttcatggatatctcaatggctctcgagaagatcagggcggcaactatggctaccctcattgctacaccctctggtctactgaagactttcccaatcgtcgtgatctcaaagttggcgaccaatttcctgctgaccgtcagtctcgtcaaagcaagagcgataccaaccccactgacaaggaatgcaatacggattatgtccccccagtgctggctttccaagctcacactgcgcctctggatatgaaatttgacaatgatggcaaaaatgcctatgtttcgttccacggaagctggaatcgtgagcctccagttgggtaccagatttctgagataccttttgaagatggtcggcctgcaaactcctcacgaagcagagacgctgccacacccatcatctacaacgaaaagctgtccagctgtcctgatgactgcttccgtcctgttggtctggcatgggacacacaaggacgattgtggttcagctctgataagaccggcgagatctttgtcttgaatcacaacaaggacgactctagccaagacggctcttctaagggcgacagcgatgatgacgatgataatgacaactcggcattttctctgcggcctgnctcagctgcattgattgtgacgatggcggctgtcatcatgnngagattccctcgcataacttctaaagtgacagcactgtactcgtgcaccggtcgt

SEQ ID NO: 60632 - DNA, 248 bp, Triticum aestivum
  Clone ID: PAT_TA_60632
tactataccttgacttttacgcaaaagcactctttaccgcacatcatcaactacgacctctcgagataccactaagctaatacccaacccccaaaagccaaggcgtccaatgaagttcgctgccgctcctcgctttcgatgccggagtagctgcccacgccgagaacgttacctacaccaccgaggtgcgcactgctcacaccacctactgccccggaccaactgagatcgacctcggagaaaagact

SEQ ID NO: 60633 - DNA, 688 bp, Triticum aestivum
  unsure (1)..(688): unsure at all n locations
  Clone ID: PAT_TA_60633
gccggccggttcgggggcaccgcgcgccacaaatgtgcagtttgcgtggcttgctccgtccctctcgttagttgccctgctctagtgggattcatgataatctcactacggtttgatcaagatgtctaccttgaattattgattgcgccgtgaactgttgaaggtgcaagagtaggatgaatcaggttagcgaggagccaagggatgatccgtccaagagggtgagcggggccgcgccggcggcggcacgcgccggctgcttcgactgcaacatctgcctggacttcgcggtggggccggtggtcaccctctgcggccatctctactgctggccttgcatctacgagtggctgcgccgcgacgccgccggcggcaccatctcgacggcagggcggccgtgccccgtgtgcaaggccgcgctcacgctggactcgctcgtgccgctctacggccgtggcggcagccggtccggcaagtcacggctccgcccggcccttccgcgccggccgaccgtgcaccggggagccgtcgagcaacagagcgcgcgaaccagcggtggcagtaggcaccggcgtgtgatcgtggaacccgattcgccgactcgttcatcccgacacacgcgtgtcggtgccgcgcagttcgacatcctgtaccctcctcccgccctgnggcgcggaatgaatgcgat

SEQ ID NO: 60634 - DNA, 701 bp, Triticum aestivum
  unsure (1)..(701): unsure at all n locations
  Clone ID: PAT_TA_60634
gccggccggttcgggatcagtcgatctctgaccagtcattccttcattagtccttctttgacgactagacctatcgcattacagggaaaccactcctttagttcccttgtctaatttttgttatctcgatcttgattaattaattaattcaccatgagacaatctttcctcactggccttctggccgcccccctgtctgcctacgcagtcgccctcactggctacgagtacatcgttgtcggctctggtgccggcggtggtcctctggccgctcgcctggccatggctggtcacaagaccctcctcatcgaggctggtgatgactacgccaccaccaactacaccgtccctgcctactcggccaacgcttccgaggaccccgagatctcttggaacttcttcgtcaagcactacgccgacgatgagcgacaggctcgtgacttcaagaccacctacgacactcccgacggagagtacactggtctcaaccctcccgctgatgccaagctcaagggtactctgtaccctcgtactcaggcactcggtggctgcactgctcacaacgctctgatcgctgtgtacccccaccagtctgactttgagtacattgccactctcactggcgatgactcttggtccgccaagaacatgcgaaagtacttcgtcaaggnncgagacaacaaccaccttcttcctcttca

SEQ ID NO: 60635 - DNA, 484 bp, Triticum aestivum
  Clone ID: PAT_TA_60635
gccggccgtttccagaaagagcaagctcagcaagcaacttcatggggatgaagcgatgcatccttcccagcatcctgctgatgctttcactggaggcagccctcctcggcgccgaccgcccctctgtcgacgccgaggagggagccattctcctgccgagacaaggccaagttgcagaccaacaagcagccatggcggcgacgaagagggcgtgcaagggcatgagaccgagcgaggtgcaccacgaaccatcccgtcgatctgcacctgcgtgaacgaggcatccgagagcgcctacacctgcaaggcatgagtgtcgtaaacgcgaaacccgtcccttcttttttttttagcatcagccacgacggttaccccgaaaccatctgacgggcgtgtgagtgctgctactcggccgtaagcaccaagacataccctccgacgtgccgctgcaggaacgatgtcaagaggtgcgctccgacctgca

SEQ ID NO: 60636 - DNA, 830 bp, Triticum aestivum
  unsure (1)..(830): unsure at all n locations
  Clone ID: PAT_TA_60636
gccggccggtcncgggactcaccaattcattcaataccccaatacttcctgtttcttctgcatatccatcaccaagatgccaaccaccgaactcatctcctacgacgaggcccagaactcagcattcgacaatgtcctccatggaaaatcaaaagaatcaagaggtggcatgcgagccatgatgaacaaagacaataaagctcatgctgccgctgttgatgagtactttcagttctttgataataaaaaggccgaggatgaagtagaggctgtccgacaggagagaaccgacaactatgccagtttgacaagacaatactacaaccttgccacagatctctacgagtacggatggtcccagagttttcatttctgtcgctttgcgtatggagaatcctttgaccgtgctatcgctcgacacgaacactacctcgctcacaacatcggcatcaaacctggtatgaangtcctcgacgttggatggtggtgttggtggaccagcccgagagattgtcaagtttacgggggctcacgtaactggtctgaatatcaacgagtatcaggtcgggcgtgcaggtatctatgccgagaaggaaggactttctgataaactcaagtttgttcagggcgattttcatgaaaatgccctttcccgataactcattcgacgccgtctatgccatcgaagcaaccgttcacgcaccctcccttagaggcgtctacagcngagatccgacgtgtcctgaaaccagcggcatcttcggtgtctacgagtggctcatgactgatatatatgacaacgatgacctcggacaacgtcgtatccgtct

SEQ ID NO: 60637 - DNA, 870 bp, Triticum aestivum
  unsure (1)..(870): unsure at all n locations
  Clone ID: PAT_TA_60637
gccggccgttccgggatcttacccagtttctgcaagacagacgatataaaatggcgacagtacaacacatcacacctcgttcggttttgctaaaaaatccatcacacgagaacctaccacaatcacgtccaaattctatgatcattcgcagtgtggttaatgatgagggtcttcctgaagtagtgaattccagttatgctatgatgaattaccacgacgctccaataccggtagattcagaatccgataagcgatttaatgaagctcctatcccagtaggaacactggacgattctccgcctccattgccagcgcgcaaatctacgaaccaatatccatatggtccggaatcttatgtgtctcaacaccaaccgccatacagcacaggtggttacgatccccaagtgcccctacaacatcccgacaataacggatctacgccacgaccgccttcttatcacggcaatgaagtggtcacgcatgtgacaccactcactgaactcggggatcaccccaagtttgtagactgccctttctgcagacaccgtgccgagacacgagtgaagaagacctcatcaagagtcacacatatatccgcgacagtccttgggtttacgaccatcgccggtgctgctgttccctacgctggaaagtgngctgctcatacaacccattactgcaccaactgcgaccgcaaagtagccatacgaaaatggggaaccaaagagatgaagggcttgngaactcctgaacatatgcgggaaattcacgatatccttctgcgggtttacgtccatgagcagcagttcaggatgagttaggggtaaaagagccaaaatgatgctacttcagcaatactctgacacttga

SEQ ID NO: 60638 - DNA, 725 bp, Triticum aestivum
  unsure (1)..(725): unsure at all n locations
  Clone ID: PAT_TA_60638
gccggccgtgccgggaaacggtgcatccatctgaccatctcaagaaagaagagcagcagagccgtgtttaatcaaccgtgagctccggtccgcatcatctcatcaaggtcgaccgatggcgtttctgggaggatcattgcaagttgacagccggaagatgatggaggagaagaggcagagccacggcgggtcgtggcggcaggcgccggcgtccgtgaggcagctgttttggaggatgagacgcgccgtgctgcggccgaagcgccgcgccgtgagtttcgggtacaacctcaagagctactcccagaacttcgatgacagcctcgtccctgcccaccgcctctagtgacagacactcacagggtcttcttctctcgattttacttgccgcccggccggaccacggctcgaggctggagagtttgaagcgtcgtcaccttgtgatgtgctcctcctctagctcagctacctgtgtagtactcgtagtattactatattagacagtattgttcgtacactagttgtttactgttgaaaggctgaaactagccatgaaatgacacagggtatggtttcacttgccacaatggaatgggatttaaactatttcaatttatgtcacgcgctagaatacactctcgctgctgctgccattttattctcgggatgaaatcaatgggagtgaagcgaattttcttagaaaaaaaaaaaaaaaaggcccctan

SEQ ID NO: 60639 - DNA, 810 bp, Triticum aestivum
  unsure (1)..(810): unsure at all n locations
  Clone ID: PAT_TA_60639
gccggccgggtcgggactacttctttgtaatttgataaaatgtcgtggctatctattccctcagaatctcacttctccatcgccaacatcccgttcggcatcatctctacatcctccaacccaactcccagacctgccgtcgccattggagatcatgttctagacctgcaagcctttgcaaagggagatggattctctggtagcccagatgctcaaaagcatgctgacgtcttctctcaatcttcgttgaacgcctttgcagctcttggacgtcctgttcatcgcgttgtcagaagctatctccagggtatctttgcaaaggacaccaaatatgcccaaattctcaaggacaaccaaaagctccaagaaacagctcttctcaagagttcagatgtgaagaaccatgttcccctcaacattggagactacaccgacttctatgtcggaaagcatcacgccttcaacgtcggctgtcttttccgtggtcccgataacgcgctgcaaccaaactacacacatcttcctgtcgcgtaccacggaagagcaagcagtgttgtcatctctggaacaccaatccgccgtccatggggtcaaatcctccgtccgggcaacaaggttcctgatcttgcaccttccgagaagttggatattgagcttgagatgggcatgttcatctgtcgcgagaacgctttgngtgaacccattcctatcagcgaagcagagngactatatcttcggctatgtccttctgaacgattggagtgcgcgtgatgtccangncctgggagtacgtgcctcttggacttttac

SEQ ID NO: 60640 - DNA, 387 bp, Triticum aestivum
  Clone ID: PAT_TA_60640
gccggccggttcggatcgtccccatgaccatctcccagccagaaaggagtacgtcgacaagattatcaacagaggtgggaaccaaaccgtcgaagctcgttgacggcttctagtgttcggcagcgagcgtgtcttctgtatgtatctacatatcacaccaaaagttactgaataagatgtgtgattggctttcgccgtgtgctcgtaccagcatcgatcctgtatcacttgtgtggttagtttgcaacatacccgttcgaaaatctttgctgaaacttcttcgcctggcgatgatgcctgtattgaataataatgatccagtgtcagcaatggtgtgacgaaaacatattcatgttaaaagaaaaaaaaaaaaaaaaaaggccccta

SEQ ID NO: 60641 - DNA, 822 bp, Triticum aestivum
  unsure (1)..(822): unsure at all n locations
  Clone ID: PAT_TA_60641
gccggccggttccgggacagtcacctcgtaagcaagcagctactagggcctcaacaagcaaaccttgattcgacatggcgaagtcccccatggcgatcttggctctcgggctagcagcactagtcctatctggcgccggactggtggcggcgcagaactgcggctgccagccgaacgagtgctgcagcaagtacggttattgcgggaccgatgacaggtactgcggacaagattgtcggtcgggcccgtgcacggcgagcggcggcgggagcggcgatcccgtggagagcgtcgtcaccgatgcgttcttcgacgggatcaagtcccaggcagccgacgaggggtgccccggcaagagcttttacacgcgccagtttttcctggacggcgcccaggcgaaccccgacttcgggaaaggcagcaccagcgacgacggcaagagggagatagccgccttcttcgctcacttcatccacgagactgggcgtaagttcacctccaagctccaactaactactactaccaacactggaggaatttacctctccatgattaagctggctgtatgtaacttgtgtgcagacatgtgctccatcgaggagaacggaggggcgagcaaggattactgcgacgagacgaacacgcaatggccgtgtaccccggggaaggcgtactacgggcgcgggccgctgcagctgtcgtggaactacaactacggngcggccgnngagagcaccgggttcgacgggctcacagcccggacacggtggcgcaggacccagcgttacgttcaggggcgcgntctggttctggatgaccacg

SEQ ID NO: 60642 - DNA, 706 bp, Triticum aestivum
  Clone ID: PAT_TA_60642
gccggccgttccgggaagacttgtctctctcttatctctctctcgataatctaggccagatacatccacaacaactcaattgatgctgttccatcacaccgtttgccgacgctccagtcacaggacaacggccgcgttgatggccctctcttctctcttcaaaagaacgctgccgaccaggacaggtgggaggacattttcaatctggctgtcaagacgtccaacgacaccgctatgctcagcgtgagaagatccgactataacgacttgagaaatctgacgactctggctacatgcacggtgagggcaacctgatctatcaaccgcgtatcaaggtcatgaaaaagatgcgcccccgagcgcccggaagatcctccagcttctccggctcctccatatcaacaacagcgtcttcgtaaaggaaagcatggtgatcactgacatgatctggggtgtcaagccctgtatctcctagggccacgccaatctgaagaccggctagaagctcgcctactagcgagagaacgataaaggctgaaagcagcgtaatgttcttaccgacgattctattgttgacgagaacctcagcaaggacggcaatccctgtgttgatgatctcatccacaagatcatcactgacgtccacatattcaagcagggctgatgcttcctctggcccttcaagctctccaaccccactggtggc

SEQ ID NO: 60643 - DNA, 648 bp, Triticum aestivum
  Clone ID: PAT_TA_60643
ccggccggttccggaaacgtttatcgacatgtcatcacagtccgcaaaacgtaggaccataaatatcccatcaaccagagaccagccagcgatagtgccgtgttacgatctcgaggatcgcacccgctcagcccttcagagtctacatgaaggcgatttattacaacttgtgagacaatagtttccaacactcactttcacgctgacgatcatcatgggccgtggaacatggggaggagttgtttcaattcgtgagtgtcgatagagacatcacaccggactcagtaacccatcatctcaactctgccgacccgaagaacgtggctttatatcggtgtcctgtatctaagaatactgttttaatctggactcggtgcccggcaacaagttcttcgaagcgaattcgtgcccaaaatcgggtcagaagagatcttacttggtacgctggcgaagagggtatccaaaatattgttactgtaggtaatacacttctgtgtcaaagcagcctatctaagtttatacagttatcaatgcgttcaaaggaagatgtgactgtttccaaattaagagacgcttgcggaatcagtggagagatacaatatcaataaaaagctattgaatcaaaaaaaaaaaaaaaaaaggccccta

SEQ ID NO: 60644 - DNA, 539 bp, Triticum aestivum
  Clone ID: PAT_TA_60644
ccggccggtcctggtgttggaattgcccatgtggaggattttgactcaatcgaggatgccagcaagagagcatcatgtgagtgccgcgcgcttgattgtggcaaggcaatcctgaagggacgccgccaatttgagagcatcgagcaagtgattgcacttgtccagtcagtaactcaagactgagaaaaccagccgtctgttcggcgtttccgattgaggagacctcgtttgatcgttatcaggattgagtacccacgctcgagtatcgagatgtgctgccctttgtaaaacatccttgggtcagtgtggcttatgtgtattgtgtagtgggctgccttcagagatacctatacttgggtcgggaacatcatgtgtgtatttctagtgtaaggcaggctgccttgcagcatagctgaataacagagtgtacaatgtgtctcaacgttgtacaattatccatagatacaggcgtggtcgccaccaataaaaccctatctggcggaaggttttggcaaaaaaaaaaaaaaaaaaggccccta

SEQ ID NO: 60645 - DNA, 863 bp, Triticum aestivum
  unsure (1)..(863): unsure at all n locations
  Clone ID: PAT_TA_60645
ccggccggtccgggaaaaaaaaacttgtctgtcatatcattattgacatcttcaaaaacgccaagatgggtggagctccgactacagttggcacttatgatgctgcccttcaacgacgacaggcccttatgggtgccagtggtgccagagccctggtaaagaactggaaggttttccgaattgctgcgttcgcctgtattggaggtattctttatggttacaaccagggaatgttttcgggaattctcgtcatgaaatcttttgagagacatatgggcgattatgtccaaaacaagacgaaaaagggctggcttacatcgattcttgagcttggtgcttggctcggtaccttgatgtctggtgccattgccgagctgtgttctcgaaaatatggtattcttatcgccacaagtgtgttcattatcggtgttgtcattcagtgtactgctatgcaagctggacataacgccattctggccggtcgttttatcacgggtatgggagnttggtagtttgtcaaccattgtccctctgtacaactccgaatgtgctcctcctgaggtccgtggtgctcttgtagctcttcaacaacttgccatcaccttcggtatcatggtcagtttctggatcgactacggaactcacttcatcggtggtactggtgaaggtcaatccgacgcagcctggttgatccctgtctgccttcaactcggccccgccattgttctcttcatcggaattatgtggatgccatttttctcccgatggctcacacacacaacagagaagaaagagctcgtcaagtctggncaacctacgtgacctttcctacgacacgaacttatcgaacttgaattctcgaa

SEQ ID NO: 60646 - DNA, 837 bp, Triticum aestivum
  unsure (1)..(837): unsure at all n locations
  Clone ID: PAT_TA_60646
gccggccggtccggggctgcccgaaaggatgcggatacgcgaaacaacgagataagatcgttgcgccaccagaacagcaagagctcagaaatcattgctcaactcaaggatcttgaatcacaaaaccgcgtgcttctaggcaatctggagaaacagttgaccgatctgaagcaatcaaatgcttctctgatgacagagaacaagaagatggaagtaacaagtcttgacgctgtccgccgtaccgagtcgctcaacaagcaagtttctgatctatccaacttggtcaagtctaaagacgccgcatccgctgtggttcgcgagcgcaatgttatgcaagaaactgaggtcgaaaagatgaaggtgcgacttgagcatgcacagaaggatcgcgacaactggaagaacaaggccctgagtaattcttccgaggaagaggaaatgcttcgaacattcgctctatgcactatttgccgcaacaacttcaagaatacggccctcaagacatgcggccatttgttctgcaaccaatgtgtcgacgatcgcatcagcaatcgcatgcgcaaatgtcctacgtgttcccgcgcctttgataagatggacgttatgcccgttcatcattgatcgcttcaaaggctctacggaaattacttagcttgccacctttctccacgatattttctgcgatacctctttcttcactaatagcttccgtcaagcattgctcatccgttctataccttttttcccagcattagagaccccgtcacttgtacatttcngncagatggcgttggctgcatgatctgaatagcanatcttgacgcttttcttctctct

SEQ ID NO: 60647 - DNA, 784 bp, Triticum aestivum
  Clone ID: PAT_TA_60647
gccggccgtttccgggctacactttcttactgaagtaagatcgctcgcggggtgagagcggacatcagtggggagtcgtacgatgtctggcaaggctgaagcaacggcccgcgggctagctctagaggccctggactattatattttgaaatacttatttcctttgtttaagacggagagagaggtgtagacacagattggggaggcgtacaatacacatacatagctagtttactgtacagtggtatcttaaaaaaaaaaaaaaaaaaaaaaaaaaaaaaaaaaaaaaaaaaaaaaggaaggcgagcagtttgccaaggagaatggtctcatctttatggaggcatctgcaaaaactgcacaaaatgtcgaggagggctttgtcaagactgctggagcaatatacaagaaaattcaggatggtgtctttgatgtatctaatgagtcctatggaatcaaagttggctatgcagttcctggccaagctggaggtgctggtgcctcgtcttcccaaggtggcagctgctgcggctaatggaacgatccatgatcagtgatgtacaaaatcgcatggcatctgttacaatacctgttgcattattttgagttgccgagtgattgtaactccagggtgctttgttatttcacgcgcctatggattatgttccagtgagctagtcaaaataggttcagttcatttccttaccttatactgtatacaatcactgtaatccatcagatgcttccagtcgggacgtgtcatttaggattcacgaattatatc

SEQ ID NO: 60648 - DNA, 739 bp, Triticum aestivum
  Clone ID: PAT_TA_60648
gccggccggtccggggacctcaaatcttccaagccgcctccatcaccaacgctccgtatctgatacttgccgtcgttgccgcattttattctcctccacagaactgcaaccatggccaactttcttgcttccattttcggtaccgagcttgacaaggtcaactgctctttctactttaaaatcggcgcttgtcgtcacggcgatcgctgctcgcgaaagcacgtcaagccttcctacagtcagaccatcctcatgccaaacctgtaccagaacccggcatacgaccccaagaaccgaatgaacccttctcagctccagaaccacttcgacgctttctacgaggatatttggtgtgaactttgcaagtacggcgagctcgaggagctcgttgtctgtgataacaacaatgatcatttaatcggcaacgtttacgctcgctttaaatacgaagaatcagcccaaaaggcttgcgacgagctcaacagccggtggtacgctgctcgccctatatactgtgaactgagtcctgtcaccgatttccgcgaggcctgttgtcgactgaacttaggtgaaggctgtgttcgaggaggattctgcaacttcatccatcgcaagaacccaagcgaagagctcgatcgcgaccttaccctcagcacaaagaagtggctcaagcagcgcggccgcgacgagagaagtgcctcgcgttcacctacacccgagcctacgagacgccgctact

SEQ ID NO: 60649 - DNA, 796 bp, Triticum aestivum
  unsure (1)..(796): unsure at all n locations
  Clone ID: PAT_TA_60649
gccggccggttcagaccgcctcaagtgatcctccttctcctccctcttcttcttttagtccctctcttctcctccaacctttcctccatcctcaacccatcccatcatcaccttcaaaatgctgtccaccctccgagtcgccagccgccgggctgcccgccctgcccagtacaacctggctgccattcgcgctgcctccaactgggccaacgtccctcaaggtcctcctgatgccattcttggtatcactgaagccttcaaggccgacaagttcgacaagaaaacaacctgggtgttggtgcctaccgtgacgatgctggcaagccctacgtgctcccttccgttcgtgaggccgagatgaaggtcgtcgagtccaagttgaacaaggagtacgccggcatcactggtgttcctgagttccctcccgccgccgccaagctggcctacggcgccaacagccccgccctggatcgcatcaccatcacccagaccatctctggtaccggtgctctccgtgtcggtgccgctttcctcgccaagttcttccctggcgaaaagaagatctacatcccccagccttcgtgggcaaaccacaaggccgtcttcaaccacgccgggcctcgaggttgagcagtaccgctactacgacaagaagaccatcggcccttgacttcgagggcttgattgctgatgtcaagtctgcccccaacggcagtgtcttcctttttcacgcctgtgctcacaaccccactggtgttgaccctacccagnagcagtggaagcagatctctgacgt

SEQ ID NO: 60650 - DNA, 816 bp, Triticum aestivum
  Clone ID: PAT_TA_60650
gccggccggtccgggaacacgccgtcgatcgccacaaaagtgccctcagccgcggcgcgtcgtcgtcgctggggagccccaggtcgccgccgccatcctatgggagcatcgtcactgtgctgagtatcgagggcggtggtgtgcgcgggatcatccccggcaccatccttgccttcctcgaggagaagctccaggagctcgacgggcccgaggcgaggatctcggactacttcgacgtgatcgccgggacaagcacgggagggctggtgaccgccatgctcagcgcgcccgatgacgcaggccgcccgctcttcgccgccaaggacatcaacaagttctacctcgaccactgcccgagtatcttccctcaagccagcaaagggccattcggcttgatgaggagcatgatgggaccaaggtacaacggcgagtacctccacacggtcgtcaagaagctccttggtgacacgcgggtcggcgatacgctgaataacgtcgtcattcagaccttcgacatcaaactactgcagcccacaatcttctcgacttacaacaccatgatggataaatcgaagaacgctcttctatcggacgtctgcatcagcacgtccgctgcgccgacctacctccccggccaccactttcagacagagggcgaggacggcacgccccggcagttcaacctcatcgacggtggcgtcgctgcaaacaatccgaccttgctagcaatgatggacgtaagcaagcagatcctgatggggaaccccgacttcttccccatcagcccgcggactatggcaagttcatgatcctttc

SEQ ID NO: 60651 - DNA, 642 bp, Triticum aestivum
  Clone ID: PAT_TA_60651
gccggccttttccgaatgacagagcagccgcgcccgattaaaccacagctcgcagccatcggacgtcgccgtccgtgcgaagtgccgccgcccgaacctcccaccacagcacgccgcaatggaggccgaccgcccatggcatcgcccgagctcacctcccagcagtcattctcctttgaattcgtcgggatccggctggatccggacgccagcgccccgttcctacctccccacctcgcttgggtcgtcggccagctcgacgatgtcagactgctcgcgggatccagcccaccgctggctggccacttcctcctggaggagacgcccccacatcggcgcctccccatatgagcagcagcggcgaacgcctcgctaagggcatctctggtggtgttttttataaattgttttaaagaagtttgccagatctgtgactgaaaaacaatggcgttgaactccgattgacgtcccgcgaaggctggcggcgcttgatgtggtggctggagaatatctctgggcaaaacagtaggccagatctagggggaaaaaatctgtaattccaagtttttggttgtgtatttcttccttttggtaaaaataaaatttagttatctagcaaaaaaaaaaaaaaaaaggccccta

SEQ ID NO: 60652 - DNA, 668 bp, Triticum aestivum
  unsure (1)..(668): unsure at all n locations
  Clone ID: PAT_TA_60652
tcgaggccggccggtccgggttagaagaagaggaatttgcatcatcaccaagaaagacaagaaagagagacaaggaaagggcggaggctgctgcaggcgtccctgtggtgaagccccttggtggtgtgggccggcggaggtgctgcggttaggattcggagccgtcctgcatctgggcgctcgcgccgccatggccggtgggcttggtcttggatctggccgctgtcctgccttgtcgaacagagggaagggccgtccatggcgatggtctccttccattgtgatggcctggctgcagaaaatccagaagaaaaagaagaggggaggaggatggagggcgtacctctggcgtctaggtgctgcagcccgtcgccggcgtcgagggccaccacatcccatccatccatgggtgggtgtggggctagggttctgcccccatccgtccatccantccatgggtcgggtcggaccttcatggccgacctcgaggacatccatgggtgtaggacatcccgccggtgccgctttggattgttagactatgtatagcttctgtacctatgtacgtatatggtacatattgtaacacaaccattatatataatgagataagccacccccctagagggtgtgctggttccccaaaaaaaaaaaaaaaaaagccccta

SEQ ID NO: 60653 - DNA, 474 bp, Triticum aestivum
  unsure (1)..(474): unsure at all n locations
  Clone ID: PAT_TA_60653
gccggccgttccgggnttaccgctactcaaggggcctcgctatgacatcgtttcgaaatcagccacctcggcatgtgtgcagagtttgactatcgcaacttgattgggaagctcgttatgagaggcaattttagtcgaaagttctaccctgcaaggaagaaccttttgaggtttgctggccgatccccagcaagcagatttatgtgtttgtcttacatgtctaacgcaacgagactgtttgcgattgcggctacatcttgctggatgccctgtttatgcacggcggtctgcacgttgtagtcagtgttgttacggcgcaaggttaaattatatatagctggaaaagctatcggagatgctgtatgttatttagtactgggtaatccgccatgaattaaactaaacagcctactatttgtttaccttggctggatcgggccaaacagagaaaaaaaaaaaaaaaaaaggccccta

SEQ ID NO: 60654 - DNA, 765 bp, Triticum aestivum
  unsure (1)..(765): unsure at all n locations
  Clone ID: PAT_TA_60654
gccggccgtttcgggatccattcttcctacttgtaccaagttctcacttttcacagaccaacagcacaacagagcatcgatcgaattacagattacagcggatcgttaaaacaagcagcaaatccatgggagtgggcatgaagcgcgcgagggaggaagagccagttgtgtcgctggcgctgtcgctcagcacagactccccggcgacgtccaccacgacgtcggagtcagacagttcgaccggtgcgccggcgatggtccccaggaagagggcgcggcgagggagagctgtggccacgtccggggagggggagttcgtgtgcaagacttgcgggcgtgccttcgagacgttccaggcgctcggcgggcaccggactagccacctgcgcggccgccatgggctggagctcggcgtcggcgtcgccagggccatcaagcagcggaagcggcaggaggaaaagcagcacgactgccacatctgcgggctgggcttcgagacgggccaggcgctgggcgggcacatgcggcggcaccgcgaggagatggcactcagcggcgccatggactggtgggttgcgctgtcggatcaagaggctgggcaccagcacgccgccgaccggccgccagtctttgctcgagctgtttgtctagttagctagctcgatctctctgcttgctaattcaggacttgtgcaaatcttcagcatggtacattaggtttatggtaattgtgttttcagaaaaaaaaaaaaaaaaggcccctan

SEQ ID NO: 60655 - DNA, 823 bp, Triticum aestivum
  unsure (1)..(823): unsure at all n locations
  Clone ID: PAT_TA_60655
gtgcggcgctcgaggcggccgtccgggaacatccagcttctagccgatcccaactacgtgagcgagccgatcatcgagcatatggcgtctgctcctcctccttgtgctgctccagcggttccccgcatgaagctgggctccgagggaatggaggtctcggcgcagggcctcggctgcatgggcatgtccgtcgcctacggcccccccaagcccgacgccgacatggtggccctcatccaccacgccgtcgccgccggagtcaccttcctcgacacctccgacgtctacggtccgcacaccaacgagaccctcctcggcaaggcgctgcagggcggcggcgtgagggacagggtggatctggccaccaagttcggcgccttcctttcagaggatgggtggaatgtccgcggggacccggcgtacgtgcgcgaggcgtgcgagggcagcctcaagcggctaggcgtcgattgcatcgatctctactgccagcaccgcgtcgacaccagggtgcccatcgaggtcacgattggtgagctcaagaaactagtccaagaaggaaagataaagtacatcggattatccgaagcatctgcatcaacaatcagaagggctcatgccgttcatcctatcacttcagttcagatcgaatgtcactatggagtagggacgtggaagaggacataattccaacttgcagggaacttggaattggaattgtatgttacagcccacttgggtagagggggtcttctctgtangatcgaaattggctgactcactatcagacgacgactttccgtaaggntttacctagatttcagcc

SEQ ID NO: 60656 - DNA, 842 bp, Triticum aestivum
  unsure (1)..(842): unsure at all n locations
  Clone ID: PAT_TA_60656
gccggccgttccggactacatatctaccgcaacccttccggctgtcgccttcgcatctcttttctcgtcatgttggcttcagctcgctcgcccgcctttaggaacagcttccgtcagtttaccaagatacgcgccgcgcagactctcagcatggctcccaccaagcgagccaacagttcctcatcctcttcaagctatgtcgagaaccactcaaagggaccaatgctgcgatggcaggactctcttccacgattgcccgtgccgacactcgaggagacagccagccgttatctgaagacgcttcaccctctcctgtctactagcgagtacgaggccagcaagaaagccgttgacgagtttgtgcgtcccggcggcgtcggatcaaagctgcaagaaaagctcgtggccaagcgtgaggatccaaagacgaagaactggatctatgagtggtggaatgatgccgcctacctctcctaccgcgatccagttgttccttacgttagctacttctattcccaccgagacgaccgccgaagacgagacccagccaagcgcgccgctgcgattacaacatcagtccttgagttcaagaagcaggtcgacgccggtactcttgagccagagtacatgaagaagctgcccatttgcatggacagctaccagtggatgttcaatgcctctcgagttgcagccaagcccgccgatcatcctgtcaagttctcagccgaggagaacaagcacattgttgttattcgcaagaacccagttctcagattcagcacgagatcgacggaaagcagctcaacacatcagagcttgagcacagnntcagcacatctatg

SEQ ID NO: 60657 - DNA, 641 bp, Triticum aestivum
  unsure (1)..(641): unsure at all n locations
  Clone ID: PAT_TA_60657
gccggccggttcgggnccattgctcactgcacttctgactcttcccgatgaaggccgtgagtggggtcggttctctatcatcaccctcatttcgggatacccctactttcaccctctggtatcttcttggatttcagagaattcttttgatgtaaaaaagcgagcagttgcttcgagcacatacaacgttattgtacagatgggaagcgttacctcgagtcaaatctaccgaaaatgggatggaccctactacaagaccggaaacaaggttttgatctcgattctgtgtctttctgttgttgtgtttattgctcaaaggcaatggcttgtgtacctgaacaagaagaagaccgagttatgggagcagatgactccagagcagaaagtcgagtaccagacggacaaggagcagcgagagattgacggaaacaagcgacttgatttccgatttgcttattgattaatttgaggggggataatatgaggtagtaattatatgccgaggtctatactctgtatcgaaaaggcagttagctatctgtggataaattgaatagatggcctaaagctttagggtacagaaatgaacaacctaagatgtctgatctaagcaggaaaaaaaaaaaaaaaaaaggccccta

SEQ ID NO: 60658 - DNA, 854 bp, Triticum aestivum
  unsure (1)..(854): unsure at all n locations
  Clone ID: PAT_TA_60658
gccggccgttccgggacctttctaccagacactcaacccctggtgcttcagtctgggtgactctgccactctaataatcacttcatcccgttcgcgttcccgtctctcaaatgggtctttttcgacctcctaaacggacccaaacggtcttgcctgacaagcccaccaagggtcacttcttcttcgcgggcaaggaattccagcgtcttcaatggtggaagagacgtaacatgcgcactctgtatttttatattgttattctgattctaacaaacaccgcaaatggattcgatggttccatgatgaacggtcttcagaccttatcctactggcaagaatatttcaaccaccctcgtggttctgtccttggcctcttcaatgcttccatgagtcttggctcccttatcggtcttttctgtgttccttatatgattgatcgtctcggccgaaagatgggtgtcattattggttgcctcgtcatgcttctcgccgttggtttacagtctggtgctcgcaactttggcatgtttgtcgcagctcgtcttctgctcggattcggcgactgtattgtccttggctcagcccctcttctcatcgccgagattgcacaccctcaggaccgtgctatccttgtcaccctcagtggcgcttcttaccactcaggtgctttcatctccagttgngtcacctacggtactctccggatcaagagcgactggtcgtggagactacccagccttcntcagtcaatttgcagtgtcgtcattcttggtggaattttctggatgcagaaagnccacgttggttgctcagcaagatcnngcatgatgagcactcaagtgcttactcactac

SEQ ID NO: 60659 - DNA, 858 bp, Triticum aestivum
  unsure (1)..(858): unsure at all n locations
  Clone ID: PAT_TA_60659
gccggccgggtcgggctgtccttctcctccttcttcctctccttggcttcatcccagcatccatctattctggtgcttaatcgtttcctcgtagacttcttacacttgtcattgtgaacgaattcagatacatacaatgtcttctctaccgtccaacgtccatgtctctcagcacccctgtctcgtggccaagctgagccaacttcgctcaaagtccatcagccctagagaagtcaagtctttgattcatgaggtttctttgattgtctcttgtgaagcctttgcttcatctctgaaagctacagaagggtcccaggatgagacacctttgggctttcaattcaagtctacaacagtttcgccaagcaccatgtgtctagtaccaattctgcgttcaggccttggcatggttgatgctgtgcaaactatgctccctgtagcagtcccagttcaccacttgggcatgtatcgtgagccttcaactctcgacccagtcgagtactacaataatcttcctcagcaatcttccagcgaaaaggctagcagcctcgctatcttggtcgaccctgtcattgcaaccggaggaacctgtgccgccgctatccaaacgcttcgcgaatggggcgcagaacgaattcttgtcctctctgtcattggagctaangagggtgttcagcgagttgcggctgagtggcccgagggatgtgaagtctggatcgcaggagtggacaatgagctaaccagcgatggtatgttgaagcccgnnttnnggnagatgtgntgacnagctgntcttgaccattggtaaatgagtatgcgtcagcgactttctatttcgatggctttgattcccattgc

SEQ ID NO: 60660 - DNA, 805 bp, Triticum aestivum
  unsure (1)..(805): unsure at all n locations
  Clone ID: PAT_TA_60660
gctcgaggccggccggttcgggncctttctgcgattactgccagagatagctgtcaaaatgcttccttcatttcttctctcatcgttgctgtgcctttccacagtctcagctctccccaacccaattctggcggagcgtgcagcctgtgactgcaccggcacacgtgatggtggttccaactccaaggaatacatctgtcgtgacgctcgacttggccctttaaaattgcccagaaaactgcctttgagcacctttgtcgaaagctacaatcgtttcgggggtctgacaccagcccagttcctgttgacatggaccgatgagaagggaagctacagataccctccacagaatggtttccaacttgatgctcaaggcaatgcaatcaatggaagcatgattcttcctgttggaacaatggtagaccgatttggaagcgaatacggatcattcatctctgcggctgctgctccctactcacagagagcgcttcccccatcaaatctggccacaaaccctgatactcctgacttcccatacaactaccacgtgtatcgtgtgatcaagccgcttccagtagtcggagggcccattgcgccgtggttcggtcagcctggtctcggagcacagttcttcacgggggagttgggaaatatcaagttcttgcttgaacagagctacatccangncggaggatcccaagactctcgtgcacaagtctgatggttgcgcataatgcctngagtttcaagtgcgagtttatggtagatgaccttacngagaacgtgggtttgatttgatcacatt

SEQ ID NO: 60661 - DNA, 876 bp, Triticum aestivum
  unsure (1)..(876): unsure at all n locations
  Clone ID: PAT_TA_60661
ccggccggttcgggatggtgtacgaggaggacgagagcgcaaccgcatgaaggagttcatcacgaacaagagacttatgctttcacttgcagatgcaggtggtcgcatgatgtactcgatcaaggacttgtcagaattggctggatataccagccgcgtgtacacactcatctcgacactgcatcgggtaaacgccgatgcttatcaggttcgagctggacagagcgaactgtactctctgtctgatgtctcaggaactatccagaagggatttgacggcgttcgattcgagcatgtaccagttgccgctcctggcctgtggcctcaggggggcgaggaattgctcgaatcattgtctattattgtgcgaaggggcgaacatctactcatctctgggccaaatggagtgggcaaaaccgcaatttcaagaatcatcgctggcttgtggccggtctaccgaggactggtcagtcgcccgaaggatattggtcaagatggcatcatgttccttcctcagcgaccctacttgagcccaggaaccctacgtgaccaagttatctaccctgatggccatgttgatatgaaggagaagcgcaaatccgaggatgatcttattaaagttcttgaagctgcgcgactgggttacctacctgaccgagagggtggatgggacanctcgaaagagtggaaggacattctcagtggaggtgagaagcagcgcatgggctttgctcgcctactctaccacgagcctncatatgctatttgtggacgaaggggtacagcgccgtgtcnaggtgggacgtgagggcttgctgtacgagacatgcaaagagaagggcatcacacttattactatnctcactcgagcatctc

SEQ ID NO: 60662 - DNA, 795 bp, Triticum aestivum
  unsure (1)..(795): unsure at all n locations
  Clone ID: PAT_TA_60662
gccggccgttccgggattgcttcacccagacggccgaaggattgccaattgcctacgccatcaatatgatctcgagatcgacccttgcgcgaaccgcgcagcaggctgcccgccagtcctgccgcgtccagcgacgaacatacgccgccgctgcttcgaccggatcatacgagacctcggatgcgtctggcctcaagattgcctcgcgggatgcccacggccctaccaccaagctcgctgttgtagccaaggccggtactcgataccagcctctacccggcctcactgctggccttgccgagtttgccttcaagaacacccagcgacgatctgctcttcgcatcactcgcgagtctgagctccttggtggtcaattggcttcttcccactccagggaggctgttgttgtcgaggctaacttcctccgtgaggatctgccttacttcaccgagctgctcgctgaggtcatctccatgaccaagtacaccacccacgagttccacgaggatgtcgagcgtgttcttcaccacaagcaggccgccctcaacgccgacgtagccgccactgctcttgacaacgcccacgccatcgctttccactcaggtctcggttcctccatcctccccagctcatcaactccctaccagaagtacatgaacgaggagtacattgccagcctacgccgatgtcgcttatgccaagtccaatatcgccctcgtcgncgacggtgcctctggcgatagctctcccagtgggttgggcatttcttcacgatgtgccctcgncccccgaaac

SEQ ID NO: 60663 - DNA, 643 bp, Triticum aestivum
  unsure (1)..(643): unsure at all n locations
  Clone ID: PAT_TA_60663
tcgaggccggcctggccgggaacttcacaccaacctcgatttcttaacaccaacataaacaaaatgtcccgccttttaacccgccgctacacaccctccagcctccgggttcccataaccccccggctctcatcaacattccaatcccgccccggtcccccaaagctccccgccgaagaacaagccgaattcgagcgtctacagcgcgcagcgtctgtatcatctgctttccagcccacagagaaaacagcagaggtcacgggagctacacctgctacttcacaaattaagcatacaactacacctgagaaaaagacagatgatgatatgaacgtgggctacttccggggtgcgcctccagaatttgagggcgatgtgaatcccaagactggagaggttggagggcccaagaatgatcctcttcgatggggcggggagagcgattggtcttacaatggacgagcgacggatttttaagacaaaatcacggacaacaagcctcggtggcgacacagacggcaacaaaattgtacaaaactgtatcatatccaacttatagacaaggcatacgccttttattaaacttgttatatcataacctgaaaggnggtatttctgaaaaaaaaaaaaaaaaaggccccta

SEQ ID NO: 60664 - DNA, 868 bp, Triticum aestivum
  unsure (1)..(868): unsure at all n locations
  Clone ID: PAT_TA_60664
gccggccgtgccgggacgcctttgcctcctcacgcgagcactcacatgggagatgcctggcgctccaccccaagaagcagcagcacccgagcgctactctacctcatgacccgccgcccaggctcgcctcccgcaaccttccccagaggcaatcgcctcctccgcggatccctgccgcctcctgaacgcccgggctcccgtcccgctcctcctcgcctcgtcatcgaccggcctcgccgtagaccgcgaccaccaggccaagcctcgtcatcccttgcctccccctcgccatccctcttctcccatcattaatctcttcctgcctctccctgtgttcttcatgcagaagctccaacgccgcctcatcgtgtcgtcgcctgcttcaccctggattcaggcgcccatcgccggaggccgtcatcccgcgcctggatccgcgcacctccattccctgcgccgccatgtccatcgttcgtgccgcgttggtcttctgttccaagagccacgttgaccgcagccgccgattccctctgtcccgctcgcctcgccaggagctcccctagccaggcccagatctgcggaccgaggcggcccagctccctcctccaccaacgggccgaagcccatggcttcgatttcgttccggagttgtgaggattcgttcgactacgtctgtttgtcttcttcatggactcgttcttcttccttgcgngatctcaggtacaaccaagtaagattcaggtgatggccaggaactcaagtgggagttcgatgcggaacgtaggcgaatgtacgtgtcatatcccgacgatcattagtggttcctaccagagcgatcgcgcatagnggggggggtatcttcttttca

SEQ ID NO: 60665 - DNA, 480 bp, Triticum aestivum
  Clone ID: PAT_TA_60665
gccggccgtttcgggaactcatactgtcacctgttacttacatctcaaactactgcctacaagatcaacctacgatactgaatctctgataaggtcatctgccccaaaacgacatgtatgatgcggagagagacttctgtaaagtccacagcgcgtatagggaagaaaccatgcatcttatagaagacgaatgccaagaactggggcttcttacacgtgaagaaccgcgcgatcacgctagaaggtccttgaccgtgtcaataagaagcgctacgagagctatcgactccaggtagtggagaacaagtggccctaacactgtgcataccttctatcagggtggcgtatcgtgaacggtaccgtcgaggcgaagaagacggagcaaaacatgatctgccaggacatctactatctctataatcacaaccactgcccatacgacaagccagacttcaacgataccatgccacgagtaccgcg

SEQ ID NO: 60666 - DNA, 242 bp, Triticum aestivum
  unsure (1)..(242): unsure at all n locations
  Clone ID: PAT_TA_60666
ccctgactattttttcttggnacaatgagtctcttgcttagcagaccaataccctctaagctactgtccttgttcgccgccagactatgaccttcgatccaaaataccttaaccaggacttttgtcaacccacaatcaagaaccatcctactcaaggagatccaaacgccactggctccgagatcgagactcaccaattcccggatttccgcggtactgtcactcgttacaaaggcgaacat

SEQ ID NO: 60667 - DNA, 655 bp, Triticum aestivum
  Clone ID: PAT_TA_60667
gccggccggtccgagatagcacccgcacaaaccacgagctcctcaggaagagctaattatcgcattgcatccgatcaccactccattcctagcttactagctagatgatcctaacggcgagcaccaccgctctctcctgcctggccgcgctcctgctcctcgcggccgccgcgtcgcccgcgccgcctgcgcaggacacccgggtgcgggcgtactggtaccacgccgggagcggcgggcctaacgcgagggtgctgccgggggggcacgtgccgctctcctacgccgccgccatgggatttggtactgtgctcgctatcgaggactccgctctccgaggtctccaacctgaatccgaggctcctcggccgcgcgcaacgcatgcacatcatcgcgcggcaaagacaggctgtcgctgctcatggccatgaacttctgcttcttcgacgaagcctacaacgtacagcataatcgtcatcattgggcccaatcagagggagcgcgccgtcatggagatgtccgatctgcttaccaccggctgtcttgcgattcgcgcgcaggctactgccagtggcggacccactgcgtcgacactcagaccggcgacgccaccgtcgagtgctagatacatctccgtgacgactgaggcattgtc

SEQ ID NO: 60668 - DNA, 753 bp, Triticum aestivum
  unsure (1)..(753): unsure at all n locations
  Clone ID: PAT_TA_60668
gccggccgggttcgggaaatccaacgaagtctattctcggtgaacctaacaagctgcatctcgaaggcactgccaagggtccctttaactctcacaacccctacattgcccctattgccgagtcatacgagctcttctctgccaaggacaggaactgccttcacatggaagtcgacatcagcggttctaacctcaaatacgaaactggtgatcacattgctatctggcccacaaatcctggtgaggaggttaaccgtttcttggatattctcgatctctccggcaagcagcacagcgtcatcaccgttaaggctcttgagcctaccgccaaggttcccttccctaaccctacgacctacgatgccattctgcgataccatctcgagatctgcgctcctgtttcccgtcaattcgtttctactctcgctgctttcgctcccaacgactctatcaaggctgagatgaaccgtctcggtagcgataaggactacttccacgagaagaccggccctcactactacaatattgctcgtttcctctccagtgttagcaagggtgaaaagtggaccacgattcccttctccgccttcatcgagggtctcaccaagctccagccccgctattactccatctcctcctcttctctggttcagcctaagaagatttccatcaccgccgtcgtcgagtcccagcanattcctggncgagatgaccctttccgcggcgtcgctaccaactatctctttgccctga

SEQ ID NO: 60669 - DNA, 805 bp, Triticum aestivum
  unsure (1)..(805): unsure at all n locations
  Clone ID: PAT_TA_60669
gccggccgggccggggttacaggaggagtccctaggcatttccagttgagacatcagccattgccgagatctacaggcgtccttactacataattaagcacggccccgcgcaactaattacgccatcatgtcggacaacgtcgacaaggagaccactcctgagatcgactcccctatcacaaaggtcgagatcacaccaaccaagattgagatcgaaaaggcgcccgaggttcccgccatccctcagaacgacaatgtcgcccacgctcttgctggcgctggaggtggtctcttgtccatgatcctgacctaccctctcatcaccctctctacacgcgcccaggtcgagtccaagaaggccgagagcaagttcagcgaggctgttggcaacatcatcgcccgtgagggtatctctggtctgtactccggcattaactcggccctcttcggtatcagcattaccaactttgtttactactactggtacgaatggacccgcggtttcttcgagaaggccgctgccaaggctggtcgcgctggatccaagctcactaccgttgagtcgatgatcgccggtgccattgctggctccgctaccgttatcatcaccaaccccatttgggttgtcaacacccgagtcaccacccgccagcaggagaagaagaaggatgtcgaggncggcgagtcttcccagcctgccaaggctcccagcaccatcggcactctgctgctactccctcagaacgagggtcctcaggctctcttcgncggtgtcatcccggctcttgtgctcgtcatcaaccca

SEQ ID NO: 60670 - DNA, 727 bp, Triticum aestivum
  unsure (1)..(727): unsure at all n locations
  Clone ID: PAT_TA_60670
ggccggctcgaggcccggccgttgcccgggaaaaaaaaaaaaaaaaaaaaaaaaaaaaaaaaatctcccatacttggctcggggggcggtagagcctgcgtatgctcaatcgcggagagcctgccttgattctgcacgaatggtcatccaagcagaaacacaaatggaggaggaagacacgatgttcaaagcgacgaggcttcggctatgtttggccttgcacagcgtcttcatcgccagtatagttctactgctagacttctgccttggcgttgatgccgacgagaaagagcagaggcggcaggacttggctgaagcatggaatattctggagacagcaaaggaacactcgaggcccacagcacgtattcaggaccttctgagacaggtgatgaagaaacacaaggtgtctttacccgtggtcaaagcaaaggaacggcatcacccaaggccagtgggtaaaaccctcccacctacacctaattcttcaacggcaatcatgtcaacgggaacaacgcccagtgacgtaggagtttcttcttctcaggagttgaatgatctgggattcaacatggacttggacggaatggactgggaaagcctcctctggggcttggaagctcccatgttctaagcaattggcatagaatatcataggtaggcgtttcattcagagagacctttttaggcttggtctccccgaaaaaaaaaaaaaanaaagccccta

SEQ ID NO: 60671 - DNA, 846 bp, Triticum aestivum
  unsure (1)..(846): unsure at all n locations
  Clone ID: PAT_TA_60671
gccggccgttccggggtagataatcccgcacattttgactttttttaagggacaaagaccactaccgctgagcaacccgatatgctgtcatgttaggctcttcatctactttcgtcctccttctcataacttggctgtgccttgttattcaattaggtagtgctgctgaagaggcgaaacacggactgggacagaagctacaccaattaacaaacccagactcgtcggaacactgtgttgatattgtcgcggttcatgggctcgatggacactggaagagatcctggactgccaccaataatgcgttttggcttcaagatctcctgccagtagaaattccttgtgcgcgaatcttttcttacagtcatgattcgagaacgcgtggaagtgagacaccgcttgattgggatatctctgaccatgcgacggcacttctgactactttaagtactgagcgccgcttgactcagactgaaaggaatccaatcttgtttatcgggcacagccttggaggaatcatcttgaaagctgctctactgaaggctgaattagcccgtgtcggtcatttggagcatttcaaggctattaaactgtcaacctatgcggtggtgtttctgggaacacctcatcaagggggtgaaggtatccctcttgttgaggtcctttgccgaatctcatctattgtcagccacacaaacacaaaaattctgagcaaaatggagcgaaactcagagtggctacnagggctacagtcagactacaatgctattagccaggatattgaaactatcttcttctatngaactctncagatggatatnagaaatgagaacttgcttgntagag

SEQ ID NO: 60672 - DNA, 141 bp, Triticum aestivum
  Clone ID: PAT_TA_60672
gccgtgccgggaacgaggtgctctaggaggccgaatgatggctgtgaatagaactgcgaggctcgccaccgtggccaactacgaccccaccatatttgacaagatcatcaaaaaatgagatacacttctacgtgtggacgt

SEQ ID NO: 60673 - DNA, 691 bp, Triticum aestivum
  unsure (1)..(691): unsure at all n locations
  Clone ID: PAT_TA_60673
gccggccgttccggaagagctatcgatcctccgcgagcgtataccgtcaagatgattcaattaaagacaatgcttaactgcatcgacaactcgggcgctgcccttgttgaatgcgtcttggtcgttggccaaaagcgacatgcccgaatcggtgaccgtgtcgttgttgtcgtccaggagcagcgtggtagctcctccggtggcatggccggtatgtctgccgccaacaaggtcaagcgaggtgacattcgtcacgccgtcgtcgtccgaacccgataccctacacagcgccccgacggatcaatcgtcaagtttgacgacaacgcctgtgttttgttgaacaaggctggtgaccccgtcggttcacgtatcaacggcgctgttggcgctgagctgaagcgcaagaagtggagcaagatcttgtcaatggctcccatgcaggcataaacacaacacaagtcaggttagggaagcaaggggacagaagaaattacaaccaaaactagggaaggggacggttggtgatttataaaagacaccatagactacgggagcgaggttggctgacaacagccgtgtacgggtggaatactgtacaattatgaatactatactcgggcatatgcgaggcgttgatgcgagaataaaaacacctttcagctcctanaaaaaaaaaaaaaaaaggccccta

SEQ ID NO: 60674 - DNA, 435 bp, Triticum aestivum
  Clone ID: PAT_TA_60674
gccggccggtccgagacgcagtgatgggaacgaaggcagttctactgagaagcagagatatcacagtagagcagggcctggagcatgtagcgacttggaactctggaatgctgagatctaatgacctgatggaggccatcaaagctttcatggagaagcggaagcctgttttctctaagctctgatgatcttcatcatgggcgaaaatttatatgtgaaccctagccacctgagaatgaaagtgagatggtagaatgtagacaagaaatagtacaatctatgaatttggaaaacaagtgctcttgttatctgtatcttgtatgcatatcatatcatatataaaagggaataaaacaaggattttatggtaaaaaaaaaaaaaaaaaaaaaaaaaaaaaaaaaaaaaaagaaaaaaaaaaaaaaaaaaggccccta

SEQ ID NO: 60675 - DNA, 724 bp, Triticum aestivum
  unsure (1)..(724): unsure at all n locations
  Clone ID: PAT_TA_60675
gccggccgggctcccgaaccaccgagcaatttgatantcattgttctctaccaaaactcgactatttttctcaaacgggttcttataaactcgcccacacaaatatggaatcagggccaactgaacttgcagccaccatccaggctgcaagcatcgagcacaatcccgatgccaaactcgacaccaacccgcgcacagccgctgataaaagacaacctatgactcttgagcaagacgacggtatcgatgaagatgatgacgaagaagaagatattccatacagtgttcttcgacctgctccacgacactccaacctccctcctctaccagacctacgcttcgagcagagctatctacgaagcatctccaaggccgatacatggtggaaggtggcactcataacgacaagggaccagatcttgatgcccttgacccaaggtctagcatacaacttgttcctctgcggctggcagcactggaacagaaatgcccaactacacggcaacacagtaggtgcgcgagtgagacgctggtggtggggagtcaacaactggcatatacccacgcatagaaagagggcttaaaagataaacattgtgtttgagatgaataggtagataggataggatacaacatccatgtcacgtattaattgcttgacctgacaacagcaaataaaaactctagtaattagaaagaaaaaaaaaaaaaaaaaggcccctaa

SEQ ID NO: 60676 - DNA, 740 bp, Triticum aestivum
  unsure (1)..(740): unsure at all n locations
  Clone ID: PAT_TA_60676
gccggccgggttccggaacagctagcaggcattcccgacccatccatcggtcacctcccacatctcatcttccaatcttagtcaggcactcgagctagcttcaacaatggcggcgggtgctcagaagctgcaagtgttggtggcttctgccctgctgctgctccttgctgtggggtgccaggccagccctctgcagatcgggttctaccacgacaggtgccccgaggcggaggccatcgtcaagggcgtcatgatggaggccatctcccagaaccccggcaatggcgccgccatgatccgcatgctcttccacgactgcttcgtcgagggttgtgatgcttcggtcctcctggacccgaccccgttcagcccgacgccagagaagctcagcccgcccaacaacccctccctgcgcggcttcgagctgatcgacaccatcaaggatgccctcgaggcggcctgcccagacgttgtctcatgcgccgacatcatcgccttttcggcccgcgacgcgtcctgcatcctcagcgccagcaaggtggacttcgaggtgccatccggccgccgcgacggcaccttctccaacgcctccgagccgctcaagttcctcgccccgcccgcatccaacctcagcgacctcgtggacagctttgtcgtcaagggccttgacgtggaggacctggtcatcctctctggagcgcacaccatcgggcgctcccactgctccgncttcgtgcccg

SEQ ID NO: 60677 - DNA, 850 bp, Triticum aestivum
  unsure (1)..(850): unsure at all n locations
  Clone ID: PAT_TA_60677
gccggccggtctcgagagccgagtgtctatctctcaattgtccatcatgacactctcacaagctgtactgcagctactctctgcgtcgctggctctcggccagatggtctacaatgaagttgagggccctacagaacgaccacaatgcaaaaccagagagacaaaagagccaacatatacacatacacccttcagttacacccttactgagactgtgagatacgctacctcggtgcctgcacctaccaccacaacaacgtacgccgacccgccagaatctctcatctctctcgtgccttcactgtcatttaccacatggggaaaatgggatcccaatgccaccaccaaagcctcagacacggatgacccctacggccaggctgcgtggactgctctctgggaacacgccaaccctcccaactttaccgagaaggccgtctatagcactaccgtctcgcccacccccattcctagcagcgagctcattcttccgccgcgagattactttggccctgaagactgctacaacttcccaaagaactttagctttggagtcgcaagctctgcgagccagatcgaaggcgctactgcagaggagggcaaatcgccgtctctcatggatattcttgttcgggatgatggtggaaaagattacgttacgaatgagcactattactactacaagcaagatattgagcgcgtcgctgccatgggcgcgaagcacttctcattcagtattgcgtggacgagaatcttgccctttgcactacccggtacacctgtgaatcangagggaattgatcattacaatgatgtaatcaacttcattcttgaaaaggaatgactcccg

SEQ ID NO: 60678 - DNA, 774 bp, Triticum aestivum
  unsure (1)..(774): unsure at all n locations
  Clone ID: PAT_TA_60678
gccggccggtccgggtctccaaccactacactcgctacagtcgttatcactctcgcttccctactctgcacttcactcgttaaaagtcagaccactccaaaacaaccctcaaaaaaacatccatcaaaatgtctttcttcaaggctgccgctgctgctggtctcctcattggagctgccaatgccactcctcactacgctgcctacggtaacggtactgagtacaccaccgaggtcgtgaccgccatcaccacctactgcccggctcctaccaccctcacctacggtgacaagacctacacagtcaccaaggagaccactctcaccatcaccgactgcccttgcaccatcagccaccctctcaagcccacaaagcctgtcatccccgttcctcccgttgtctacacaactgaggtcctcactgccatcaccacttactgccctgagcccaccactcttactcacggcaacaagacctacacagtcaccaagcccaccactctcaccatcaccgactgcccttgcacagtcaccaagcctcagactgagcactacccccagcctacccccggcaagcccggtcaccccggcaagcctgagattcccgctcctcaccctactgctcccgctcccggcaagcctgagtacccccagcccggtcaccccgaggctcctcacaccaccggccccgtccccgttaaccctaccggcagctctcctcctgagggcacaaccctgncgtcgtcactgctgctgccngncgcatcgcccctgc

SEQ ID NO: 60679 - DNA, 614 bp, Triticum aestivum
  Clone ID: PAT_TA_60679
gccggccgggtccgggttttactcgcagtgcctgtcttatgccttgattgagggtctgataaccgtgaccaattttatcccctaacatctacttcatctgagtcaacgatatccccctctaggtaggcagttcgcagagtccaatatagtcgctcttagccccatatctactgccactaattgcacaagcagctatcacaggcttcgcccagaccagtcccatcttagcgccgggagtatccccagatcgactcggagtacggatgtctaccgagaaaatctgaactctctagccatcccgtgcagttcccataattcagcagcaatcgatatttctttctcattcttcaaaacaggctgtcgttttctctgaggacacctcgggcaccccggtcttcttttacaggtagtcagcatagcacagcgcataatggatggaagaaaagagataggatctgcttgcttctcacccaagatatcgctagcatggagcttaccagaaatccatttgggcaccacttaaaaagctaggtaacatcggcgaatatcacattctgcatgtctctggctgcagacagtacatccagcaaaaaaaaaaaaaaaaaaggccccta

SEQ ID NO: 60680 - DNA, 788 bp, Triticum aestivum
  Clone ID: PAT_TA_60680
gccggccggttcgaaaatgtgcttgacctaaatttcagtttactcctcatatcctcgacaacatcatctatcatcgcgaacccttgtattaactttgcgccaaagtatcaaactttcgtgtccgagacccttcatctccattaactccactatctacttggaccccctctatcctctcgcctctttgtgtgctcgtgtgcgacgcgagagaaatagtcacgccatgacgcccgccttggaacacgaagatgccattgcgcaagatcctcaagcgccggcgcattcatcaaaccacaagcatcgcagaaccatgacatcgaccgacgagatagacagcaccattatccgacctggcagtgtcaaaatcaatgtcaagggcgcctttatcgtcgaccccgacactgcgacgccagcatcgacttcaggcgcaagcgctggtgctgtcaattcgatcaacggccgaatgagtccgacgcatcccgagacgagcgacattcgacttccatatcacactgccattgtgagccacattgcgattgacattggtggttcacttatcaaggtcgtctacttttcacgtgaggttgattccacagatcctggtggccggttgaactttcaaagcttcgagacggatcgcatcgatgactgtgtcgagtttatgcgccatttgcgcgataaccagcttgtgaatggctcgcaaccaggagagctatgtgtgatggctacaggtggtggcgcatacaagtattatgacaagattcgggcggctttggaagtagatgtgt

SEQ ID NO: 60681 - DNA, 769 bp, Triticum aestivum
  unsure (1)..(769): unsure at all n locations
  Clone ID: PAT_TA_60681
gccggccggttccaaaactccgtcatcgcttttcgcctctcaccaactcaactctgatctcgcatcatcatcacctacaaccaacacagaaaacacaatagttacattacaccgaacttcgacatatcaaccaccacaactcacatattcacatattcacaatgttcgctcgaggaatccgtgccgtctcccgaagagctgccatcgctgctcctcttgctcgccctaccattctccctgctacccgacagatcgcccccgccgttgccgtcaactcctcgcgctcttaccacgagaaggtcctcgaccactactcgcgaccccgaaatgttggctccatgaacaagaaggatgctgatgtcggtaccggtcttgtcggtgctcccgcctgtggcgatgtcatgaagcttcactgctccatgttggctgaggatgccatcaagtcagccatctccgactactacaccaagaaccccaacgccaaggtcagcaacctcagcggtactggcatgaagctccccgaggccgatgctcccgctgccgccactgcttaaatgtcaagtttgcgtcataaaatcttaccacacataaaataaaaccaacaaaaatcactcatggccattacgccatgtcacaaacgattgngaaattaggaaaatgataccctctttgaggcaggatggaagaagaagagcatctcgaaatatcaacgggatggcatctttggaggtgagactgtctaatgaatggaacgctaccgtctattcac

SEQ ID NO: 60682 - DNA, 883 bp, Triticum aestivum
  unsure (1)..(883): unsure at all n locations
  Clone ID: PAT_TA_60682
gccggccggttcgagatttcccatctctctctgcgccgtcccgtgctccctccgctagttctcccaattccttccccacctcctcggtcgtcgcctcccccagagagcaggagccgcctcgtccctgccggtcccgacccccatcccgtccgcgtccaacgccatgaatcccgagtacgactacctcttcaagctgctcctcatcggcgactccggtgttgggaagtcttgcctgctgctgaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaattgataggtatgccagtgaaaatgtgaacaagcttttggtggggaacaagtgtgacctggctgagaacagagtagtttcttacgaggctggcaaggcccttgctgatgacatcggaataccattccttgagactagtgccaaggatgcaacaaatgtggagaaggcattcatgaccatggcaggggagataaagaacaggatggcaagtcaaccagctgcaagtggtgctagtaggcctgcaactgtgcaaatgcggngtcagcctgtttctcagcaaagcagctgctgctcttgatcgtctgtctagatcacagtagtgtgattgtgcagcaagcaaaacttaaatttggntgctccctgtacattaagcctatttactgtccaaaaactcgatggtatctat

SEQ ID NO: 60683 - DNA, 673 bp, Triticum aestivum
  Clone ID: PAT_TA_60683
gccggccgggttccgagttataatttcataacaaaccgacctagctatacttttttcaaatcatcatcatgattatttacaaggatttccttactggcgacgagatgatgtcggactcatatcctatcaaagaagttgatgatgtcatcttcgaagttgactgcgatgcaatctatccagaatcggttgctggggatgatgaacccgttgaattcaacaacgtcatttactctttccgtctccagcctacgacatatgacaaaaagacttatgtgtcttctctgcgttgtacggtttccgttacacctagcaatgttgagtctggtctaatgtgggtctagcttatctcaagattgttaagaacaggcttaagaaaattggaaagaatcccgagtacattgccaatttcgagaaaaatgcgcaagatttcttgaagacaaagctacttcccaacttcgacgacttggaattttacaccggagaaagtatggacctcgatggaatgattgccgtaatgggatatcgggaggatggtaccacaccttatttcatgttctggaaggatggccttaaagagatgagaatttgaacataactaagtcagaatgcctaggcagaagatacggacggcgagatgctggtttggaacgcaacaatataaatatcttgatac

SEQ ID NO: 60684 - DNA, 863 bp, Triticum aestivum
  Clone ID: PAT_TA_60684
gccggccggtttccggaatacctactatcaagttcattgtcacacattcagatcatacgaccaaagaaaccatgtctcaaccctacggtgcaatctccaacggtgaaagcagagctgaaaacggcatttctactcaaaatgacgaaacgcagcctctgctcgcaccaaagccgggatctagatcttggttgcgcacgagattaggtgctgatgttcgtcgagattgggcggatgttatgcttctctcgtgttatatcataacaggcattctcgacagtgcttccatttccacgtggggtgctttcgtgtccatgcagacaggtaatacggtttatctcggtcttggtccaacggcggggacgaaccggtggaaaaagtctggaacctcgattctgtctttttgcatcggttcctttctgttcagccgtctgcatcgagccttcacgtctagcccaagacgcaaatgggtcttttgtttgtcttttggcattcagacagcgttcatcgtggcagcagcgtccattctgacatggggcccgaaaggcgctggtccagacgacgtgccctggtacgtgatcgtgccaatcgccctcgtggcctttcaaagctgcgggcaagccgtggcgagcagagcgctcaagttcaacgctctaaccagcgtcgtactcacgagcatctactgcgatctgttttcagatgcggggttgtttactgcttccaacgtggagaggaacaggcgtgtggctgcaccggtgcttcttctcatcggagccattattggaggaattattgccaagagcgaactgggaaattcaggagccttgtggattgccgctttgctcagttactcgtcatgtttggat

SEQ ID NO: 60685 - DNA, 711 bp, Triticum aestivum
  Clone ID: PAT_TA_60685
gccggcctgttcgggaatccgcaagcctgtggacgccagtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcgggagcgcgcaagccagcggagcatcacgtgccaggcggcgagcagcatccccgccgaccgcgtccccgacatggagaagcggaagctgatgaacctcctcctcctgggcgccatatcgctgcccaccgtcggcatggtcgtcccctacggcgccttcttcgtccccgccggctccgggaacggcggcggcgggacctacgccaaggacaagctgggcaacgacatcacggtggaggagtggctcaacacgcacggtcccaacgaccgcacgctcgcgcaggggctcaagggtgaccccacgtacctggtggtggagcaggacaagacgctggccacctacgggatcaacgccgtgtgcacccacctcggctgcgtcgtgccgtggaacggcgccgagaacaagttcatctgcccctgccatggatcccagtacaacaaccagggcaaggtggtccgcggaccggcgcctctgtcgctggctctggttcacgccgacgtcgacgacggcaaggtcctctt

SEQ ID NO: 60686 - DNA, 817 bp, Triticum aestivum
  unsure (1)..(817): unsure at all n locations
  Clone ID: PAT_TA_60686
gccggccgggtccagactttttaacccaaccaagtcaaacagaaaaattgcccaccatgtcgtcggagaacaaggaagtcgattactctctggctaacccagataccctcactaagtacaagaccgctgctcagatctctgagaaggttcttgccgaggtttccaagctcgtcgttcctggagccaaaattgtcgatatctgccagcagggagacaagctcatcgaggaagagatctccaaggtctaccgaggaaagaagatcaacaagggtttctctcaccccaccaccgtctccccttcgtcctacgtcaccccctacactcctctcacatccgacgaggctgaggccggcgccgagatcaaggatggcgaggctatcaagatccagcttggtgcccaaatcgatggtttcggttccatcgtctgtgacaccatcatcgccacccccgaagacaaggctggcgacaagatcactggccgcactgccgatctgatccttgccaactactacatcaacgaggtcctcctgcgattgatgatcccccctggcactctggcccaaggctccgacgaggagaaggccaaggctgctgcccagaaagcccctacacaggccaagatcaccagccttctcgagaaggttgccaagacatacgaggtcaacatcgtcgagagcaccacctcgtggctcttcgaccacaatgagatcgaaggcagcaagaagattgtcctttcccctgcagagggcaccaagggcgagggtgtccctngaattggtgaggtttggggtgttgaggtcggcgtcagcctgggctc

SEQ ID NO: 60687 - DNA, 775 bp, Triticum aestivum
  unsure (1)..(775): unsure at all n locations
  Clone ID: PAT_TA_60687
gccggcaggtccggaaagaaccatccagaaacaagacatctcctcgcaagattgtgctctggttagtcttgttcctacctttctctttcatccaacaacgccaatcggaccaaagttcatccaacatggttctcatcaagagcttcgtgctcggcgccctcgccgccaccgttgcagctaaatccgccgtcatcgaactgctcccctccaactttgacgacatcgttctcaagtccggcaagcctaccctcgtcgaattcttcgccccatggtgtggccattgtaagaagcttgctcccgtctgggaggatcttgcaaacacctacgagtctgccaagggcaaggtccagattgcaaaggtcgacgccgacgcccatcgtgagctcggcaagcgattcggaattcagggtttccctactctcaagttctttgatggaaagagtgcaaagcccgaggagtacaagtccggccgtgacctggagagcttgaccactttcattgctgagaagactggtgtcaagtccaagaagaagcttgagatgcccagcgaggttacctacctcaatgatgctaccttctccaagaccgttggcagtgacaagcacattcttgttgcctttactgctccctggtgtggacactgcaagactctcgcccctacctgngaggacctcgctgccacattcgccaatgacaagaacgtcgtcatcgccaaggtcgatgctgaagctccaacagcaagggcaccgccgagcagcagggtgtcaagtcctac

SEQ ID NO: 60688 - DNA, 628 bp, Triticum aestivum
  Clone ID: PAT_TA_60688
tcgatctcttggtgcaacttttgatctttatcaccgacggatcaaattagattatccacagacaaactacttctccggcctaagctcagtacacagcaataggaggtcaatgtgctaaggtctatgctcgccaagcctgctgacactgacggatatgcggctatgccgtacagcgaatacatcccgtgctgtccatgttcgacaggtcgacctataatatgcagaatgacatcatctacgtgttcgcgccaccagcgcccaccacgtgctccatcgataagggtcttgacatgaacctcctccaataccgtgccttcttcggcaagttcggtaagacccccgacggcacgacgtatgtcatactcaacgaccggggcgcgcggctggttgaagggaccgtggacgccgacctactctgacatgagccctcgaaacccactgcgagatctgctgaatctgcatcctgacctgcaggagtagcaccaataggtgatgcttctgcagatgaacacggatacggtgctgatcgctcgcacaatgtttcacgtccaaccactattacagacgagcggcatgccaccagcaacttcctcatagcctgtatgcgcgccacgacagggatccccat

SEQ ID NO: 60689 - DNA, 774 bp, Triticum aestivum
  Clone ID: PAT_TA_60689
gccggccgggtcgggatctttagacacttttcattcttgagccgcaatttggccttgaaaaatccgcggctatttgcttccttttcttcttttctatctttccagcagccaacaacgcactgtttgcgaactactcaattagcattattaagcttcggcttctaactcgccacctccgactcaccatcaatcaaacataaccacaacttcataaacgttttcataccacaacagccatggcaccgtctcttgaaacaccggagtccatcgacgacgttttcgccaacccaatcaagcagaagccacaacttgtcgcgccagaacctcaaaactgtgttggccccgactcacagcaggccggtaaagcggactcatgcgccggatgtccgaaccaggctatttgtgcttcagcaccaaagggtccggatcctgatattccagtaatctccgcgcgattggagaatgtcaagcacaagatcctagtgctcagtggaaagggtggcgtgggcaagagcacatttacctcattgttagcccacgcgtttgcgacaaatccggacagcaatgtaggtatcatggatactgacatctgcggacccagcattcccaagatgatgggtgtcgagggagagacggttcatgtcagcggtacaggatggtcacctatctgggttatggacaaccttgccgttatgagcattcagtttctactaccgaaccggggacgacgcccgtaatctggcggggccccaagaagaacggtcttatcaaaca

SEQ ID NO: 60690 - DNA, 858 bp, Triticum aestivum
  unsure (1)..(858): unsure at all n locations
  Clone ID: PAT_TA_60690
gtgcggcgctcaggcggcgggtcggaatttctcgtcctcacgagcctcacatcgccctcccctcccccgcggttatatctctaatacaaataataaaacatggatcacggacgagacccctgcccctatgtcattctcaatgactttggcggtgctttctgcatgggtgccatcggtggtactatctggcacggtatcaagggtttccgcaactctccctacggcgagcgacgcattggcgccatcacagccattaagatgcgcgctccagttctaggtggtaacttcggtgtttggggtggtcttttctcgacattcgactgcgccgttaagggcgtgcgccagaaggaggacccttacaacgccatcattgccggcttcttcaccggcggttctctcgccattcgaggtggttacaaggctgcacggaacggtgccatcggttgtgccgttcttctcgccgtcatcgagggtgtcggtatcggtttctccaaaatgcttgccggcagcactaagctagaagctcctcagcctcctccccaggaagccactctgtgaaccaagttttgacgaaatgaaccatcacgatcgatcaacggtgatacaacgaaacaatcttcgactcccccactctcaactccaccatcacgaccatcacacaacaattatgcgggccaagctcttcaagagctgggcctcttgtatttcattaccaccacgaacaacgactggctgacatttaattgcttcaattcgcatcgggccggcgttccatgtataatagagtaagacatgnngaggggtatcggaggcggattctggctagcgatggagttgcatacttctgcgactatgact

SEQ ID NO: 60691 - DNA, 701 bp, Triticum aestivum
  Clone ID: PAT_TA_60691
gccggccgggccgggattgtgtctttccgtcgcacacgtcgcggtctttagagtatcgagcacagctaacagtaacagaccccaacgctcccaagcgcggcctgtctgcctatatgttctttgccaacgaacagcgtgagaacgtccgtgaggagaaccctggtatctctttcggtcaagtcggcaagctcctcggtgagcgatggaaggccctcaacgagaagcaacgtgctccctacgaggctaaggctgccgctgataagaagcggtatgaggacgagaagcaggcctacaatgccgatcaggaagaagaggagtcttcttagaatggagcctccgatgtcaaacccaagcgtcgctcgcagaagaagtctgaatcggattagtcccagcaccagcgccgtgttgtagattctggccaggaagtccttcctctttgcattttggtctgggcggtgttgtatgatggcacaggaagagtgccttgttttttactaggaattttctcgggttaaggccgtccccgatgttatgatcttgagggcgatcgattgagctactggcttctatttcagtgtccttggccatgagaaacagatcgtgaactcgaggatcatgggacgaggaaacgcaatgcttgtacaattaagggaactccgacccaaataaatcgaactacgaaaacataaacgtcatctacc

SEQ ID NO: 60692 - DNA, 755 bp, Triticum aestivum
  Clone ID: PAT_TA_60692
gccggccgggtcgggaatcacattaccctatgtacgtcacacgcaggctgctagataaggtctgtgacaaagtacaacctgaggttcatggttggggtcaacacgacgagggaccatttccgcgctgcccttgggctgcggcgcttcccactcgtcgccagagtcagactctcacccgacttcgactcctggagggggacgtactgtgaatacatcgtggagatatcacgccgccagacacgctccgccgagaaggggatgtggcggcggctctcatgcgaatcatctttcactcactgcttaccacatgggtgtgacgctgcacagctgctcaagggcgacgggattcacgttgatgaggaccgcaactgaagcttatgattcgtgtacgtgcatgatatctggaggatccgcgccggcgtacacaaaaacagggaaaacgccctctcatgcggcgaattcccgtatgtcatactgaagatacccgtcaagaagccaaaaacatgctctctcacaacacaactctatgtggcatacatggtgctcaaggtagggcctagatttcacgggtctcgatgtcccgtttcaagaagcttcatttgacgttgctgtgagcgagtcggaccggaaggtgtgcctgcaaggctatgtcgaggacgctgacaaggccgatgatccacctcggaacacatcatgccaagttattatcttaatcgcgacgcggctcatcctgcagatgacggtgttttccctcg

SEQ ID NO: 60693 - DNA, 780 bp, Triticum aestivum
  Clone ID: PAT_TA_60693
gccggccgggtccgggatcaactaccaaattcttcattgaataaacacacacaaaatggctgctgcaaacaccctcttcccctatcttcgcaaagatccctctcagctcccagagggcgaagaccctttcaccatcaccacccgtacaggatacttgcctttttctcttcctctcactaaacttccatcccaattcgaccctgtgtcggatcttctcaatgacattcccattcagaaattggacggtacaccaggtctgctcgccacctttgagctaggtcctctcatcgacaatggcggtcttcctgatttgacctccgagattgataacctcgtcgttcctggcactgataagaaagatatggctgctattactgctgcgttccgcgattatagcttcatcgcttcttcttatctgcttgagccgtgctgggagcattacagcaagagtgatgatggtggatacggtcttggaagacagactcttcccaagtgtatcgctgggcctcttgtcaagtgcgcagagattctcgatattcccgccttcatgtcctacgctgcctcatacgcactatacaactactggcttgtccaccccgagcaaggtcacgacgactacgacaacatccgcctagtccgcgccttcgaaaagggtctcgacgcaaagtcttcggaagccggtttcattctcacccacatccacatggtcgcccaaacaggcggtttgatcgaaggagccgtcgatctcctcacagcagctgaaaagacgacagcgctacc

SEQ ID NO: 60694 - DNA, 657 bp, Triticum aestivum
  Clone ID: PAT_TA_60694
gccggccggtccgggattagagatacgtacgtcagctttatactcagcaactttcgcttctttgaggacacgatcccaccctaacgtcaggcattctatctacggcatcacgacgacctcaacgcacaatacccagtcactttcttccctaaacgaactctcagcggccaccttacgccatgtctgcttccagcgctcgagggcactatgccaacccacctttggaggatgaggacgacctgatcgaccctgatgatgccgatctcaacgactttgacgacccccttgcgaccaacaaccctcgccagcccttaactggcaacatcggctccagttcatcatcgcgaccgctcaacgaaggttatttaacatcacggatccctggagaagaccgagcagcccctctgaacacaattgacgagtctgtctgggatacgttgcgacgcgacctgctcgctgtctgggccaagcttagagaggtgctgtaccctcgttaccttttgggtggcaccatgttcgacagcgagggaggcattcgtggcgcttactcaagcatccgcggtgccggtctgtcgggaacaagagaggagcttactggactggccagccgcatggtcgatgctgaaactctgctttagagcaacatgacacccggtc

SEQ ID NO: 60695 - DNA, 794 bp, Triticum aestivum
  Clone ID: PAT_TA_60695
gccggccggtccgggactcactcacttactcacttatcaatatcacacttacaccctttaaagtgcgctccttctcatatcacccaagaaaccgccctagccattgaaccaaaacaaagagaaacccactcaaatccgatataacgggtgacgttcctcccctttcgatattgggtctagatctgcattccttgtcacagccgagccaacctagctccgtcattgccctgagagagaaggactacagccaaaagaaataagaaaagacaaaaaggaaatcgataaagagatcgatcgcatcgcatcacacaacagagttaaaaagcggtcgcttccttgaagcagtgaccaccttgatcaagaacaaccatgaccgccactcccgattccgaatttccctgttcaattactctaaacgtcccttttcccactgctcgactggccgcaaccgccctcaaggccattcaggtggaccctgagctctccccactcgtcagacgacagctcaccgttgtcccggcgccagcatcaaagtcaacccaaggttcaccaaatggtcaagatgcagatgtagatgcagatgcgcggttccttgaggttcagtacagagctacaaccaatagaatgctccgtgtcgccgtcaacggcttcatggagagcttgaagctcgtggtggaggttatggagcagctagacactgatgtccttgctcaacacatcaataacatgatactgccatcaatcatcacaataaacgttattatggaaaaaaaaaaaaaaaaagggccctaggg

SEQ ID NO: 60696 - DNA, 717 bp, Triticum aestivum
  Clone ID: PAT_TA_60696
gccggccgggctgcgattagactcacaaagtacgaccaagacagttggatttgctccaaaatcgaatggaaatgaccattcgctcctaaacaagaccgccttcaccttcccaacagtccccttccaagagcggccaacttcagcttacaactcagcctcatccctccacagaccagtcccaaccgccgtcaagataaagcaacatgacaggtcatgcactccacacaagaccctggagccgcaattgttgagattggagatcctcaggcctcatcctgccacaagcccccattgcaacaagacatcacccaagctccctcatccgcaccctttgacattgcggcatctggagttggacgacgggtccgcgaccccagtttttgcttctttaccccgctagattaatgatcactactacggctgttcaggcctctcaatgcatatgcggttaccccacatccggggccgcaagtctttctcctcatccccgactagggaccgattcaatctggggcggacacggctccgtccttgtgagctttgggtgtgtggttagatgtgtcagacgacgtacgtctacttcctgcaagtgctgtagatctaacctgaccccagactttgtcttgccgcaacggacatcaacatggttgggcactggttgatgggagctgcattaccacgccggtgagctgggttctctattcccgacacccacgc

SEQ ID NO: 60697 - DNA, 518 bp, Triticum aestivum
  Clone ID: PAT_TA_60697
gccggccggtccggggaccgccccgatttgttgttcacaccacacccatcccctcccctccacctccatcgcctcgccgtcgccgtcctttatttatccctcgctcgattccatctccactagcggccgcgcctctccctaccctcgccgcccgccgcccgccgctcccacctccctcccagactccccgtctccgcgcgcggcgatcccgccagtcccggcgaccaccgaggttcaaattggacacatcggtgctgtactgtgataggcggtgcccttgcttgccgacatttgtgttttattgattgccaaggcttccttactgcttagcccttgtttttgctggctgtctatatctgtttggagagggcaatctagcaactatgtcatcgcttcagttattgcaacttacggagcatgggcgcaaccttttttcttcgagaaggaggacgcttgcagttgtttctggcgcactacttgctggtggtacttcaacatatgcgcagccaggtcgacgg

SEQ ID NO: 60698 - DNA, 835 bp, Triticum aestivum
  Clone ID: PAT_TA_60698
gccggccgggtcgggatggacaaagctccggaagcgaagatgacacgcatgcaataaccaaacaatggtgcctggtttcgcagagtcccgtgcttcttctccctcataaaacctcgctgaagccttcacttgttttcttcatctgattgatgtgaaaaaagaaagctgtctttgactcggccgttttatttatttcttgctacccactaactctacatcacgcaaattgagcaaagttgcccaacatggctgaaaatgtgatggccgcctactgggacctcccagccatctctcggaatcttattactgctctagtgttgacgtccgtcacctgcaagcttaacattgtgtcggtctactcggtgctttatcatccgacctatctgtggatgttccctcctcagatttggcgccttgtaacatgcttcttcgtcgagctgaaccccatcaatttgctcatgaattcgttctttctgtatcgctactgcactcagctggagatgggaaacgctcgtttcccgcgcaaggtcgatcttgtcttttacattctcttcgtctgctcagtaatcctgatgatcgactacgttacaggcttgaacagcatgctgtacttgaacggcatcatccttgctatggcgtacaccgtgactcaggatcagcgaggccagaagacgcaattcctggttcttaccatcccagcccagactctgccgctctgcatgattgtcgttactgcgctcatggcaggacccagtgcagccctggtcgagattgagggtttgttcgccgctcatctctacgacttcctcgcccggatctggcccgaaatcggcaa

SEQ ID NO: 60699 - DNA, 771 bp, Triticum aestivum
  Clone ID: PAT_TA_60699
gccggccgggtccggatccttcacccctttacaaactcgacaacaccaccaacagacatcaccatggcctcacctacgacgaccaatctcccctcaagggccaccactggtttcagcacccaaagcgaggatgctatccctgaagttgatccctcaagcactgccggtttgctcgctgagcgacttcaggcatggaagcatgctgtcggttacatcgaggaatacatgaaggctatggagagaatccatggccaccacgccaaggagtacgagaaggcgctcaaggccatcagcaaccccctaaaggagggtcaccacttcgaccaaagcctcggcggcatggctggcttctttgagaacatgcgctccaacacccagtcccttatcaacaccaacatcgagaccgaaaagagcatcaaaggctccgtcctccccgtcctcgagcgcctacacaaggagatcaagcataaggccaaggaacttgctcacggtgctgaaaagggagccaaggaggtagagaaggcccgtaacaccactcagaagcagattgagctgctcggccaacactctgcgtctttcgactcggccggtggtcaccttaacagcaacgatgatccttacgtcgtgtaccgtggtgtcctgcaccgtctcaacagccaggttattgccgagaacaaccaccgaaatgacctgatcgctgttcagaacaacttccacgcctttgagacccatattattgaggtcattcagcaagctatggaggctttcacc

SEQ ID NO: 60700 - DNA, 313 bp, Triticum aestivum
  Clone ID: PAT_TA_60700
gccggccgggccgggcacgatcaagttcccctcaagaccagtggcggccaagtccgcatcactgactccaagaacttccccatctccaagaccatcgctgcagcccacgccatcatcgatcccggtgccatccgggagatgcactggcatccttctgctgatgagtggtcgttcttcatcaagggtcgtgcaagagttaccatctttgctgcagagggtactgctagaacctttgactacgtccctggcgatgtcggcattgctccccgaaacatgggtcactttgtcgagaacattggtgacgagcccattg

SEQ ID NO: 60701 - DNA, 801 bp, Triticum aestivum
  unsure (1)..(801): unsure at all n locations
  Clone ID: PAT_TA_60701
gccggccgggtcgggactcagcccaaagctttactgcaactacctcccctcaacgtgcaagatccagacgggagggaaataacccaattaacaggttggcgcaaactgctgatcgccaaacgatttcaatacttgatacatctacctgtctgcctgcatgccttccaggtcccatcagtccagtccacagcggtcactacaactcttcctcacctgaatccttccttccctcccgtccttctcttactcagcctttacgccaacacaaacaatataaactacccaccaactcattcgatcgaccagtctctccaactagtcgattagcacttcgtcatttttaatcatcagcgttagtcatgaataccctcagacctttgcgcggtggttgccagtgcggtcgaaaccggtacattattgctgtcccgcaggacggcatcaacgaggcacaggtcctcttcaacaccgattctgcgcatcagacatcccttgcgacaccactggctgcctacatccgagttcccttgtcgtggtaccacagcaccacctactctttctttcctgacgagacacatgctttgatccgacgtgtttacacacaccctagccaagaacactcgaaacgtcacttttgcggttactgtggcacgcccctgtcgtactggtctgaaaacccccagaccgaagccgattttatcaacctcacgctcggcagcttgctgagggaagatctgcgagaccttgaggacatgggattgatccccgaagagggagacagcangaatctaactacacaggcat

SEQ ID NO: 60702 - DNA, 359 bp, Triticum aestivum
  Clone ID: PAT_TA_60702
aacctcattagagccgccgcagtttttccatcatggcactgctccgttaagaatacagcattcctcaaatcattccgtcagagggcttcaaacgggatcctggcgctacattatgcgaggcagtggatggggacaaagctacagagaactctatcgctggatatgagatcaaccagtccaggatgattcttttttatgaagttttgggattagccaagaacatctgggaactccctgcaaaattcaagatttgccacactgattgttgacaggtgggccaagaaatttggcaagattatcgctatcaacaattcaacatggacacaatcaacaaatccgaaaggggggggggcatctgc

SEQ ID NO: 60703 - DNA, 414 bp, Triticum aestivum
  unsure (1)..(414): unsure at all n locations
  Clone ID: PAT_TA_60703
cagagtctaaaatgtcggtgcagataggcggcagaaagtggtagggacgaaatcccatgccgtttggagcgcgacctccgcctaccgacaacagcagtcgagcttagggtggccgccgcgatagaagttgatgagatgcagagttgcggaggagtccgcggcgagtgggtggggatgaagtgggcgagggttttcttttttccttttgcatgtgtgagtgaacacacacggttcgcagaggcgacagagatgaatcatgtgcgatagtaaatcaccgagattgaatggcaatccaaatttcctttgtcctttgtccatgagttttttctacgatgaacataaccctgctaatcaccgtgttcaaatttggcacttttccaggttcatttacantatttaagggattatgtgcat

SEQ ID NO: 60704 - DNA, 425 bp, Triticum aestivum
  unsure (1)..(425): unsure at all n locations
  Clone ID: PAT_TA_60704
tgcgaaaagacgacagaaggggaaaatgatgatgaacttgtgcctggtgactcgaagccaaaactggacctgcagagtgataataagaaaggaattcaagtgcagctcaacctgaagagcaatggcaacgggtcgagcgcaaagaaggcgccagcagcaagatcaaaagctcctgggtctgcagggaaggctgtcggaggctcaggcgggaagcggaagaggtagcctaccgccgccgcacaatgatgactggctggaagcaacagaccccagatagttggtggtctcgtgtttggtttctcctgttaccccagttgttcncatttgtagggaaaacctgtttgcttgcacttcatttgctcttgtgtttctcgccgctgccggaggggcttgtttagcgtgtgagctttttctcctgacgcaat

SEQ ID NO: 60705 - DNA, 433 bp, Triticum aestivum
  Clone ID: PAT_TA_60705
cggtctagtatcccgggccgaccgggctgcgagaaaacgacagaagggatggaaagggtcagagttgaaggtgccggtggttgtttgcgcaagcacattagcactcgtgtcaccttttgttgtcagaatggcaaaacttagttagcatagtgtttcaggtgtttcaattaatagtgtgtcatttttttgaggtactgatgctctcatgttgtaagcgctcaccgtgattaggtttctttgatggcggggcagagttgcagagtgctccaactgaaagatcccttggtcgccgtctcgtgtactggactatatccttcgtcactttaggtaactacgggtacgggaatggtatggcgttggaggacacgtcaatcgcccacgatcacctgtcagaacacagcagcagtacattttagacgtaatgctatgtgta

SEQ ID NO: 60706 - DNA, 421 bp, Triticum aestivum
  Clone ID: PAT_TA_60706
tggtggtggaggaggagcgtggcaatcccgtagggcttcgccaagcaccatgggagaagaggagtagggagaggggcagggctgcaccaacgagagatcaaatcatgtgttatgggcaagagatggtggcccttctgtcgtcttctcgcagccgtacccttctgtcgtcttctcgcagccgtacccttctgtcgtcttctcgcagccgtacccttctgtcgtcttctcgcagccgcgtcgacacggctgcgagaagacgacagaaggggtaggataaataaggaggacagcttccttgtgagggcggccagtttggcacggcagtccgccgtttgcttgtaactctcttcctcctttctccctgcttgtaatttcgaattagagctacagatcggagtgatgttcatcagtagagagatat

SEQ ID NO: 60707 - DNA, 414 bp, Triticum aestivum
  Clone ID: PAT_TA_60707
cagttagtcaaccttgcagaggttcgttctcctggaaaacccaccctttattctctcctaagtacgatggagttctcgaagaaaggaggccgacttcatcatgatgacctgaagcagagaaatgaagacatcaacgtaatgaatcgacctcttcgaggagagcaactaagaccgagaacactcactagaatttcgtaaccagaaccttccccttacgcatcttaaatcttaggacgagatttcttgtagtagaggagaattctgacaccccgatagttaagctacagtaaaccactgttaatgatgccaggtcatcaaaattaaaattttgctaaaccttgcttgtttcaaattagttcaaatacaaattcaaataacaaatcaaattatagtttcataaaacaatgaattaca

SEQ ID NO: 60708 - DNA, 428 bp, Triticum aestivum
  unsure (1)..(428): unsure at all n locations
  Clone ID: PAT_TA_60708
gtaggcgggatgatgacatcggctcccatgacattgtgtggcgtgaggccaatggcgacatagggcgtcgaacaatatacggaacgactgatgcgcgcgagatagtgcggcataccggatcgccctaaaacgacggcctttatatggaccaaactgtaaaacctgccgtaccaaatattgttgtcgagtagaaaatactgtttgaaatattataaatatgcgcaacgcgaataaccaaaacaattacacctgaggattcatccgacaacgtccaaaccaatggaggatgaggctataatgctcgtgggacgtcctgnccggagtgcctgaagactacgttgggccgaatagtatacgaaacgaccgatctgaacacgagggttcttacgcataggtcggctcgcccgattgacacagatggaaaacca

SEQ ID NO: 60709 - DNA, 358 bp, Triticum aestivum
  Clone ID: PAT_TA_60709
ctgacggggggatcaatgagaggtccacaaagcagtttatctgtgaggaagcttgccgggtcaaggttctgtggtgtttcgtctccttctccgacggcgtcttcgccgccggcggctcgtggagacgatagttggcgtttttgtggaggggtctccaaggtcttgtttgtaatttttccttttatggggtcctttctgcaaagtgtcaggacatctggtgcttctggagcattctggctgggtctgtctgtgtgtgggtgtaactatgtatcctgattgttttattaaatgacagatggtaccttctcaaaagaagaatggttgccaacattttccctgcctgattagtcactccctg

SEQ ID NO: 60710 - DNA, 276 bp, Triticum aestivum
  Clone ID: PAT_TA_60710
cgagaagacgacagaaggggtacgtcatgtatgagggcccggtgcgacaatccggtggcactgctaaccctttagagtttgaccccgggatctagccctttgactttgcatacaccgggtcccatacacacggtaaactaaaaatctaaaaaaacgtaataatcgaatttattaaaaactctggtattcatcatggagaggtccatcggtcaaactacgtccagcgaaagtcaaagggatagacccgacggttgtctatgtcagggttagacggga

SEQ ID NO: 60711 - DNA, 401 bp, Triticum aestivum
  Clone ID: PAT_TA_60711
cgtgtcctcgtcctcatcctcggcgctgccctcaaggttgtagtactcgtagtagtggatgcgctagagctcgcgttggtactccatcaccgattcctcgacggacaaactcttctctacctcgacctcggccacgcgcaactcctcctcccgacgctcctcgatctccgctgcctcttgcatctccagctctcgctcgatgatctcatgaggaagtaggtgctccatggccaccggtgcctttttggacgtgggttgcatgctggatttcgaggtggcctggaatatcttggcgtgtgcatcctcgatcttggcgggatgccctcgacactggccaaggcaacatcggcggcacggacgacagctcgagcgctgtcggcgtttgcatccatcgtcgcagc

SEQ ID NO: 60712 - DNA, 412 bp, Triticum aestivum
  Clone ID: PAT_TA_60712
cccagtcacaccgatctggcagagtgatggtggtcgtggtggcggttttggcggaggtggactacgtggtggtggttttggcgaaggtggactcggtggtggtggtggttttggcggaggtggacttggcggaggtggactcggtggtggtggtggttttggcggaggtggactcggtggtggtggtggttttggcggaggtggactcggtggtgcttgatgtcgatgatgattccgtgtatgcggccgttgtgccatgcctttcatgttttaacttttatgatgtttcatgtcttgcactacttttatgttcgtgactttcgctagtgatgatctttagatgatgaacttgactatgtttaaatgatgatgatgaactgtcatatttcatattattctgctttgaaatgct

SEQ ID NO: 60713 - DNA, 435 bp, Triticum aestivum
  Clone ID: PAT_TA_60713
cggtcgacctgcgagaagacacagaaggggatatactcttgataacttaaagggcattagtcccacgctatgtcagcacaaaattaatatggaacatgatgctaaaccagttgttgatcaccaacgtcggttaaatccgaagatgaaagaggtgctaagaacagaaatattaaaacttctaaaagaaggtataatctatcctatagttgatagtagatgggtaagtcatgttcattgtgtccctaagaaaggaggtattactgttgttcctaatgataagaatgaattcattccacaaagaattgttacaggctatagaatggtaattgattttagaaaattaaataaagcaactaggaaagatcaatacgctttgccttttattgatcaaatgcttgaaagattatctaagcacacacacttttgctgccttga

SEQ ID NO: 60714 - DNA, 436 bp, Triticum aestivum
  unsure (1)..(436): unsure at all n locations
  Clone ID: PAT_TA_60714
gtcgaccggctgaaagaagacgacagaagggtcactgcccgtgaaagagcttaagtaaattgatgttgtatcatcagaatctgtagcctggctcatcacaggggctctcttatcagcaaaatagctactctagatgcgcagatgacgatccagccgcggttgcgctttatctcgtcgggacgaaatagccctgccttgtccctgccgccgccggtagaggctattttccatangccaaggtgaacatccgtgtctaatggtgcgaatttagtctggttccatgagcacttcgttccccgccatgcaatctttgttgattcggaaagatgggagctgtctgtttagctaattcaatctaccattgatcatgctaatttttgttatataggaaacaacatggacatgctgcccttttttccaatcaaaatacttctgt

SEQ ID NO: 60715 - DNA, 405 bp, Triticum aestivum
  Clone ID: PAT_TA_60715
gcgagaagacaacagaagagagagatttgagtgttggggagactatcatttgaagcacaagagcaaggagttcatcatcaacacaccatttgctacttcttggagagtggtgtctcctagattggctaggtgtcacttgggagcctccgacaagattgtggggttgaaccaaggagtttgtaagggcaaggagatcgcctacttcgtgaagatctaccgctagtgaggcaattccttcgtgggcgatggccatgatgggataggcaaggttgcttattcatggacccttcgtgggtggagccctctgtggactcgcgcaaccgttaaccttcgtgggttgaagtctccatcaacgtggatgtacgatagcaccacctatcggaaccacgacaaaaacatccgtgt

SEQ ID NO: 60716 - DNA, 434 bp, Triticum aestivum
  Clone ID: PAT_TA_60716
cgacagaaggagctataagttcggggtgccacacttgtgaaagtgttcggagtttatcacaccataattttgggatacttaagcccctggtgcattggccgtaccaaagtgtacggttgcaacatgtcgtgaaatgaacatatgtatatatataaagcaattaaagcaataataagcaagagctatgtattgtttattcaaaaaggtactgcaatggaagcagaacgatacaaatagtgcggtaagcaagggatgagactatctaacatgtccccctctaggggtaagctgcgggatggtatgtaaaacaggtataatgctcataacagagaccacccgagcacttgacgtggccttccgcttccctggctgttgtatcgtgagttcggcgattcaagtgccggacaggactgttcgaagacggagtcctgaaa

SEQ ID NO: 60717 - DNA, 435 bp, Triticum aestivum
  Clone ID: PAT_TA_60717
cagcttcctgaatatagttcagttgaactcgatgtttccgtctctgaatcaaaaaatgtataattagttccatatagtgcgcaatggattttgaagcatttaagctgtttggcaagtctggtggcatacactcagtgcagtgtatgctttgaagaaagatataggcacctggtggatgggaagtgcaaatgagatatgacttggcaactcaacaagacagttttggggaggattataacattacagagagatgctgagttagtgcactcatagtggaagtgtttgattatgacattagcgacatggtagttgctgagttagtgttgtcaaattgtgaagtgtcaagaggtgtggggaagtcatttcttcaagcagacaaggacaaaattcaagaggctgatgaaacagcacatgatgatcacatacaggaagcac

SEQ ID NO: 60718 - DNA, 433 bp, Triticum aestivum
  Clone ID: PAT_TA_60718
gtggcataggagctttcttcgtcagaactgacaccatcttcgtcagcaagggatactacaatacgaggcccagaagagagtacatcgtcttgcctacttgtcagcagattcgagtcagtgctatttgatgtacttctttgccagatttttgaagaattgccagtgctttgtgtaacggggctgagctttatcttgttatcctctatcctattctggaaaaaaagtataacaatcagaagaaaagaacaacatgaacatctgataacaaaaagtactgagagaaatacagaatgtgtgatctcaaagcaccttaatgtaagtaaaacgatctgctgtaactttcttcttcaacgagtcaataacacgtaaaatgtgccgggaggcctcacttctttcttcttctgacatattagccttactatcttgactcttg

SEQ ID NO: 60719 - DNA, 341 bp, Triticum aestivum
  Clone ID: PAT_TA_60719
acagaagggaacaagaacggagttttcggaggagatttccgcactttgaagccaccatgatgatatataagaagatggacgaaatatataacatgtctttcacaaatttcgtccatagattattattggtgctgtgtcaccttagttttgggctagcccatgtattttcaaaatacctctcatttggctatttttagagtccatattgtaggggaagcgacttaggagatgttttagtcccaccttgccaagggtggacgaattcccctcttttttctcctataaatacaacccttaaggcaccgtgttttatctaaaaaaaaaaagaagaaacgacaaaa

SEQ ID NO: 60720 - DNA, 423 bp, Triticum aestivum
  Clone ID: PAT_TA_60720
ggtttccttcaaggacctggttctttctgtccacatcaattgttgtcattggagtgcttctgttctgcggttctggctgtgcatgatctccagtggcttgatcttcgtttctctcatgctctgctggctgctgcttcttggtcgtagtgagatatgcatgtaatctttcggtttttgtcaagtttttgcctttgtaatttagcatcattgtatcctaatcggttgatggcttcattaatttgaagtcgggcctttcgtgcctttttttctaaataaagggaggagccatgcagaaaccaccctcatattttagttaacaaccagcagtacatgtagaaaataatgttttattaggaatattaaaatggtttaaacatatacccatatagtttaaaccctaactccaattttgacagattatat

SEQ ID NO: 60721 - DNA, 422 bp, Triticum aestivum
  Clone ID: PAT_TA_60721
gtgtccagcatggactgctacgggtcgaagaaaaagttcaccaggagccggcccatatgtttgaccggatattaggccttctgggattaattccttctttaaacagtgagatgggctagtgtgcacgtagcttctctggtccattaagtctaatcctccttctcttcttttgtattttaaaagacttgtgcatgtagcatggaacatggatggccctcatctctgcaagcacctttgctcctttctgatgcgtgtgtgtgtgtgcacttgcatgggccgtgcaatcttcaacatcttcatatttattttgcagatgccttcaagaactctacataagaacataaagttgtgtagtatttttgtcgctgataataaaatataatatcatataatgatcaataaaattacctgaaaattttgtc

SEQ ID NO: 60722 - DNA, 414 bp, Triticum aestivum
  Clone ID: PAT_TA_60722
ctgcgagaagacgacagaagggagttgaccactgcaggatgcacggatgcggagaaggtgtgttttgccgcacatcagctagatggacccgcagcatcatggtgggagaatttcacaaccacttatcctatcgacactgtcacatgggaccagtttcagcaggctttccgtactgcccatgttccagcaggagctatggccatgaagaatcgtgagtttcacaacttacaccaatgaggacgtacagttggccagtatgtggatgtctttagtaagctagcacgttatgccccagatgacgttgctacagatgcagctaagcaggagaagtttctggaaggactgaatgatgagctgagcatgcagttgatggtagcaaccttcaacaactaccaggagttggtaaggatctct

SEQ ID NO: 60723 - DNA, 178 bp, Triticum aestivum
  Clone ID: PAT_TA_60723
gaagacgacagaagggatccctcaggtcgccaccctcctagggcgcgccgctgaggcttgtggacgtctcgggactactttgacttcatctccaaatcctacatgtgtcttgtggtccaagaaaaatcatcgcgaaagttttattccgtttggactccgtttggtattccttttttgt

SEQ ID NO: 60724 - DNA, 322 bp, Triticum aestivum
  Clone ID: PAT_TA_60724
gggtccaccagccgggcatcatcggcaaggtgggatcgattcttgggacgatgaacctgaatgtcaactttatgagcgttggcaggattgctcctgggaagcaggccatcatggccattgggattgatgaggagcctgacaaggaagctctcaagttgatcggggagacgccgtcggtacaggagtttgtctttcttaagctttagagaatgtaggttgatttctactcctatataacatctcctgctttactagtatgatgagtggttttttgcaagcttatttagtttttatgcaaaagaaggaaagggccacagaaaag

SEQ ID NO: 60725 - DNA, 423 bp, Triticum aestivum
  Clone ID: PAT_TA_60725
gggccgtactccgaggccctaatttctccgaagaggcgttcaattccttcaactcaggagacgcgtacatccgcgctgctcaaggtggtcttgctagagtcacggaccagtatttaaaggatatacgggtaagaaaatctgataattatgtatattagtagctcctgagacttgaaacagttggcacaactgatttaaggatcattatatgcataggttcttacagagaagaacaccagtttgtctcaagagctggaggagtgcaaagcccagctaagggccgcagctgttggaatggaggaatccaagaaggcctcatctggtaatacttgtcttgataaaaaagaacgtatttatgtgtaccagttagtattcagcatgtttgcaaatctaacaatagattctgcagacaatcccggagtg

SEQ ID NO: 60726 - DNA, 215 bp, Triticum aestivum
  Clone ID: PAT_TA_60726
gcatctgtggcagataacaggggggtcgtggagctgtagcagccatatgtcaagaccaagcgtcggataccagaggttttcaactattgtgttcaaccatctagagtaagatcatgcttacgttgtggcttgttaaatattgtgacttgttaaataaagcttgtgagtttgccgcagaaaaaaagctccaatgcattggaaccggaccagattta

SEQ ID NO: 60727 - DNA, 422 bp, Triticum aestivum
  Clone ID: PAT_TA_60727
gcacctcgggggaccatgacaagtggattgtgggcgcggcaggagccactgtcatccggcggcttcgcgcgtgacggggtggcagactcgcctgtcaatgtccttgcctgcaccaagctggttcagtcacggcaggcgtggtttcgatcacgcccacgtgcaacattttgcatgttgtcccgggggtgacgagccaggcagacccgccagtcggcgtcttctccccatgcttggctggtttgattgcaacatgcgggtcgtgcttcgctccatttggtttgattgcatattttcgaaatgtcgcttaaagacattggtaagtccaaaaaatatgttatggggcacatttttggccaccaaatatatgccgtctagttccctaaataatatagttgataattatcatgatacatgtgtttaca

SEQ ID NO: 60728 - DNA, 449 bp, Triticum aestivum
  Clone ID: PAT_TA_60728
gggtccaccggctgcgacaagacgacagaaggggtagatgcactctcctttctactcgtagttggtttctccatagatagatcttggtgacacgtaggaaaattttgaatttctgctacgttccccaacagtcgtctcccgaccagttaggtcggaaagaggacccccatgacggttcgcgaatgggccacttcaggcagcccatgacgtatacaaggaagattccacaagacttagcgcgcaagacgacgactcttctaaaccctaggcctctgatgcattatataaaccgagactacgctagtcaatacgacatcttatattcattacaacaatatcgtggtagatatcggtactatactatccccaatatatgaatataatctcgaacttgggtaaaatcatgtgtccatgttgctatcgctacaagacgcctaacttatgaccct

SEQ ID NO: 60729 - DNA, 381 bp, Triticum aestivum
  Clone ID: PAT_TA_60729
cgggtccaggccccatcctcaagccatgcgatgtcatgccggtgtttgtttgtttgttaattaataaatactggtacagaagaagaaaaaggagtatgaaagcagtaaggtgggaggggaaagggaagggagctaccactgggttgggtttattctcccatttcagttagaggagtcgttttcttcttcttcttcttgtgcttccacttcccttgcctacacgcacgctcctcctcctccattctgttttttcacttgcttctttctttctttctttctttcttgtgccgacacaacaaagagatcatgagagagcacccatatttatcatcagcatcagcatccatccatccacaaaaaaaaaaaaaagagaaagaaaaa

SEQ ID NO: 60730 - DNA, 404 bp, Triticum aestivum
  unsure (1)..(404): unsure at all n locations
  Clone ID: PAT_TA_60730
gcactgactgcggcaataacacatgttagaatatcggagccgaaaaggacccggctttgcagccctggcattcccatacagcaggaatgctcctcaaacttaaagagcaacctgtgcacggcgttctgacatgaccccaatgtatagctccttgtgtgttggtctgatgtcagtgatggctcagcctgctggttgtctctgctgaggataataactcgggttttcctgtcagagcaagcaagcgtttgacatggtgatgctgtagattgcggtgatggctgatgaacccgacatggtagctgatgctgtaaattttgtaaatagaatgatccagtagctaatttatatcttgacagagttcagaataatttcagtctatgatagagaaaagcggngggggggtg

SEQ ID NO: 60731 - DNA, 326 bp, Triticum aestivum
  Clone ID: PAT_TA_60731
tcgcgggtcaacacgacaccctataatgagtcatagtaatatgaccaaaagaaattatgagaattatttgggaatttttggatgaacagaaatatgggttgctttacaacctacggtagacagggttattcctttaatagaaaaataaatattcctaaaaaaagaaattagggtttggtcaagcagtgaagtgacacgatcttgacaatgttttgagaatgatgagccacttggggagggggaatgaggatgatttcccaggtggcaaggccacaaaatcactccaaatagaaaaacagagcatacaagatttatcaaactcaaaa

SEQ ID NO: 60732 - DNA, 445 bp, Triticum aestivum
  Clone ID: PAT_TA_60732
gggtccggtccggtcctttttatagatagatagatagatagacgatgcaagctagtcttggaatttcggttcacacaagaaacagccccacgatgcatggcttggctagcttattaatggttcacacaagaaacagccccacgatggcttggcttggcttggctacaagaaacagcaccaccaacagccaaaagaagctggtccttaggcgccatattcttttggagatcccggaaataatgaatggtccaacactcttatgtcggaaacagatatacacatataagggaatccatgatttcccacacacgtactccctacgtaaaaaaaatataagagcgtaatgcagtaaacaaaacacaaaaaataaatttctttactgtgggagtattatgcaaggttgggaataaataaatccccaacacatagccaagtcgtttttcct

SEQ ID NO: 60733 - DNA, 270 bp, Triticum aestivum
  Clone ID: PAT_TA_60733
cattccggcaatcaggggggcgatatccttgccgcgaagtcgtgtatccatctatccgtccagaacataaccttgctaccctctccaactttgatgagcaccatgctatcaataactacctttgcatccttgtccaccatgaggtgtaaccctggccacgggcaggtggggtctgtccttcttatccactcccaccgaacacgcatggtcaggccttggatcttcaggctcttgactcccattcaagataaaaactctgaaaattggaat

SEQ ID NO: 60734 - DNA, 277 bp, Triticum aestivum
  Clone ID: PAT_TA_60734
cacacttcttccaaatttggtcacggtctcgtctagaccattcgacaacaaccatatgttctactgcatgctcaatgcttcagcagcggctccccatcatcagttatatcattttgtcaattcaagaatgtgatacttggttacttctcctgcatatcttttgtactaagctcaagtattcacactcaggctcatccaataagtcttcgtatcatgtgctactgttattgtaatgtatctatatacacctgatcaaagatcatgcatagtgccaaaa

SEQ ID NO: 60735 - DNA, 379 bp, Triticum aestivum
  Clone ID: PAT_TA_60735
ttcacgggtcgaccggctgcgagaagacgacacaagggggagcgcaagacggtggttgccgatgataccatgccaagtggccatgaggtgtatgccggtgatgccatctacatctctctctactccatgggaagaatggagagcttgtggggtaaagactgcctcgactttaacccagacagatggctcctgggggatagcaacaagctcaagtatgtgccgtctaacaagttcttggccttcaactcaggcccaaggatgtgcccaggcaaggaaatcgcagttgtgcagatgaagaccatcatcgccgcagtcgtgtggaactttgacctggagcttgtggaaggccagagcatccaacccaagctatcttgtttac

SEQ ID NO: 60736 - DNA, 142 bp, Triticum aestivum
  Clone ID: PAT_TA_60736
caaccgatgaacgctgattccggaaccacctccagggccttgtttcgtctttatctggggtgttttttttttagaaaaggaggatgacccccggcctctgcatctggtcgatgcatacggcccctttattaattattatcac

SEQ ID NO: 60737 - DNA, 190 bp, Triticum aestivum
  Clone ID: PAT_TA_60737
ggtctagaatatccgggtcgacccatcaccgtcttcgacagtttctgaagcctgttggtttggtcatggcacatttgctgatggccggatgtgtgcctactatgcgccgtagcactgtggaaaaatgttccaacatgaagaactatatatggttgtcttgctagattatgtagtactatttgtatgatgc

SEQ ID NO: 60738 - DNA, 415 bp, Triticum aestivum
  Clone ID: PAT_TA_60738
gctgcgagaagacgacagaaggggaagacctctgttctttcccttgcgcacgaacagcccctccgacggcggcgaggcgggcgaattggcatcctccctcctcgactcgacgcgcgcgtaatccgagactaccttcaagaggacaagatgctgtggcgcacgattcgcagtatggaggtgatggcgcattcttctagtttccttcttccgaaattgcatcagcctgccaagactccagcaaacaactatactctggttgttcttaaccagcagcttccacggttcatgcctcgcctctgggctcaagagcagcaaagatgagaatatgtgctgatggtggagccaatcgtatttttgacgagatgtctcaaatgacaaatgacctggacagaaataggtatattccagaaatagt

SEQ ID NO: 60739 - DNA, 431 bp, Triticum aestivum
  Clone ID: PAT_TA_60739
cgcactcgcggacgttggtggggctcccggaccggagtgtcatgtccgaagagccgcaggttgaagataaggctccctcccgtgctcacatttcctgcctgcgattttgcgccccccccctccctttttggtcaatttctgatcgagtttcgttgagattccggccgattcgcggtgctccggcgtccccgtcggtggtggagtcaggtgcttgccatctagggcggcattgcgcagttttgtcgccgccgtggcggtagtcatgccgatgtgggccaaatccatccccgtccccgtccgcggcctaatccgttgtttgccttgcgattgagtgggcgatttttccagatgttagttatgattttcctcggaatgctatggccatcagtgtagtgagtattttgtttgttaaatttcatggatatgatagg

SEQ ID NO: 60740 - DNA, 416 bp, Triticum aestivum
  Clone ID: PAT_TA_60740
acgccgtcaagtagccgtccagaattctagggtcgacgctgcgagaagacgacagaagggcatcgagtagaccctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcgtggcagcattccgagtaagtcctcagcctggggttccgcccgaagaagcaggggctggagtagctgccgaatcttctactggtacatggacaactgtttggactgatggacttaccagtcttgatcgttacaaaggacgatgctgtcacatcgagcctgttggcggggaaaacagccaatgggtctgt

SEQ ID NO: 60741 - DNA, 425 bp, Triticum aestivum
  Clone ID: PAT_TA_60741
cccctggccttgattcttttgccaatattttttatattttccaaaagttatctacgtggatttttaggtcattctgagaacttttattttctgcacaataaacaacaccatggcagttctgctgaaaacaacgtcagtccaggttagtttcattcaaatcatgcaagttagagtccaaaacaagggcaaaaagtgtttggaaaagtcgatacgttggagacgtatcaactcccccaagcttaaacctttgcttgtcctcaagcaattcagttgataaactgaaaatgataaagaaaaacttctacaaactctatttgctcttgttgttgtaaatatgtaaagccagcattcaagttttcagcaaagattatgaaactaaccacattcacagtaacacttaggtctcacatatcaatggcataatc

SEQ ID NO: 60742 - DNA, 420 bp, Triticum aestivum
  Clone ID: PAT_TA_60742
gcagatttttatttctagctatttatcggtctgcatgtaactttcttacagatttagaaaaacactcagttaagtttagactgtccatgtcactcacaaaaaaattatactgtcgatgcatcttttgtggtctttcttgtagaaagcagcctatagatagaagacatccacgtgggtagtatttcagctctctcggcattatgaaatggtggtacaaatatagcatcaagttacacgacaaaaagttcccatcgatatctcataagagctttccaccaaaagaaagagaatctcgtatcaattagagattttccatatccgaggaaataaacatatagaggagagtgaccttttactatgaggaagcagacagcagtatgttcatgctattcggtactaacattaacggcgaggaattaa

SEQ ID NO: 60743 - DNA, 406 bp, Triticum aestivum
  Clone ID: PAT_TA_60743
cttaaactttgtgttcatgcccatggacacgatgtacatcctatcataaaaacttcttgtaataataattgtttccttgatataatatcatatggtatctgagaattgacccctttgcaatcatggttccggccatgttctcctttaaataccatttcccggacaagttgaagtacttgtcttctgcagatctttgcacctgtccaacctttactttgatctaccatcgagtattacactctggtatctcaaaaatatcatggaactgcataacttcttatgggttcttcatcaactgttatttctcaccgattccaattttcctgggttctgggttgtcgtcaaccgagagcaccgatatgtgaaccgattccgcactccgattcaataactctaagtaattttc

SEQ ID NO: 60744 - DNA, 402 bp, Triticum aestivum
  Clone ID: PAT_TA_60744
gggtctcttcccactgaacgcacatcatcgaaatactgaaataaattcaaaaataaatgcgaacaccaggacgacttgtaccctggtgggctggaaatagcactgtcctcctaaccatcgaaccacatcttggttcgccattggatggttttctttatctatcttttggctatctctcttttgactcaagaaccgtgcgctgcttgctagtaatagttgctctgctagtagtaatactttagtggttggtgtattctattatgggagctaattagaagtttccgaatagcaacccaagaatcatgggcagccgacaaacttcgcctcacaatggcgttggcgacacaatgacatcacccacaacgaatccctacaatagggaccgttggattggacatatcc

SEQ ID NO: 60745 - DNA, 403 bp, Triticum aestivum
  Clone ID: PAT_TA_60745
cggatgcgagaagacgacagaagggggattcatcaaaaagctggcgtcaggctggatctgatggaagtagtcagctcaaactgaaagagccatctaccaatgtggtcttagctgatcatgttaccacgaagaaatggtagcaagttgttgatttcgacgaccacctcgatgatatcagcaagtaagtggaagagtctacaagtgtcatgaagctatagtttgtaataccccacaaagaagttgtacttctttttaataaccatattgagtgcttcctttcctctgtttacattatttccccttgcatatttgcagggactggttgaacgcaagcctgcttggttgacacggttttgagatcaactttgtcacatatttatttgaactggctagaaacaaggca

SEQ ID NO: 60746 - DNA, 377 bp, Triticum aestivum
  Clone ID: PAT_TA_60746
gacactttctttgagctaatacgcaagcagatctgcaaccagatactttgtgttgtaagcgggattgtacatgcggtgcctactgtgatgaggcactgagatgaggaaggctgatttattattcataaatgcatatcctacctgaccagatctgctgtccaggtcgtaccaaacggctcctgtttcgtcttcggcgaggatagctatagtgacagatccgatgactttgcgtttgcatacattgtcccagtcataaactgttatggttacctatccagaaagtaaaaaatacatcacacattttagcaagcacgtctctggcatcaaatgcgtgccttggcatatcttgttttcgctgaaaacgtctcagtttcagc

SEQ ID NO: 60747 - DNA, 211 bp, Triticum aestivum
  Clone ID: PAT_TA_60747
ggagacgccgctgcggttgccctcaacagtggtcacaagggcggactgtagagcgagctcatcctcatccatctctacgctccaggggaggtagcacaacgcggacgccgggcgtagataggggtggccggacaaaggggatgccgaacgtgacgccgggagtggtccccagggcaaagaggggtaaacaaagcaaagatccaagaaaaag

SEQ ID NO: 60748 - DNA, 413 bp, Triticum aestivum
  Clone ID: PAT_TA_60748
gactcttagaaaaagtttcaagcaatttcttggtgtacaagttgaagctttctcagaacgctacctcggtttgcccattgccgttggcaagataaatagtggaacctttgaatatctagctgatcgggcacgaggcagcacgcaaggttgggcagagaggctttttgcttgcaccagcagggagacccttctgaaatctattgttcaagctatcctgacgtttaacatgagttcctttctgttgacaaaaaggtgtgtaaaagttttacctcaagcatggcaaagttttggtggggtagctcaatcgataggaactccttacactggatcgcttgggataaacttgccacaccaaagtgcaaaggcggaatgggattccgcaattttcggctgtttaacttggcgctgttaag

SEQ ID NO: 60749 - DNA, 260 bp, Triticum aestivum
  Clone ID: PAT_TA_60749
ccatcagagacgtagtgatgatggcgcagcggagaaaacggaagcgcaagacttcgaattcagtcgtaatcatccgtttcactcccgctacgactgagggggaatgttagaagtataaacgtagagataaggagagatagggataaacttagtttaaacacataatatcttgccttgtactccaaacctctatccctcgtgtacttctatatataccccatacgagggtcggttcaatataacacattattagccatccc

SEQ ID NO: 60750 - DNA, 432 bp, Triticum aestivum
  Clone ID: PAT_TA_60750
gcatttacggaccgtccgaatttccgcctgtcaaagatccgcatcataaatgggccaccatttcggcctgctaagaccagtgggttatttggcacaatcagggcctaatctcactttcggtctattaaagtcccatgttttttatgggctcgagatatttacacctgtaaacggcctatttttactgagggcccaaattatgtttaggcctgttaaaggccaactacgggcacatgcctaccagaaaaatatgaaagcttatgctgatttaggcccatatatttttagtggctacatgccaattttggcccgtagtcgtttttagcccaattggaatgggctcaacgaatattggcatgttgggctcctacgaagctttcggccgaatacattactaagataaacctacactatacaaaaatagcgtcgtaa

SEQ ID NO: 60751 - DNA, 302 bp, Triticum aestivum
  Clone ID: PAT_TA_60751
catcgactcacaactaagggtgtgtgtatttgtcaagggtccccagttgcatgtcaaccatcaacttgcaactagggggtgtgtgtgttgtcgatgcccccagctgcaggtcgagcatcgactcgcaactaagggtgcttttgtgtgtttgtctagagtccccagttgcatgtcgatcatcgactcgcgactaggtgtgtgtgtttgttgagggtctccagttgcaagccgaccatcgactcgcaactagaggtgtatgtgtttgttgagggtccacagctcccttctgtcgtcttctcgcc

SEQ ID NO: 60752 - DNA, 370 bp, Triticum aestivum
  Clone ID: PAT_TA_60752
cgagaagacgacagaagggtacggctgcgagaagacgacagaagggtacggctgcgagaagacgacataaggggtgttccgtcagacgattgcaggaaatatccttgttggcagctactgtgcattctctaacacgggtggactggtccatcctcacacatccattgaagatcttgatgatctgtccacactcctccaagtccctcttgtcgctggaaccgtgaaccgtggtaccgaggtcattgctgcgggcatgactgtgaacgattggaccgccttctgtggctcatacacaacggctaccgatctgtccgtcatcgagagcgtcttcaagttgagagaacgccagcccgcaacgatcgtcgatgac

SEQ ID NO: 60753 - DNA, 128 bp, Triticum aestivum
  Clone ID: PAT_TA_60753
gcccagtgtcagtcagcagcgagcgacgcagtgccactctcgccggcctgcgtctgcgtctgcttagctggagccttgttacggtgtgtgtcacagtgtcagttccacctatgatcgatcggtatccc

SEQ ID NO: 60754 - DNA, 323 bp, Triticum aestivum
  Clone ID: PAT_TA_60754
gcaccggggctgagaactgagatcgtccggtttgctgcccgctgtggtctgtggacctttcgccgttattatgatggcgcgccgcagccggaacggcaatgatcgaccatgatgatggatggtttggagaacagcggccccaccagctgctctccaaatcatggtcggcccatgctggttgcacaagtcaagggaaagtcactcttcccctcgccataagccacggctacacaagtaaaccggcccagcgagctcgctcgcttttcaggattgacggctcgaccattgacctgttgactgctaacagggtgaccgttacctct

SEQ ID NO: 60755 - DNA, 379 bp, Triticum aestivum
  Clone ID: PAT_TA_60755
gacctcggcggcaacacgatcaaactccgctggtacaggaggaagagcaatctgcacaaggtacgtcctaccacagtctcaggctctcagctccatgatccattcatttattcactgtcgactatagtagtagtttacgagggtgttgtgtttccaaactaccatgtgtgggattcggacgtgattacagaggccatgaaggacttcttcaacatagaggagtacgccatgatcgagtccatccagcgcaacatcaccgtatgctacctcactagtcacctctgcaccgcattttgcgccattacttcagcttaatttcacctcgagtaatttttgtttgagtttatcacttgcaggacgactggtccagcgaggagaa

SEQ ID NO: 60756 - DNA, 412 bp, Triticum aestivum
  Clone ID: PAT_TA_60756
gacgtggggaagttgacgccctgatgtagcaaaacattgaatgacgggtgcaaattgaatgcacagttgccaaggatatttttccttttttatgatggatggatggatggatggatggggggtgtttgtttcgccctcgagtcaggtctcgaggggtttcgctgttcatccagagtggaggatgggatagagtagagtaagagcaagggaagaagagcgcagggtgtagagatgtattgacagagatacattatttggctgggattcattcatccatgtccatgtgtgtgtgtgtgtgtgtgtgtgtgtgtgtgtgtagttagctgaagggtttgtttgtattgaagcaagtttgtgagtgtgtttactagttacatgatgatctaacaagaatatatgtataatgggtccc

SEQ ID NO: 60757 - DNA, 434 bp, Triticum aestivum
  Clone ID: PAT_TA_60757
gaaggactacattcaagtggaccaaccaattccctttggtttaataaacgtgaagccagtgtccaagctcctgaagacagatttctagaccaagaccgccctagcaaaagtggcatgatatacaatacatcttacaatatctgtcacagcaccatcaacaacatacagattgtcttcatcttcgttatcgtcgtgactcccctggattttcgttgtttgttgttaaatttatctccctccgtagtagtatcgtgcccccccgcactaatctgtgcctagcagagctgagccgagctgaagtagtagggctgtgttgttgtgctccatccatgtcagtgtacatatgattagcccgtgtaaagctaagttttatatgccgtgtaatgtggtagtgtcgttgggtcagaggaagttattgaccgcctgttgttttt

SEQ ID NO: 60758 - DNA, 221 bp, Triticum aestivum
  Clone ID: PAT_TA_60758
cgtaatggcgaccaaagcattgtcgatgctaagttgttggaacaccccatcgatcagctccacctttatgtccggatcctcttcggaggccggatcgagggaccattccggatcctcgggttgtggagccgggctgtgtatatcttctacggcccggcgcagttcctgcgtcaatatcacaaaatgagatacttaaccatgggaatgtggatcagataggt

SEQ ID NO: 60759 - DNA, 399 bp, Triticum aestivum
  Clone ID: PAT_TA_60759
gtcgaggaagaagatggacacgccggagatgaccgtggtggcctccgtccacgcaggcaatggcgaagctctcggcggtgccctctgttctctgtctctaaaggaagaaggagaaacagaggaagggaaagggtggcggcggcgagagggaaaccctaggggcgcgggttgctggatttataggagggccaggaagcatcgaggggtcgcggtgaaaccacggtggccatgtgtgggcacccctagaggttttactgtgagagaaaagagatcaggaggaggaagaaaaaacaggggaaggagaggctgcaggtggggcctggacgggtgtccaatgtggattcaccacgggagagagcgaggggggctgcgctgaggctcctgctggactggcctggt

SEQ ID NO: 60760 - DNA, 434 bp, Triticum aestivum
  Clone ID: PAT_TA_60760
cttgcagaggtccgttctcccggaatgcccaccccttattctttccgtaagtacgatgaagatcccgaagaatggatgtgtactacatcatgatgacctgaagcagagatatgaagacatcaacattatggattgaccgcttcgagaagagcaaccaagattcagaacgctcgttagaatttcgtaaccaaatcccttccccctcacttcccctcataaatctcgggacgagatttcttgtagtggaggagatttgtgacacccggataattaggctacagtaatcccgcgttaacgatgccacgtcacctcggttactgttgctaatctcgcgttagttcgaaaccgattcaaattcaaatccaaaatcaagcaaacaataaaagttttcaaatattagaactaaaatgtatggagtgagccaaataatgttt

SEQ ID NO: 60761 - DNA, 360 bp, Triticum aestivum
  Clone ID: PAT_TA_60761
ctgcacactttggaaggctctctggtgcaccgtcttgaaaggaaggcacaacgtcctcgggaggcgtctcaagcagcagtatccagtcgcccgggcttacgcaccccacctgattcttttcatggcaacaaattacgtagcgattgccggtttcgtcgcagtctctatcttgagcgaacaagctgccagagaggcgaggcatcctggggcacctgcgcctgcgccttcctctgtcctcctcccctagctcggagcagcatccaaattagaaaagtatactgctgggtgctaagttaaaaccaggttagcagttggtacttaattcagaatctttctcgcagctgggataaggtttgtggc

SEQ ID NO: 60762 - DNA, 417 bp, Triticum aestivum
  unsure (1)..(417): unsure at all n locations
  Clone ID: PAT_TA_60762
caccggagcactgcagctcttcttctccaagtttggtgccaccagcccaccatgctctgttctccggtgaggcatctctacatcgtctgatctaacttaatcaaacaacccatatatgtttaaactcagaattagtatagttcaataaggcgacgccacgtggctctccaatagcagttgtggcaacaacatcagaaacactgccacgacagactttttggtcagatttcaattcaattttcattttgctataccttgagatccacacgttcaaatcaagtgatcctttttcctacatattcacaatgacctctaccgtgttgtaaatcaatatttcatttgtccanaccttttanatttgaccaactctaattcaaatttggatctccataagatcatatcctgcanaccgtatat

SEQ ID NO: 60763 - DNA, 421 bp, Triticum aestivum
  Clone ID: PAT_TA_60763
caataagttaccaataagatatccccaacattggttgtatgaatgatacacttggtgctttgattgtattcttttgtgaaagattcagatttattataaaagtttattaaaagtacaaagcacctcaaacacaattaaaaatatgtcgaggtctctaaacaaccaaacgaccattaccgccgccggaatggtctgccgacgcgtctgtgtcgccactcgtctaccgaagccggcttgaccttgtcgatgacagccggaaagtcttcgtgcacgtgttcgtaaggacctgcgccctggagccgcaggcattgccgttgaacccacaaatagatttgaatcagctgacaccaaatatcaccgttgtgcaagcacaatgagaaatcctaacctcaccattccaagaagacaacatgaatccaca

SEQ ID NO: 60764 - DNA, 394 bp, Triticum aestivum
  Clone ID: PAT_TA_60764
ggtaatgtgacagttgaaggcgtgcctcgcggggacgacatgtcgataccgtgtcatgcgggagaatgctatgaagagtgcatctcattctacaccggcctggtgtgtggaaagtgcatgttgaagccgcttctcgtagctgtgctcgatgaagtatgttggtcggcagtctagctaatcgtacagggcgatgacatggtgtgcatgtagtcaaatggtggtgtagatgcagatgcagttgcagatcggtctgtgaggtcgttcatcttgatgtatatggcagttggctatcgtagcccatctggtcgtgcgtaccggtcgtgtagtcatcgtcgatgcacagagtccaagtcatgttgcatgtatcacctcgtaggagattgattcatgtgga

SEQ ID NO: 60765 - DNA, 418 bp, Triticum aestivum
  Clone ID: PAT_TA_60765
gagaagacgacagaagggctcaccatcataagaggaagcatgggtctcacgagtcccgcaactggtagtcaaacccatacctttaaatcttgcctcatattcaaagacttgattttggagatcatagatttgtctttgcagaaagttgatttgctcgttgagggtgaagacgacgtccttcatggactggccatccaccttgtgatcacgggtgaaatatgtaatcatgaggtgattggcgttgagtccgcgctccaccatccccttgcacttggagacctcctgctccatggcttcaagcctggcctccacggtccccttccccttgggcccctggatgtctcggatgtggagcaccccctcatgcatctcaatggcttgagcgtggtgataatcccaagtgcaaggaatcatcgta

SEQ ID NO: 60766 - DNA, 417 bp, Triticum aestivum
  Clone ID: PAT_TA_60766
ccatttgattaacccccacattatactttcttccccatcttgctcgttctccattggatagaacacatcgttgaccctcccgctgttgcgccgtcgcgcacaaccgtagcctcaacattggaatcaccccaacgtgctctagttgtagccttcgccagttctagcaccttcccgaggctgcttaccgccggggatgaagcatcctcaatcaacagttctagaaacccatcttaccggttccaacaaattactttaccacctctagcacctccatcgcaaattggtcactaccaaggatgtagcatgccaaattcattttctatttttcaagtgcccaaaatgagtttttgtgaataacctagcaaataattgtcacaaaattggaccacgtcaattttataaaatactacgccatat

SEQ ID NO: 60767 - DNA, 399 bp, Triticum aestivum
  Clone ID: PAT_TA_60767
gcatcgcggagtcgtggctggtgtggcaaccgacgaggttgctcaagcaaggcggtagccctttgtgccgttgttgaggtagccgagagcgtgggtggaggagccgtggtcgaggtatccatgcgaagaatgtcatggtcgatgtcgagttggggtagccggtgtcgaggaagtcgccgtggagccgcgggcgcaaagaggcgccgagttagtcatgggcgcagtagtggtgcaccggggagaagacgttgttgacgacgcgttgcgccggggttgccaagagcggggacatatcgtagacgaaggcatgcaccagtggtgccagcaccgggcatgcgtagatggacgaagacgaagttgacgaagcgccgcaccagacttgccaggcccggggacacg

SEQ ID NO: 60768 - DNA, 243 bp, Triticum aestivum
  Clone ID: PAT_TA_60768
acaacccaccacggcgcgcctaccccccaggcgcgtccaggtgggttgtccccacttgttgtccccaataaccctgaagccaacgctaagatcattaccatgcgatcatacctccgggtgacaaggaatggaggtattaatgttgttcctaatgataagaatggattgattccacaaagaattgttacaggttataggatggtaattgattttcgtaaaacaaaaaatcaaaaaaaataaaaa

SEQ ID NO: 60769 - DNA, 401 bp, Triticum aestivum
  Clone ID: PAT_TA_60769
cgatcttcccacaacgtttgcctccgccgccgcgctccggccgtcatccaccactagcttttgtccacaccgccgcggcggccaccaacgaccactttggcctaatcatggtccgcctgcgcttcatgtccgatcaagcttttccaataatgttcggcaccgcgacaaccaccatgaccaggtttggcctgatccttgtcggcgtacacctcttatctttgagagggcccaacagggcgttttaattcgttctacaactcacttctgttagttggctctcaagatgcttattgattttcgtagcctaggggtgtataaattggtcaaactgtgtttaaagaggcgaggttttactatttaattttctaacgatcctatactataacagaagtggatggtag

SEQ ID NO: 60770 - DNA, 332 bp, Triticum aestivum
  Clone ID: PAT_TA_60770
acatttataacgagacgcatttgacggcacatcataacgggaagcagacacggcacattaagtcatcgagtttggaatcaatagtctgctttgctccggctttactcacgctaggactacggtgatggtagaagtactaacaatgcatgcatggtgatagagatattaatttaaacttacaatggaatgtctcgtactcaaagcctatctcctaatattgtagtctatactattacaataggctagggcacatttagatgtgtcataactattgcacatctaatatgcgacctaatcaggcataaattgattaagacagaacagagatttac

SEQ ID NO: 60771 - DNA, 174 bp, Triticum aestivum
  Clone ID: PAT_TA_60771
tcccgggtcgacgaactgggagtctgcccgtgtgtagattgataggtgttgtcgtttgttgcaattcgtgtcactttgaactggtttttcgatctgtggcatcatatccatcctgtcatgttcgttcaatgtgttttctgatgtctacgattgaattttcattttgcttcctgc

SEQ ID NO: 60772 - DNA, 330 bp, Triticum aestivum
  Clone ID: PAT_TA_60772
atagacagaaactacaagcgttgaggctccagtgagagagggcgagagagtgagcgaatacgctaactagctacacaaccctcccgttatattcaacgagagggaaataaccttttatgcattcctgcattcgtgtgacaagcatggtgtttttttttgtgtgtgcgggagtcattgggatttcaatcataatcgtgtcatgtggctttggtggtaagactatccacagtggtgcagaaataatgcagccttagtcaccttatctctctccacgtattacgttgggtcccaccagtcagatggcatacaacgacttcggataaacatcaa

SEQ ID NO: 60773 - DNA, 416 bp, Triticum aestivum
  Clone ID: PAT_TA_60773
caggtccaactgctgtgacagttgtacgtctggttggagtggctgagtatttaaactcgaggacacacagtcctcaccgtattctccttgagctaagatcacgcaaatctcgcccaacagtactggtaagtcttcacaggtgacttccaaaccttcacagacttggtcacccagcaatccacaattcctcttggatgctcagaccatgacacctaaccgtctggaggatacacaatcctcaaaggtaacaagtgtcggttccacacaagaacaatctcttcattgatgctcaatcactttggggtttgtaggtttgggttgaggatttgggtatttcctcacttgatgattttcgctcaaagtcctcggaggattggatgctctcaaatgacaagtgtcagtttctctcggagcag

SEQ ID NO: 60774 - DNA, 427 bp, Triticum aestivum
  Clone ID: PAT_TA_60774
ggtgtggcaaacgccactttgacggtcgagtcggcgcgggataacctcgagcgtctcatcggcaaggagaagaatcaggacgacgagaaggtcttcatccagtcattcctcgcgttttgctttggtaagacccacattcttaacaaagtactaaactttttttctttctttttagttgttggatctgcttccacttttgaatgttgtgtttagatctcattgtttgccaccctagttcaatagaaccatagatttttggctagcgatggctctgtcatacgttattccttttaagtagtttttttataaggcataatttttcaatatagtggcatatagttgggtacatatggcttcacaatacgtctttctcataagaaaattttatcataggctaacatagtgcaatagaacagtttgctatttt

SEQ ID NO: 60775 - DNA, 418 bp, Triticum aestivum
  Clone ID: PAT_TA_60775
gagatgtttgcgcgatgatggcctcgggagggccatgacacggtgcaggcagggagcatatcaggatactgctgctcgcgtgctccagcgcaggcggagctagcagcgaggaggagaagggagttggggcgctccggaggagaacgaagggaggcggcgcacgataggaacgagagggagatcgagagaaggaggagggttcgagcgcacgggatgggatcgggctcctccctgacggcgctagcagtgaacgggagatgaagaggggatcgggatacggcggctagagttgagaaggcgggggtcggctgcgcctaaagtaacaaatgggccagaagaagaggttgggaggcccaggtggccagaggcctggttgggctctctctccgttattccttttagaaaaaaaattgtttat

SEQ ID NO: 60776 - DNA, 412 bp, Triticum aestivum
  Clone ID: PAT_TA_60776
ctagccatgaaagtcgctgctacttagtcgccgttcggtgggtgggcgccctgagttgaggaggtggacatcgtcgatggatgcatatttcttcttgcctcctgttaccaacactgcatcgcctcgtggccttaatgttttattagtgtatggcacttttattccagtcgtaacattttttcaaaataaaatgagatcaacccggctagactagcctgttggcatttttatagaagaaaactccgtgagcaccaagcgctcgagctgagactcgaacccttgtgggctggctatgaactcccgcaccttgtcatgaggtggggccgcagttgagcaaaccgaccatcggcaaatccccaacccgcccaccgcacgtcggctgagttagaattagaagagagaaatgagagag

SEQ ID NO: 60777 - DNA, 416 bp, Triticum aestivum
  Clone ID: PAT_TA_60777
ccgagcactattttgatggtgtcctggaggggtcccgcctcgcggcggagcaatgttcgaaggatattatattcccataagaacatgtgtattgtcttgccctataatatggaacaaagatgttatgtattataatgtttatgattttaaatttcacctcctatgtggccgtttattaatctgagggatgaccagtcgtcggcttctgcccccacgtagatagtacggggggtgttcgggataaatccaaacactctttactccacattctagtccttaaaggaggtgtttagcgaagcgaacaaggcaatcagactatgcggcctttaccgcccccacttagccataggagtttgacaattaataaagttggcgaagcccctggtgttcggaaggccgaattacgggtgctatac

SEQ ID NO: 60778 - DNA, 183 bp, Triticum aestivum
  Clone ID: PAT_TA_60778
ggcgtgcaagcggattcatacctcttctacagtgtacactacattcagctcatcggacgtcgcattacaatttcattcatgggacgtccctgtagatactcatcatagtcaccatgctgcagatccccctttcactagctgtggtacaaatcaccctgtccgcacctatcgtccttcccaaca

SEQ ID NO: 60779 - DNA, 334 bp, Triticum aestivum
  Clone ID: PAT_TA_60779
acggctgcgagaagacgacagaagggaagggcgtcaagttcgcgcaggaaagctaggctgcaacctgctcagcctataacaatcggttcacacttgaactcatgcaaatttttgttcgaccgctttcgttgcccccaaacccgggtgtgccgcggggcatcgaggcgtcgccgtgctccacaataaaatgtactactggctttgatgtcccgccagactgaactgaacctgtcgtaccagaaacagcagacaccggtgcctatgtgttcgtggcattcgtacccgagatcacgaagcgcggcaccgaagattctgcgggcaaaaaaaaaaatta

SEQ ID NO: 60780 - DNA, 270 bp, Triticum aestivum
  Clone ID: PAT_TA_60780
ccacgcgtcaggctgcttccgttatcataccaatcctcagctccaataggattctcaatttccgcacaattgcacggaattccgttgcagagcaaacactggggtgcattcttcacgggatttcttgtgatagttgccttaccgtggcgtccaatggacatcacttatcacacatgggtctaagcccatgatatcgttacatagctgcatcatccaaacttactttgggaaaattctttcagcattcagattccatctttgcccagttaa

SEQ ID NO: 60781 - DNA, 216 bp, Triticum aestivum
  Clone ID: PAT_TA_60781
ccacgcgtccggctgtctcgtgtacggacctggtggtacttccatcagcacacgaacaatcccagtcagtgagacggcactcatgggaaggatacccatgcagagactgagctggactgatgttgttactgactgcctgttcgccagttgacgccagatccgtgcccacattggccgatcagattcaagtgcaggacaagttcgatctgtctacga

SEQ ID NO: 60782 - DNA, 410 bp, Triticum aestivum
  Clone ID: PAT_TA_60782
ggagatctccgttgaattggccaattggccatgatgtgctcctcgactagtcatgcgtgccttgttgctgcaaaacggcatgcaaagcacatgttcctctattgtggataatgtatccggtgctctcagttttaggatgctatccatgttcccaacctaaaaatcatcataacttttgtaaagtagatcagcctaaatcatcataacttgcctcaagatcccagatgcatgctctgtcttcagcaaccagaaacagcaactcacctctgcaaagactgtcccttcacggtcgcggtttggaaccaggtgaactcttggactaacgaaggcgttccaatctcgggcttcctcccggagccaggaaatgtgtctgactggtgggacaagactctgaattcccagtccaagca

SEQ ID NO: 60783 - DNA, 238 bp, Triticum aestivum
  Clone ID: PAT_TA_60783
acgttcctgctgagtgtcgatgagggcgctgcaagagccggtaattccaacatgatcagatgggtcactggggatacgggtggcctctttaccaccgtgaaggatggggagtttatcactgggaatgctcaccatctgatagaccttgctagtcaagatatcaagaacaatgtccaacacgttgccaacaggcgtggtaagcacactagcaatcgtgatatgcatagatctgcagcta

SEQ ID NO: 60784 - DNA, 374 bp, Triticum aestivum
  Clone ID: PAT_TA_60784
gacgactgcgtcctggccagggtgccatctggcagggacatcactgcacttgaccagcagatcaagaacctcctcagcccgtccacaccgtttttcttcaacaccgtgtatgacccctaacgtgaacgagcagacattgtccgtggataccacttcagacttaaggaaggtgcacctactgcggtctctcatggcctttggctgaacatccctgactaagatgcacccacagagatggacattcctcgcaatacgaacagcatgtacattgatgacgtcctgaatattcccatgggaacactgttccgcatgtgtggcaggaacctcgccgttgaccgtcagctcattggccctgcaatgtacattggtcgcat

SEQ ID NO: 60785 - DNA, 428 bp, Triticum aestivum
  Clone ID: PAT_TA_60785
tcacacagaaaacgattgctatctcatcgaaacatcgggacacctttgcccctatcaagtgatatcagatttccaggttgctcagtgagattttacagtttttcgtagtttagatcgagtttgttcttcatacctatagtccacgaaaaaggcaaaaaaaattagggttagttcatcttatccgaaccaatctgagcctttgcataatctttttggcctttgctttgttgaatttgccagtgcatcatcgtgtcaagttgctggtcctagagtctagccctttagagttttgagttctgctcacaagttgtcacgtcgccgccgcaccatcgtcatcacagctgccatataccaccatcgtcatcgccgctcccatataccacatatccaccgcttatccgccaccgcttcgaatccgtatccatata

SEQ ID NO: 60786 - DNA, 318 bp, Triticum aestivum
  Clone ID: PAT_TA_60786
ccacgcgtcaggtggcatccgttcacagcccattccccagctcgaaaaggtttctcagtgtccgtatagttgcgctggtttcaggctcctattactagctggtaaggcagtcttctcccgtgaacctcgattggattttcacgttatgatcttgcacagtattgcagataatatgtagtctatccaaacaatgctgagatgatctacgggattaactcataagacatgtgtgggatatagtattgtcgtcatataggatttggacacacatatgatacgatattacaacttagtacgtccattgacacaccttagtcc

SEQ ID NO: 60787 - DNA, 262 bp, Triticum aestivum
  Clone ID: PAT_TA_60787
aggcatggacgacggggatgtcgagattccctccgcttaaagacctgatgtcgaggtgatgatcatctctgatgtgatggaagtcatagcatgttgggtatgtagggtccaggcgatgtgatccctcggcgttttgggaggttttagcgttgtgcatgtgagacgtcattggtactagtgcataggtggtctttgcaatgtagacggtgcacttgggtatagttaatccaaaccagtcagtggtttgaatatcgtctgtgat

SEQ ID NO: 60788 - DNA, 436 bp, Triticum aestivum
  Clone ID: PAT_TA_60788
cacgcggctgcgagaagacgacagaagggtccattatccaaacactgttgtatgggtaatgtcatgaaatttctctccccttacctaaagggtttttgtacattatatcctgtcatgggtatcctgctctgcttgtccttgggaaggatatacccctaaaatatgtgtttaaacacattttccctttcattgttctgtttaatctgataatcactttttcctttcccttgacttgtttaacctttctcatgggttatatgatctaagcagtaataattcggtgcttatgtaaacaccctggtgtacaaccttgtcagtaagaccgtgttactattgttgatgacatttcggtaaccaccgatggacgagaactttgcctattggtccacctcgtttcaacgagcaggaaaatggttcccttcgtcactcgcccttg

SEQ ID NO: 60789 - DNA, 273 bp, Triticum aestivum
  Clone ID: PAT_TA_60789
cggtccgagcttcccggggtcacatctatttgaaaaataagggggaaaatacaaaggaaaggagaagaagaaaaacacatgaaagtttctaaaactggtccaaaacagtccatgaccttcccgaaagagctttgcaacttgctatctagcttggaggcggcttgccctcggtctggtaaggtgattgcgtgcatcttgagtgagaaggttaacaaaagacaagatcaagaaggtgatgaagtctctcaaaaaaaaaacaaaaaaaaacaaaaa

SEQ ID NO: 60790 - DNA, 332 bp, Triticum aestivum
  Clone ID: PAT_TA_60790
attcatcgtccacatgtggcatcagagtggatatccccgagttccttcggtggataggaccttctcgcttctcgggaatttgactcttctccaaaggtccctttcttacataatgcctgttgagactcgccccgcgtacattatatgccctcttgtaagatatcagaattgttcagtctagctgttttccgatgaggttttacttttttgtactttgttagatctatctgtgctttatcctggaatgctactggcaataatgtgtagctgtgaacatatcaatgttgtataaaatgttctgccttgagaaaaccttgcagcagggatttttg

SEQ ID NO: 60791 - DNA, 437 bp, Triticum aestivum
  Clone ID: PAT_TA_60791
gggaccacgctgcgacaagacgacagaaggagaacaaagtcatagccatgccagctctggagcatctaggtcgggcgtgagttgtgtgttggggttggacatgcaattgggctgagcaaattgggtgtcggtgttcgaggtgtattcggttgggtgcgtatgtcaaagatggacatacacctaggtcaaacgggttgtgtgttagagttggacaaacaactatatgcatataccgggtcgagcacgagttgcgtgtcaaaagtggacatgcaactagatcggacatgagttgcgtgctaatattgaacgcgcaactaagtaagggtccggggaatttgatgatagacatgtaactgacaccaccacaaaataaagaatttaaaaaatcatgaatgttttgaacacagcccagcttcttcaattctgcccgtacaaaa

SEQ ID NO: 60792 - DNA, 427 bp, Triticum aestivum
  Clone ID: PAT_TA_60792
gggaccacctgcgagacgacgacagaagggcaaccaagcccctcacatgacaaggccgagcattcaaaactctgagccggatgcatgtgtgcacctgtctcatttggccgaactagcctggtccaacacaaacggtgcggatggatgacccgagatcatgcggcacgtgccgcgcgtgagacggtgcatgtaggggcgatgaaaagcaccacataaagctgtgccgagcgcgcccgcggcccatgtatcatggagcttgaggaaaatcggtcgggtgtgaggcagcctcaatgattggacgacatggagcgtgcccgggaggcatcggcgggaggcgcgtgtgaaacggacaacatggattcactctcacgtctcacgtggcgatgccccaaaaggtgggtacttcaacatcctttacataagtaac

SEQ ID NO: 60793 - DNA, 380 bp, Triticum aestivum
  Clone ID: PAT_TA_60793
ctgctggaagagggccagttcttagcactcagccggtccgccatctaccagcagggtttgcgccattaccacaaccggaaggtcaagccaagatccttccaagaaggcgatcttgtgctccggctgatccagcgaacagccggccagcacaagctctcggcccattgggaaggccccttcgtcatcagcaaggccctaggcaacgattcctaatacctgatcgacgcacagaagccgaaggcacgcaagagggatgattctggcaaggagtcggaacgaccatggaacgccaatctcctaagaagattttacagttaaaagcagtatgtaccacgctaccttttgtattaagtacaagacaacggggcccccgaggtgca

SEQ ID NO: 60794 - DNA, 410 bp, Triticum aestivum
  Clone ID: PAT_TA_60794
ggctgcgagaagacgacagaagggcatatatcacaaagataacactgtgtaaaaattgttcagcagatattatgaaatgttcaatgtatcacgttttaaaagtttgttagagtttcaaatttgttcaagaaaacatttttcattttttaaagaagattaaaaaactggatctgccgctattgaaagtactttaatttagcgttgtaattgaagacaaacgtagtcgctacctgcaaggctgcaacggctggcaacgattctatccagcgtatggtcacgggtttgaatccatccgtcgctgcaatttttcgtgacattttctattatgttcgcttgtcgcctggtaaagggccggcccgtttgcgcgaatcctgcagcgaaaggtgttcattttgacgctcacgagtgtc

SEQ ID NO: 60795 - DNA, 322 bp, Triticum aestivum
  Clone ID: PAT_TA_60795
ccgagccggacagtaagcttgtgccaagcccctcctggcgtcttagtcagtgagtgagcaggctctgctaggctcagataaagggcgagacaaagcaaagctcggagctgagacgacgcgggtcgtgtacagccatatccatgtcaccggcagcgaatctacttcaagtttactagtggttggggcgtcaccctgtggcaccgcttgaaaggaagcagtgcgcatgttttcatttaagaaatcataaagtcctcgcctccatctaaaagacatctcaaaaaatcctcagcttcatcagaaaacaagggacatttagctgaga

SEQ ID NO: 60796 - DNA, 309 bp, Triticum aestivum
  Clone ID: PAT_TA_60796
tcgtgggtcgacgtcattccctaaagtgagtcgtaatacattccattcttgaaggacatttagagacgcacacacatcttcaacacggcggcggcgatgctcaattctgaatcgtgtcatgctctacatttatagccttctgctgaccgcaaagggtatgtttattggagcaacttgaaaatggatgcaccttccctcaacccccgattcccctataggtttgctgcgtgatttgatttgtaatggtgtttgttgcttaaggttcagatgaatattcaggccgaaaaaaaagagcggagagacaaagaa

SEQ ID NO: 60797 - DNA, 182 bp, Triticum aestivum
  Clone ID: PAT_TA_60797
cggcctgaccttgtcgatgacaaccaggacgtcttcatgcatgtgcccctaaggacctgcgttcgggagccgcaatcgtcggcattgagtctttaaatcactattgagaacctgacaccagatcgcactattgcattcacacgatgagaagacctacgttgtttcaagaagatgggcagatt

SEQ ID NO: 60798 - DNA, 189 bp, Triticum aestivum
  Clone ID: PAT_TA_60798
gaggtgaccgaaaacgacatcagggtcatgaaagttagtcctttcgcctactgaagcactggcatcatcaaggccatacacttagaccgccatcaatgaggcaaatatggacacacctacgtcgactgcacatccatgattctcggaggcgtgcgtttgcactgcactttaacctaccgacccgttttc

SEQ ID NO: 60799 - DNA, 407 bp, Triticum aestivum
  Clone ID: PAT_TA_60799
cgtcagcgtcggcagtggcatttcatggaacaacttgcacgcgccggtaaggttggccgtaggaatcgacccgggatacgcctccacgaatatattccgaatataaatgaaaaaatttcacaaatatattctcatcactcccatcctactaacactcaacatatcgtgatttccttaagcttgtgaccctgtaggttcggtaatccatagacatgaatgaaaccgttcgttcaatgaccgacatcgggatatggacgtccatatcgatccctatgatcacacaaatgatattcgagtgaacctatggttatcatgtgatgttccctttacttcacgatacttcacaaaacccgggatgcatcgatatcctcttgagtcatcacaatgctcactatactgaaatcctc

SEQ ID NO: 60800 - DNA, 434 bp, Triticum aestivum
  Clone ID: PAT_TA_60800
gcccttgaagatcccgctgggtgacaacagaagttttttgcttatcgtcttctatctgagtgctctaggttcatgttgggagtctttttcttttgaaaactgttggtgttgtggactgtgcctgatgatggcgtacgtaatatgtgcggtacctgtttaggtgctcgcagtgcagatttgggtgacattcaagttttcgccccatgatctgccgttcctgatgacgggcgcacatagtgggtttcttgttattgctctgaactcgcgtttactctttctctagtcctgatagtttcagttcctgagacagtgtatttccgttatgaaagtaatggaaagaggaaaatccggttcgacaaagacgtctatggtgttggctggggagcctttatatttgccagctttctttaccggtttgttcgcaaagcgatttc

SEQ ID NO: 60801 - DNA, 351 bp, Triticum aestivum
  unsure (1)..(351): unsure at all n locations
  Clone ID: PAT_TA_60801
gatgagggcgccgtctctcctcctcgcagcacaacagtggttagcaaatcactgcacactgcagcaagaacacacacatcacaaaaacagctagcacaccaataaaacacaaccaccaagcaccacaggagtagtagcgagcatctatataggcacatggtcacacagcagcagcaagcaagcaatagcacaagatggaaggcacaagcaaaggaaggagggcgggcagaggaactacctgagggaggagctcggggagtcggggtggaggaaggggagcacatcctccctcggatatgccggggaaggccgtaggcagcgaagatggaggagcggagtaccttaggtang

SEQ ID NO: 60802 - DNA, 418 bp, Triticum aestivum
  Clone ID: PAT_TA_60802
catctcatcaatgggaactgcatcagtgccaagtgcaagcatcctcatagcagccatgcacttctgcttggcagagaaagagagttgtccgcagcaatcccttgtgagcttgaagtagtcgtcctatgcgtctactccctctacaatgcgcacaaatagtggtttccacatgtgaaaacggtgacgaaaccatggatcatctgggaaagtaggattgggagcaaaagagtccctgtgcggtagctttgctccagacactctatcccggttgaccactcgtctccctttgattgagcccttgaagttgagaatatgccccacttgccgttccatttcctctttcatgctcatgagcatgaccatgtccacttcttcgtccgaataagaggaatccactaactcatcttgaaacatttga

SEQ ID NO: 60803 - DNA, 187 bp, Triticum aestivum
  Clone ID: PAT_TA_60803
ccgcggctaagtgttccgacttggaaaaggtcgtcaccaggattattggcgtctcgacctcggtttcggaagcagtaaattcagctgggattagtctttctccggcgacaactgtaacactatcatgcaatatttcatgaagatcacatgagttgtgaatttagtacaatttaatcgctaggtttct

SEQ ID NO: 60804 - DNA, 198 bp, Triticum aestivum
  Clone ID: PAT_TA_60804
atagtgagtcgtattacaaccggtcaggctagcagcgtgcaagtgtgacctgagtgggtctggttaagtgtgtggcgttgtgtgtttgtgtgtatggactaggtggtcctggcttgggggcagatctgaacagaagaggaaatagacggaaccgtctgaatcccagagacacggtaagacgttggagggaaatagagg

SEQ ID NO: 60805 - DNA, 408 bp, Triticum aestivum
  Clone ID: PAT_TA_60805
gcggccgcttattgtttttcttttttttttttttttttcaactcagttcaattcagataccagcacatatcatcagcacatttataacagcacatatcagcagcacatagcatcgaacagtaattgcagaagcatcatcacacagaagtctctaaaggatcatcatcacaaccaacataggcataagcacaagcatatagaaaagcaccacacacaagtctctaactggccatcaccacacacaagtcatctcaagcatcatcaccacactcagggcttaagcgccacgacgtccagcactgcggaggtcgtcaccgccaagaccgccgaagcccaggtcgtcactgctagcggcaacgctaccgccaagaccgcctccacctccgccttcgcctccgcctccgtgga

SEQ ID NO: 60806 - DNA, 355 bp, Triticum aestivum
  Clone ID: PAT_TA_60806
ggctcatcgccatgtgctcgatttcagataggtcccacgcactcactcccgtgtatgaggctgctacaagatctggcactgaagatcaaccatccccttctccaaaaactgattcagaagagtccgataccaaggatgtggtcttaccaggagtcaatctcatatttgatggcgctcagctgcacccgttcgacattggcgcttgcctccacgcccgccaacccttgtcattgataactgatgcgtcggacgcgtcattggccatgacatgactgatatgcatctcagcacgttgccatcacaatttctgttccgtttaatctatgtgcggaattgaatattggtgtagacgact

SEQ ID NO: 60807 - DNA, 370 bp, Triticum aestivum
  Clone ID: PAT_TA_60807
cggctgcgagaagacgacacaagggggagaaaggttggaccccgagcctatttataaggaaaatggataaggcaggcgcggggatcgaggagcctgaagcggcgaaagagggcgtagttgtcacctcgatcttcaggataacattaatgaagggaatctttttaatcattttagatagagatgagttcatgataatccgttgctgtgtccagaggatgacgtcacggcagtttaacaaaatttacaggagaagacatcatggtggtttacgagaaatataacgagatgttcacataatttctttaagtattgaagattgacatgaatacgttcaaatcaatttggagcctaatgttggggatataactac

SEQ ID NO: 60808 - DNA, 361 bp, Triticum aestivum
  Clone ID: PAT_TA_60808
gcagtggagttcttttgagcacaagagggcgatccctaaggttaagctgttctgatagcaataccttacacctgaacatccggtggacattatcgatcaacgacgacaactggtgaaagtacatatggtggctgacttaggcattatggatttaagactccggctatggcatggcgaagtcatacccagcagctacatcgggcttgtcaaccggatgatcaatacccacctgatcttgatcgtcatggcttgcatcaagatcacctcacgatgtacatctgccatgatcactcagcctcgtctcgatcctgacaagtgatgtctcccctgacgacaccttgcgtcttctgccccgccaagc

SEQ ID NO: 60809 - DNA, 419 bp, Triticum aestivum
  Clone ID: PAT_TA_60809
gcgtccaggcaacgttcggtgcttgccgtgttcctcccgagcttgccgtccatggaggacggcagcagatagaagtggatctggcaggagctctccctctccaataagcctgttatcttccctgatctggagggcaaccatctgctgttgcttgctttttcaggccatcgtgggggtggatgaggagcaaagaagatgcagaaatctaaagcctgcagatcgagttcaagcttatcagcagaggattccatggtggagctacggcgcccttggctggctggcggtcttcaccggtgctctgcttcttctggccgaagggcgaccgactttattcctcccggcttgcgtgtcttatgggaggcagtttcagctgcaactcggaggccatgcggagcaggttatgcttctatggcgatttc

SEQ ID NO: 60810 - DNA, 320 bp, Triticum aestivum
  Clone ID: PAT_TA_60810
caggtggcgctgcgccgaggtgctgaggctatgcaactaggctgtgatgagcatgcgacaagtacaggtcatcgattcgttaagacctcaggtgcgattgggatgcaaatcaactcattgccatctcgtgcacacacagctttgcatcacaaaatactcagtgtcgtagaagttaattgtagtcatagattcgacacatttgtacatccaaacaggtatgtgtgtcaataggtgttcctttcatcgcttgatatgaggatgatctacgtcaagggaggttacgtacttgagaagtctgcttctaccgacaaaaagtagtc

SEQ ID NO: 60811 - DNA, 324 bp, Triticum aestivum
  Clone ID: PAT_TA_60811
ttcacgggtccaccattaactcagcaaaaatatgttaaggaacatttaaactcttatagtacatcagtactaataattctcactaatcagtacaaggcagagtaaccaaacacacccgtgaacacctcaaaaaacatcgtttcaaaaacaaggtatgtctggttatgccagtcctagttcagaaagtccatcagtacataaaaataattacctcaagcaaatagaaaataatgaaagtgcaaatataatacacctgtactgatgacaaactaatttatctgtaaaaatactttcaaagattatgttgatataaacaatcctttc

SEQ ID NO: 60812 - DNA, 238 bp, Triticum aestivum
  Clone ID: PAT_TA_60812
accctcgcggacggctcggcctcctcgtctatctgcgtgctcgcacatagagtcactccgtccgaaattacatattgcagacatatatgtatttagacatattttaattctatacacatccatttttatccatttctgcaacaactaattcgagacggagatgagtacatgataaaagtttagatgcatgaagcagtatataatgctccaattctcactccattcgtacacataaatc

SEQ ID NO: 60813 - DNA, 432 bp, Triticum aestivum
  unsure (1)..(432): unsure at all n locations
  Clone ID: PAT_TA_60813
caattgatggaaaagcgaataattatgagattatctaggcatgatcatgtatataggcatcacgtccgcaacaagtagaccgactcctgcctgcatctactactattactccacacatcgaccgactcctgcctacatctagagtattaagttcataagaacagagtaatgcattaagcaaggtgacatgatgtagaggtatagactcaagcaatatgatataaactccatcttgttatactcgatggcaacaatacaatacatgccttgcaaccctttctgtcacttggtaaggacaccgcaagattgaacccaaagctaagcacttctcccatggcaagaaagatcaatctagtaggccaaaccaaactgataattcgaagagacttgcananggtactcaatcatacataanagaattcagagaagatc

SEQ ID NO: 60814 - DNA, 229 bp, Triticum aestivum
  Clone ID: PAT_TA_60814
gctgcgagaagacgacagaagggtacggctgcgagaagacgacagaagggtacggctgcgagaagacgacagaagggtacggctgcgagaagacgacagaagggggaatccgcaagttgagtgccaaaacatatagcaagtgaatcaatatgataccccattatcaccatgagtattcatatgcaagacatacatcaagcgttctcaaatccataaaagtattcaatcc

SEQ ID NO: 60815 - DNA, 434 bp, Triticum aestivum
  Clone ID: PAT_TA_60815
ccctgaatctcgaggacgagattttttcaagtgggggcgagttgtcacatccctagtctggtatgatctagactagctagtcatgtgtgcatcatgtttaaatttcatttaattctgaaatgaggatttgtgaaaccctcaggatcatctctgaaaatgacccaaataaaaattgttccaaaaaggtccaagaaaatgctcatgttgctctctgaaaatattggacagagataaaaatgaaaccaatatttttagtagctcataagtctttattttgggcatttggaattaatgcataattatttgcatttgatatatatttgttatatacataatatatgtccaaaaattatgccatttataaaggagctctggaatatataactagcctccataaaaattggcataagaaaataaaatgggttagtattttt

SEQ ID NO: 60816 - DNA, 404 bp, Triticum aestivum
  unsure (1)..(404): unsure at all n locations
  Clone ID: PAT_TA_60816
gcgaggcctcggattgatgttgtgaagcgcttggcctgcatagagggtgcccagatggccttcgcccgtgtcaagatgcaattggaaaagatgaaggccaccgaagtggcaaccacaggcccgcccgaaggcaaagatcatcgaaagccggagaggtacttcgatgacgtcctagaaggagcctgagtgataaagggtcaatgttctaaggacgtaatatttgattgaatgttttcaggttgtacaaactttgtcatgaacccatgttgttatatatctatgtttgcgccttttgttcaagcgatttttcctcctgtgcggccatttattgtactacatgggtgtttgacataacgcgtgaccacactttatccaacgtcttggtccgtaaaggangtgtccgc

SEQ ID NO: 60817 - DNA, 381 bp, Triticum aestivum
  unsure (1)..(381): unsure at all n locations
  Clone ID: PAT_TA_60817
ggtcgtcgagaggttcgtggactggatggtgtcgtggctgctgatgtacggagaggcgaagctgctgctcgtcatctacctctggcaccccagcacacggggtgcggggcatgtgtacgatggcttcctccatctgttggtggcgttacacgaggccgacatcgaccggggcctgcttgagctgatggctanggcgagggacgtgacgacgtcacaactcaaggcggtggctgccatcggtcaagtgtggctagtcgaggctgcccgctgtgtttcgttgcagttgcaggccgcgagatcaggccgggaaggcgccacgcattgacgagtgaaccaatttttggatcggaccataacaacgtgtctcaatcctctgactct

SEQ ID NO: 60818 - DNA, 371 bp, Triticum aestivum
  Clone ID: PAT_TA_60818
caaggagacgccgttcaggtacatggagtggtcgatagcgatcccaatagtggcgtacgatatgtatcacgcggtgcatcaaacatttgaaactgtggcactttcgcagtggtcaagagcggggtacgtgttaatggatccacttctcgtcgtcgtctcgcttaacggtgttacgttaccgcgcaagaagattgtcggtcacccatgactacatcacatctgtgacgcccactatatcagtcatggaaatggacatctctatgagtcgaattatggtatcgtcactgggaacttccaggacagcacacgtataactatcttgcatcagacataccatcctcaagcatgtatatgcatgacaaggcctgcaa

SEQ ID NO: 60819 - DNA, 434 bp, Triticum aestivum
  Clone ID: PAT_TA_60819
cgtatatgtcaattctgtattggttctaggcaagtaggttgacatgttcatctgttatcatgagtgtcgtgtttacacttgcagttcagatattacgcttaagctaaaggtctgattgtactgtctagaggtggaatggctaagctctctttatggtcctttttgttgaatatcttgcaaatggcacactaaagtgcaggaaattattaggtgtgtgggtatcaatccagtatgttcttatgtctatggatccgggaaatgttcacgctttattggttttggtcaacaaaattttaggtgtacatgctttcatcttgaatatatgtaattcttaagtaatactacttctcggttaattcattgaagtaatgatacaatcaattggacgtttctctacagttatgcatctagcgggaaaattgttgttttcacat

SEQ ID NO: 60820 - DNA, 433 bp, Triticum aestivum
  Clone ID: PAT_TA_60820
cgctgcgagaagacgacagaagggtgactgtgaggagtgtctgagacacgtgcacagcttcaccggtgtcagttttacagggggtaccacaatgggggaggcggcgtctctatatacccgctatctctcgcgagaggggagagagcgttttgggagccgcatgtggacaagtttcaccgcgatgatgctcaccgcgatgagcacagatctcttctctgtgttggtatattatatgatctatatctacttgtgttgtgtggacacactcactacactcggtctcgagacatgtgttataatgtgctatctctgtgctctctcttaaatctcagactcttataatgagttgtgttctcagactcttatgaggagttgtattcacagactaaactcctatagtgttctatgagtctctggttgatgtgtgcggtct

SEQ ID NO: 60821 - DNA, 324 bp, Triticum aestivum
  Clone ID: PAT_TA_60821
gcctagagctctaaacctacgacatgacatggagcattgcactcggtggagttcaaggtctgagatgacagctgaggtcgatataaacaagtggactttgtaaacatgaaactgctacttttcttgcccattcttgttctgcgtatagcagctaaaaatggggatgggatgcaccttctttggtgcttatcaagaaaactcatcatggttgcacaacaggatggagccaaaggaaaatcaaccgccaggtttgatttgcatcactacttgctgctgaaaagctcatccttgatggcaaatggattctgaggattctggttgttt

SEQ ID NO: 60822 - DNA, 430 bp, Triticum aestivum
  Clone ID: PAT_TA_60822
gtcggggaagtagtcgtcgttggggaagtagtcgtcggagtccggggcgtccgtgatgaaggagtcagtagtcgcgcagagcgctccccaaaaaccttatcacccttctcctgtaccggacggaaagaggtgcgggtccggaggcctactgtcccgacctgtggtgcacgccgcaagccgggatgcgaaagatcgtagcagcagcgcagtgctcaggaaccggtggcgagaggaggaggtagttctggtgcgtctctctgagaggagcgacctcccttttataggcgcaagacaaggaggcgagaggctgcgccgggagcccaaggaaacacgggagaagagtgacctttcatagacccgtagtgcgttgaagaaatttagacatcggttcgttcccacaggcaagcggcggaagacgaacgcgccgtgg

SEQ ID NO: 60823 - DNA, 174 bp, Triticum aestivum
  Clone ID: PAT_TA_60823
attgccatttgcagccagccatgtttttcaaatccataggaatcctctcaatccatcggtatcgcacgccgcagccgaacttggctgtctcctgtggggggcatcaacagatccctcacaggtgtctttcccccttcggtcgtcttcgcgcaaccgtgtccacgctgacgcaca

SEQ ID NO: 60824 - DNA, 445 bp, Triticum aestivum
  Clone ID: PAT_TA_60824
ggcttgttgtggcggcaatagtggccgttcagtggtcttggaattttgatataacttttattgtgtttgagatgttttgtctttcgggagaactttttatcattttcaaaacaaaacaaaagaacagacttgaaaatttcttgtaaaaaatagccacttcacatgaaacttgcatggccttctggcacatatgtgaccatttcattccagttgagcttatgggctaggggagggaacagagagctcttattggatgcccccgtgcgtaacgctagatagcaacaaatccatattataagtgtcgtgccttgataagagccctgtatggacaatggacatttttgtaatatatgctgaccaatttttaactacacactgaatatttttgtgatatgcaatgaataatatttaaatacacattgaacatttctgtgatatacgctga

SEQ ID NO: 60825 - DNA, 436 bp, Triticum aestivum
  Clone ID: PAT_TA_60825
cggctgcgagaagacgacagaagggcctacaacacgctgaagatgcctgggccgatgaccgtcgtcaccgtcccctgcgacaagaaggatgcgttgatctgcgccgacctactcaaccaataggtcaaataccagatattcaacatgtccataaccagggacacgactaatcataattagtttatacactctgcagaggtttgcgctcttttccccacaagattcgatctcccccgttgaatttctcgcactgcctgatgtttgagaaatggatgatcgagacacagtctttctaaagaggtccccttaaccgatagataggccggtacacctacaatcccctacatctgctagcctatcatggaaaggtttcccacaacttactcaactatgccagagcccataatggcttgtggctgcacacggaagtttctag

SEQ ID NO: 60826 - DNA, 414 bp, Triticum aestivum
  unsure (1)..(414): unsure at all n locations
  Clone ID: PAT_TA_60826
gctgcgagaagacgacagaaggggttgcagcgtcttctgaaaaaaaatgtaaattatagcaacatgagtacaaaggtacccagcaagacttacatcagatcctacatacatgcatattatcaagaagggttggtggagttgttgcagcaagccagctttgactcttggctaggccaacctacgagactccaacttgaaatggttttgcgtacacgagtccactactcaccacttcaatacactaccgaggatccgcctccgtcttcctacggaagagccatcctcggcactcacacttatcttgaggcttttagtagtttccatttacttgtctatgaactgtataggcaaccaagtagtcctttaccgcggacgcggctattcgaatagatcatgataaccctgcanggggca

SEQ ID NO: 60827 - DNA, 381 bp, Triticum aestivum
  Clone ID: PAT_TA_60827
ctccgtgacgtgactcacatgctgtgtagcaccattcgacgggccgaccacacactgtcaggcacaattcactatgacacgacatggtatctcaaggatccgcctgccagtgagaaacccgcatgtttgcatgcgcgatagcactgtttccgagatccgttggtgcctcatctgggcacgcatgttacgtccagtggcatagataacgtcaactagccgcagtgaacggggaacgcgggaatgtttgtccgcttcataatgccagctacactgaccgtaaacgcgacatcatgactcattcagccagtcacgcagattgatttcccggacaatttcattgtgcagtactaaacgccaactgacttttatgacacaatataa

SEQ ID NO: 60828 - DNA, 211 bp, Triticum aestivum
  Clone ID: PAT_TA_60828
gtcatctttgcgttgatcttgtgatgagtctacaaataagcgttggccggtcgatgatagggtaggggaacgagttttatggatgaggtgatatacaagtagtatgtacgtacgtatggggttggaacaaaaacacgtaggagtatttccatacctaataaccgatcacgtacgtatctcttctaaaaaaaaaaaaaaaaaaacaagaaaa

SEQ ID NO: 60829 - DNA, 231 bp, Triticum aestivum
  Clone ID: PAT_TA_60829
ggcgacatagcaatgcttgtgttcctgcgtgttcacgttgctgtagtttggttatccatgttagaatcaactatctaccacctgctgggttcgcctgcttgcagtcggcctgatgtattgttgttaattttgatccgggcaaggtccctgatgctagtttgtgccccaggaggctgtaactttgctgatgtatggatggtttccaatgagtaatcacaatccgagcatccg

SEQ ID NO: 60830 - DNA, 431 bp, Triticum aestivum
  Clone ID: PAT_TA_60830
gagtgactagccacctaggtggtgatcctggccatggagggccctatgtagatagacaggcttcgagaagccttctttctttctagtgtctgtactcagactagttgcttccgcttgtgcttgtatgattgtatggcttgagtgtcgggtcttgtgacccctatctgtatgaacatgttatgtatggctctctggagcctttaaataaagtacttgagttgtagagttttgttgtgattccatgttgtatgtactcacatcgggcatagttgtttatccttggcagcctttcttatggggaaatgtagtctagtgttcctcgagccatagtagtccgctacaacccggttcaccggagtcctgcttgcctagcactactgctaaggacacttgactggccggcatgtgtttcacgtcactcctatgtctgt

SEQ ID NO: 60831 - DNA, 209 bp, Triticum aestivum
  Clone ID: PAT_TA_60831
cgccctccgtcacactctagtgccagcttcctccccgaccacgccgctgaccaccgttcgccacacctaatgctactcctcccggaccatgccgctgagcaccctccgccatcccaaccaccattcgccggacctctagcaacgcccaagaaacactaattaaaatgcaaaaacataatcataacagtagcataattgtgtgcacactc

SEQ ID NO: 60832 - DNA, 444 bp, Triticum aestivum
  Clone ID: PAT_TA_60832
ctcgtcggtttccttgttgggtctcacactcactctcacccggctgggtccgtaagtgaggtcgtggcccacgtgctagtgtcaccaccgttggggctgatcgatccgtccaaatccaaaacgctagcggacagcgctaccgtccaccgccgcagatcaaatctgtgctaggaaaatgcctgccccatctatgtgggtcggtcgccgggcgtggctgacagccccaccaataatgcatcccgaacttgattagactgcacaacgagtgagcagatactctccaaattcttgaatttcagggagctggtggattgccaaacaacccctgagattcaagctatttaatcaagctctcctcgttaaacaagtctggcggatcatcacggtcccgaactcgctatgtgctagagctctaaaggcacggcatttcccgggaaaagatat

SEQ ID NO: 60833 - DNA, 433 bp, Triticum aestivum
  Clone ID: PAT_TA_60833
catgcagaggtctgttctcccgaaatatccaccctttactctttcgtaagtacgatggagttcccgaagaaaggatgctgacttcatcatgatgacctgaaacagagaaatgaagacatcaacgtaatggatcgacctctttaagaagggcaaccaagactgagaagacctgttagaatttcgtaacaaaatcccttccccttactcccctcctaaatctcgggacgagatttcttgtagtggaggagaattgtgacgccctaataattaagctacagtaaacctttgttaatgatgccacgtcacctcggttacagttgctaatctcacgttagttcaaagtttgactcatattcaaatttgaattatagccaaacagtaaaggttttcaaatattaaaactaaaatgttcgggttgtgccaaataatgcat

SEQ ID NO: 60834 - DNA, 453 bp, Triticum aestivum
  Clone ID: PAT_TA_60834
cgcctgcaggtacggtcctacattcccgggccgctgcgagaagacaacagaagggtggttcggccctcgtaataccatgaccattagtccctggcccatgccaactttcaactttcaactttctaaaactaatggcactaacagaaagtttataattttgctccgcgcccctggcccatgaccattagtcctggtttgtgccacaaaccgggactaaagggttggtccttgttgcgggcagagtttagtcccacctcgccaaccgaagggggctcacaccagtttataagcccttccctctctgcctcattgagctcctctcaaagtgaaaatagatgccctaatagagaaaagtttaacctaaattcatagtgaatttctctgaaattcatagaaatttactaggaatttaggttgaattttctctataaacgcatccattcgcattttttt

SEQ ID NO: 60835 - DNA, 323 bp, Triticum aestivum
  Clone ID: PAT_TA_60835
cacggcattttcttcattttcatgctcgaccactataattttaattgtcacatcatatgcgtaaatcttggagcctcgtttgcatgtagttttcacctttatttgatacaccatgctgatatgcgatactccttggttgaattataccatgctcattgcacatcaattaaatcttttgagtatggctttagagaatgtgtcatgtgcttcacatagatcacatgaagtttggattgcctgtttctcctcacatagattgacaccatttgtacaatgcacgttttcatcacgtatatttgttagagcgtgcacatatcttctgt

SEQ ID NO: 60836 - DNA, 435 bp, Triticum aestivum
  Clone ID: PAT_TA_60836
cttgaactttgtgttcatgcccatggccccgaggtggaacttatcatggaagcttcttatagtaataataatcctcgtgtgataacttctcctcttatctatgcttggtccttttcaaccgtggttccgaccatgattgtttttctttggtcccatttctcggacaagttaaatcacttgtcttatgcagatcaatgtgcctgcccaacctcgattctgctcaaccctcgagtattcccctatggtatctcgagaatatcacggaactacataacatcttatgagttctccatcaagtactacattatcactgatttcaattttttcacgggctctgggtcattaaacactcaaggacactgataactgaatcgagtccgcatcgtgattacaactattagcaatcttctttacttacgagtttgtactcgatta

SEQ ID NO: 60837 - DNA, 433 bp, Triticum aestivum
  Clone ID: PAT_TA_60837
ggttcctcacaaacgcgacgttatcggaaccaacccgaagaagcaacaccgggaaagagcagacagcctagtaaacaaccatcacatagacatggcatgatgcgcaaacaagtatgatgtatgtcgagtttaaagagggcatggcatggcaaaatgcacaagcaatcctacaaattaagtcgagctcaatattaaatattgtaaaacatggcaagaggtgaagcataagtaaactaactatttaggcaagtttaaatgaggccggaaacaacaaacaacaattccggaaaatcctcgtgtgcatattttagatttggtactgttttgccctaaacacaattttaatgttgttaaacagcacaataaagtgtaccatgttaaactaggcatttttctaccccatttacatatataatttatttaaatccgagct

SEQ ID NO: 60838 - DNA, 196 bp, Triticum aestivum
  Clone ID: PAT_TA_60838
cagcttatacagatactctccatactaactggattttcgaattatcgacacatgccatggatatgatactagctaccacatcgattctgagcatggggggagtactgtggtcacacgagtatgtacttgtctccacgcataatgataaatgaataacaagaaaagtatacacaccataaaactcttcccacctcta

SEQ ID NO: 60839 - DNA, 441 bp, Triticum aestivum
  unsure (1)..(441): unsure at all n locations
  Clone ID: PAT_TA_60839
gccaacttatgacaccttagtggccgtaaacaaccacatgtgtttatcaattttttagttgtgaccaaacttttcgtcctcacttggattgttgccaaccttttagcatgtcggtggctcctaccaattatagtttatttgtgtagggaaaattggccaactcttggagtacataaaacattgatccaaattttggctacccaaaattttggtggtgcaaccttgggctcaaatcaaacgcaccttgaatttctcacgcaacccaggtgggacctttgggaccgcttggatttgatcaccggatgcaagacaagatgaataccaccggaatctaatatagagtggctgagtgggttttttatgtagactacangcattgagtgctcacgctctatgatttcagtggatataacaacanaaattgaagtagacgatgcaact

SEQ ID NO: 60840 - DNA, 353 bp, Triticum aestivum
  Clone ID: PAT_TA_60840
taccggtccgtagattccggggcgacattggcgagggaaaaaatcaacagtcggtgcgtcccaatcgggggtcaccgcgatatgggccgatgccgcgtcccaaccgcccttctagctacagcccgacgtccgtttcgaaaatattagtggatgtcaacaaaaattatactagtatcgttgttccgtttcaaaaaaagcatataagcggttacttcttacccaaaggatctttatatccaacagacacaaaatatccattcgactgttcgaaattactttcactgctgatctgacgtcgaggtaattgctgcatcgccaccataacccaatcgacaaaatccacggcacggtaa

SEQ ID NO: 60841 - DNA, 143 bp, Triticum aestivum
  Clone ID: PAT_TA_60841
ctctccaaagttatgtcggtagctatcagatgttgagtgtcttgagaactttctgatcattgtgggatttgctttgtaatggtaatcgtgaaattggtgtggttatgttttgggcggggggggggggggaccaagcgggcaag

SEQ ID NO: 60842 - DNA, 393 bp, Triticum aestivum
  Clone ID: PAT_TA_60842
cacggtttcttgattagcgaggcgatgcgcgacgagcgcggcctggaggtgcacattcttcgtcgtgacctccggcacctgcagggccactagggcttgaaagagttcgtcaccatggaggccgatcagggtggcaggcaatgaggagcctgggcgcgcgggctggagcagtatggcaaggtcatctgcgcgcttcttgacgtcggtgaacttgcggatggagtggaccatcatgtcgtccatgcgagaggcgaagccggcgttggcgagggctacgacgccggcggtcgccagcaccttttggaaacgctgcatggtgtggggccgcaggccggcgtcttggattatctggcacagccgactgccgctcacgtccatcgcccccaaaggtgc

SEQ ID NO: 60843 - DNA, 268 bp, Triticum aestivum
  Clone ID: PAT_TA_60843
accggtccacgattcacggggtcaccggctgcgagataacgacagaagggggctgagcaaagcggtaacatagccaaacaacggtttgctacgaaaggtgggttagaggcttgtcatggcaacatgggaggcatgttatagcacgtggtgggcatcgcggcatagcaatggagcgaacaacgagcaagcaaagatataagtgatttcgagggtatggtcaccttgtctgagatcccgcaaggaagaataaccatttcattaagaagac

SEQ ID NO: 60844 - DNA, 319 bp, Triticum aestivum
  Clone ID: PAT_TA_60844
ctgatccctctgactaactgcatttttgagcaacattttcacctctctgtagcgagagacggcccactccacttacgccggtggcacgggcagtttgccgttctgtgtactgtctctggatcaattctaaattccaccgaagacatacactcgttctgccgagtctgacccctgccatcacaactcatcgtacatccgacttgtgtaagcaatataagtatcgctgcttaacttcaatgcccgaagcaaccgttcatatctacaccgtgtagaaatttcacgggtgcaatttgtgcctcttcgagttactgtctctgtt

SEQ ID NO: 60845 - DNA, 293 bp, Triticum aestivum
  Clone ID: PAT_TA_60845
atgtgtaagacccaaatcacggtggcctggtcacttttcgacttgtaagagaaattgtgatgcatgcactttcatccagattgttttgtgaacacatttgattcaaccctttgatcaatttgaattaaggacacgactatggggctatgggaggggcgccgcgccgcaaccagccattatgcccaatacctatttggcgcttcacgcaccgttttatgctattcccgtaacttggcacgcagccccctctgtcttgggcacgacccagtaaccactccggtcacaccttaaac

SEQ ID NO: 60846 - DNA, 270 bp, Triticum aestivum
  Clone ID: PAT_TA_60846
cctcggcaggatagttggaaccaaatgccacgttcataccctaatatctttaacactaatacgagcattgccgcacataaagtattaacagtaccaataccagtcagagttaaaatcattttacacctgaccatattgtgcgtctggtagaccatcttgtagaagaacagctcccactccttctcttgcagcacgtccctcaattagtactggtacaacaaccacttggacgcctgctgcatcaagttcttgttggtgatcagtaccata

SEQ ID NO: 60847 - DNA, 437 bp, Triticum aestivum
  Clone ID: PAT_TA_60847
cggcaccactcggatgtccgacagctgtgcagatttcctcgtcattcctcagtagtcatcccatctctcggacgtccaggattcttcaatcgtccattacctgactcatctggtgcactcatcagctcccggacgtccagcatctgtcggtcatcaggtaaaatccacgacccatataaaacagggaaggggattgaccgggctgttaccctaaactttcccctcgtacccatccctttcctctgtccgctgccgcaccgctgtcgtggagcctcgctgtcggtggagtctggcgctaccggacagatgctctgccgatcctccttcaccttgatctggctcggtgtggctaaccaaaccacgtcgacattcaagcatgccgctcacaaaagtatcgacggctcatcggctcacgcgtctcattgcggtggctcgga

SEQ ID NO: 60848 - DNA, 353 bp, Triticum aestivum
  unsure (1)..(353): unsure at all n locations
  Clone ID: PAT_TA_60848
atcancagatgagaaatctttgcctcaagcatctgacaccacactctcaggttggatactgcgatatcaaagttcttcatcattatgactcaattcgggtcctgtatactatatttcattccaatccagattcttcctataaggttcgtacattctacccatactgacctctgccgtagccactcactcatatccgtttgcttcactcactctacgtctctctcgataccgtcaattcccagatcaaagggtcctacttacagctggttgaaaattcccgggctcaatttgtcactcttccagtttctctccctctgcagtctgcactgcctgcaactgactttattgctcac

SEQ ID NO: 60849 - DNA, 376 bp, Triticum aestivum
  Clone ID: PAT_TA_60849
tccacgtgacgttgacaaacgtgccaccctgccatcaaatgactacgtgcaatggccacctcacggtgcacctgtacgtagtgtactccgcctcagatgttcagctgctctctgggtacaccacaggcggccatacccggcgatggtactcgggaggatagcaccatccaatcccgccgaggtgtgggagaggtgctgcgccggcatcaaagttaagcctattaataaagaaaagatatttatatttctcgtatttggatgtgcctctatcatgtggcgcctgctaccattttttaaacttgtgggcgcctgctaccaacgggcgatgctatgtatcgctctaagcgagcaagatacaaacgctgtcactacaaaa

SEQ ID NO: 60850 - DNA, 351 bp, Triticum aestivum
  Clone ID: PAT_TA_60850
gacggcagcgagaaaacgacagaaggggtacgcccgcgcacaccaccatcccagctggaccacgagctgtcccgagctaggcctccgcttggaaaagccgcccagctcttgggccgccgactggggggaccccagcgcccgggaagccgccttgtacgcgccgctgcggaggagttctggtgctgcacgcctgaacacgccgccacacagattggatctgactcctgcgcgtccatcgattcggcctagaagaagttcgccaaaaacacgtcacatgtatcggctgcctctcgatccataatccaactccaagtcgcttctccctcaagaagaaaaggagagaaagacaag

SEQ ID NO: 60851 - DNA, 425 bp, Triticum aestivum
  Clone ID: PAT_TA_60851
cctgatctcgtatggtggcgttcgcgtgggctagtttcggtgcggagggagtcggcccagccggaggtggtacgtcgccgtgtcagggaggaggacgagcacgtccatcgatacatggttgcgttagagggtggcaggttctccaatacccggcagtttcttcagggatctcacttcaactatgatcctgtgagggttccttctctttgggtgtccaccgccgcgccgcaggaaccgcgagtgtcctagattcttctgtagtattcgatctttattagctacctagccagtgatgtattcgatattatatctattattcgagatgatgtattcgagattatatctattattcgagacgatgtattcgagattatatctattattcgagacgatgtttttgagattatatctattattcgagacga

SEQ ID NO: 60852 - DNA, 426 bp, Triticum aestivum
  Clone ID: PAT_TA_60852
cttggaactcctcgacatccacataatcatcctccaccccgagcccgaccccaaatccgtcgagccccgtgaagtgccaccccaatcggggttcctcttcttgggccacaatgttgtctggatcaccctcccaggcaccatgggcgtcttaaggtccgcgaggatcactctgccgcacatggccgctagtacctcatcatagtcgttgtggggtaggaacctcgattgaattggtaaatgggcagagtttttaatgaagcggtggagcgggtctgtaggtttgtaggttgagacaagggcagtcccctatatacacggtggtcgtgtgacggcgcccccacccaaggttccatgcatcagtgaggggtcgtgcggcgcagaaggaacgaggtaggttccggaagcaagtgcttccattcatgggga

SEQ ID NO: 60853 - DNA, 416 bp, Triticum aestivum
  Clone ID: PAT_TA_60853
cgaaaagacgaaagaagggtacggctgcgagaagacgacagaagggggaacgagcacataagttgcagcacacaagtcgctgatgccctcctctggttcctctgctccttgtccagatcgatcctgccgccagcgatggaaagatgctgctccgccgctgcctgatcttccgctctctctctcccccctggtccaaatccctaatttttccccaaggattcaaccccaaactttctaatcccctctcagatttgtcgtgggctgctcttcctctgctgctccagattgaactcgccggcgctgatgaccgcggtgccgctgggtggtgcaggttaacgctcaagtgtgcagccatggagcagatcgagcatatgtgcaggtagagagatgaagacggtggggaagacaagctgttg

SEQ ID NO: 60854 - DNA, 428 bp, Triticum aestivum
  Clone ID: PAT_TA_60854
gctccagaggcacgtactgggccaatgtggggatatatctgcatgggttcccagctgcctgcaaaacctcgcgtcacttgtttcgctggagatgtctgagtgcccgggcataacatccattccaggtgacatttggaggacgaaccttgcatctctagaggagttatatatcaccgattgtccagacctggtctcaattgggggattggaggccgttgcgcagctaggcacgctgcacatctctggctgcccaaagatgatagagatgtagcagcctgtgaagagaggcggagactagctaagatcccatcacttttcaagtctatggatttttgttgttgttgcactgagatctctgtatctgtgtggatcacttgccaaactactccagctctctggccagctgagctcatgcctattcctaattc

SEQ ID NO: 60855 - DNA, 203 bp, Triticum aestivum
  Clone ID: PAT_TA_60855
gaaagatgcatacatacgaatgcagcttattatagatactctccatactagttggagtttcgaattaacaacacatgccatggatatgatactagctaccggatcgatcctgggcataatgccagtatgccacactgtggttacagatgtatgtactgtctccacgcataatgataaatggataagaaaaaaacatataatag

SEQ ID NO: 60856 - DNA, 402 bp, Triticum aestivum
  Clone ID: PAT_TA_60856
atacgaaaagtgccaattgtggaaaactacatgctaagagttgcaaatatctgatgttctttaaaaaaggaaggcgacaactactcaaagcactcgtgctagcaccaggaaagtctcaagcaaatgtttcttttcctttgaaatctaaaggatatgaagccaatactccggaatcttgttttcctattcctgagggcaccaaaggtacttttctatgaaccccacaaatccagtgctccaaacgaagggctcaccgtcaaattgtccacttggaggtccttccagtgtgcgataatacgtcaatcccttaacactgagagaacatgcagcctcgtgaaaatgtgatcatttgcctcaaaatccatgtcgcaaagattgcaggcttaatcatggggcgaacct

SEQ ID NO: 60857 - DNA, 414 bp, Triticum aestivum
  Clone ID: PAT_TA_60857
caatttatctcagatcacgctaagaactgctccgagaaatacgacggtgacctccctgaacgccttctcctgttcaggagcaatcattcccatgggcacaccggcgatccagaacacgttcatagccgtgagccataaagtggccttggtctgccaacgcttaaagtatgtaccggtacacttatctggtttcagtgcagcggcgaagccacttgccaaaaaattcctacacataataggtttttggattgctgggtaataggcaatttttcgactaatttaattcataaatagatgactagcatgacattgacaaaattaacgacatgctgatactgatataaataagcacgtaccaccacacattatgctagtcctgctaatacggaaataattagaagaaggataaacgcg

SEQ ID NO: 60858 - DNA, 415 bp, Triticum aestivum
  Clone ID: PAT_TA_60858
ccgatagacaaacttgtcgaggcccgttctcccagagtgcccaccccttattctttcgtaagtacgatggagttcctgaagaaaggacgccgacttcatcatgatgaccgaagcagagaaatgaagacatcagtgtattggaccagcctcttccagaagtgcaagccaggatgagaagacccgctagattcgttaccaaaccttccccccttactcccctcttaaatctcgggacgagatttcttgtagtggaggagaattgtgacgcccggataatcatgctacagtaactccctgtgattaagctaatcatgttgctaaacagggcttgatcacatttgaatcaccttactttcttactcctagttcaaacttcaaatataattaaagtgaaaaataaaagttttcaaaaact

SEQ ID NO: 60859 - DNA, 433 bp, Triticum aestivum
  Clone ID: PAT_TA_60859
gatcaggggcgggtgctggagtcgtctttgtgacgccaagcgaagggataatcccgtactcatttaccctaacttcagcagtttcaaatatttcggctgaatatgaggctttgataattgggcttgaattagctctgaatatggggttagattcactcattgtttatggtgactctcagttagtgatcgaccaactactgggaatttacatggtaaagaaagaagaattaatgccttacttccaacgagccaaggtgctcatgtccttgtttactgatctaaaaattcagcatattataagaagtcaaaacgaaaaggccgacgccttagcaggtttagccgctagtttgtcactaacttcacatcagatgatggacgttcgagttgaagaatgtaagatactacctatactcaccgcaagagaggagacgac

SEQ ID NO: 60860 - DNA, 293 bp, Triticum aestivum
  Clone ID: PAT_TA_60860
gacatcgtgacatgagcgccatggtttctgtgacattttacagggcctgcgctgaagaggggaaggacatgtacatctaatagtatatcaaggagagtcatttttttctggttagagctaaagcaataatgcaaagaggttaagaggtgaggggagggttgtagtctgagaaattggcaagttgtcgcgatatgaactgcatccatatgctgctgctgttgtttgttgtgaaatgcaaggttagtgccagaatggaattgtatcgcctggaaatcaatcttttttgtttctcc

SEQ ID NO: 60861 - DNA, 381 bp, Triticum aestivum
  Clone ID: PAT_TA_60861
ctcaggattttccttagaatttagcttccccgattacaaattatggaagcttcattcttgtccttgtagtacatccgtactaaagtcttactgcaggtaaagggttcacggaaatatggaattggggaatatataggagcactaccatcgttattacttcggtcttttttatatttggattggatgtactaaaaaggaaaggtcctttttttctttaattgtcatggtgacacatgcgcgtgcatcattctcacacaaacaaaaatcagtttgtctaattcatatctagatattttttaaggatgtcacattaagctcttacaaatatataatgcagcaacagccaaaaaaaaagctaaagcaggaaaaaaaaagcgggcg

SEQ ID NO: 60862 - DNA, 397 bp, Triticum aestivum
  Clone ID: PAT_TA_60862
catagagtgcaagtctctttcaagatcggagcttatgaagacactttggagtgtgatgtccttccgatgaccgtttgccacctccttcttggacggccatggcaatttgaccgaggtgtcatccacaatgggcgtacaaatcactatagctttaagatgaaagggaaggagtttgtgctacgacccatgtctccaagccaagtgatcgccgacaagcaagccacccatcgtggagagaatcgtgagcgagcgaaccaccaaaaagagagtgagtgccacaagcccaaattgagtgcctccatgatgagcgacacgacaaacttagttctatctgccaccaaacgtgagatgagagaaatgtgtgagaacccctcaagtgtcctacactatgtccttt

SEQ ID NO: 60863 - DNA, 129 bp, Triticum aestivum
  Clone ID: PAT_TA_60863
gtggagcgcttcgcgcccacgctcgcgctggccatcgaacatctccggcagaagtaggaactgcatcggccacagagaattttttctttttggttggtacatgaattaggggcattttacggcctctac

SEQ ID NO: 60864 - DNA, 419 bp, Triticum aestivum
  Clone ID: PAT_TA_60864
ctgatctccgccatcatcgcaagctctcgttacctgcctcatagcatacagtcgctgaatcaaggtcgagctaaggatgcggggcaggtttctggcttggttccgcacctagttgatggtggtatatccattttgcagtatgctgatgacactatcatctttatggagcatgacttggcgaaagttatctttacggccacagcattgatccgtatgtggtcgctactcacaccgacggaggccagggggcgtttggctactgcgtctacccgatgggagatggtagctcgggttattttcaaccggtttggatggcggtcatgtaataggatacgcatatactgctcctattttatttgccagccggttgtggctctatgtttaggctcgcttgagcaaccttttttcctttccaactt

SEQ ID NO: 60865 - DNA, 426 bp, Triticum aestivum
  Clone ID: PAT_TA_60865
gactgcaatctttcaggttatacacatgtatacataaacggccgcccaggaggcatcatattcctttcaggcaaaagtataaaaatagccttataaaaatttataaaagcatttcgcttacaatgagattacatatcactcaaacataatattttttgagcactgggtctctatcaaacgagcaccctcaagaacttcttcaaagtagtgctcagcagcccttcgacctatggccaaatcctgcgctgcaacattggtagcatccatctccgcccagtatgctttaacaggggcaaatgtcatccgtgcgccctctatgcacgccaacctcttcatcgcattaatgcgcgacaccacgtcaaggaactgctgcaccaagttaaaatagctattcggttttgacctttccggccatagctgatccac

SEQ ID NO: 60866 - DNA, 419 bp, Triticum aestivum
  Clone ID: PAT_TA_60866
acggctgcgagaagacgacagaaaggtagaaccaacacaacagaacaacaaccgttgtcgatgaagagtagtgtagatcagaaaaaatccaacctgaagacacgagaacatagacgaacgatgaacagatgcgagcaaatccaccgtagacagatctgccggagacacgtcctcacacgcccaccggcgatggaagcaccaccgaaacggggcctagaggggagaaccttattccatttttagggagccgccaccgcctcgtcttccttagcaggacagaaaccctaacaaaactcgaagaaagatctaaaaacggagccctcccaccagcaggaaccatgatccactctgttcccatgactctacggccgcaggagacgaggcagaccaccgacgggaggcatagaaaccctagcttt

SEQ ID NO: 60867 - DNA, 144 bp, Triticum aestivum
  Clone ID: PAT_TA_60867
acggggcgccagtattctgtacaacggtggaaaccagcgcccagatgaaaacactgtatactcttgtttcgttttggacgtagaatgatgggaaatcagttccgttttcggtgttgttaaaaaaaaaaagggggaagggaaaaa

SEQ ID NO: 60868 - DNA, 426 bp, Triticum aestivum
  Clone ID: PAT_TA_60868
gctttgtcgagaacttctccaagatcgccaagccactgaccaatctgctacacaaaggcgttaagtttcattggactgaaaagtgtcaggaaagtttccaggcactcaaggacaagatgacttctgccccagtgcttgccccctgattctcgcaaggacttcgtcatctattgcgacgcttcacgacaaggattaggctgtgtcctaatgcaagaccgcagggtgattgcttatgcctcccgtcaagtgcgtcctcatgaagagaactacccagttcatgacctcgagcttgctgcggttatctttgcactgaagctatggcgccagtaccttctcggtaatcgttgtgaggtcctcaccaatcatcagagtctgaagtacctgtttactcagccagatctaaacctccgtcagcagcgatggatg

SEQ ID NO: 60869 - DNA, 426 bp, Triticum aestivum
  Clone ID: PAT_TA_60869
ggttccttccagccaactgacggcacggctggagcggggatgatcctacgtgaccacctgggggctgtaatgctggcagcgataagagggcttgggaattgtgcggacgccctggaagccgagttggcagcaatccatgaaggaattactctgtctcttaattggactgaactagatatccttgtggagactgacagcgctgatgcggtgcaactaatttcggcagccggaaaagaccgttcaacacacactcacaaagtaatggagatcagatcaatactgtctcaagaaaaaaggattcaaattatgaaaatcaagcggaatgttaatgtacctagtcaaactctcgctcatatgggacgtacacaacaacatactgcttgctggttgcgttctcccccggacgagattgcgagcattgttgtc

SEQ ID NO: 60870 - DNA, 342 bp, Triticum aestivum
  Clone ID: PAT_TA_60870
gggagcgggaaagcagatgatcgaggtggtgctcagcgaccgcctgtggaacaaaggtgctcgtcaagtggagcgacgacaacaccagcagcgacatcacgaagctcgtggcggcgcacaccgggaccacggccgacatgatccgcatccagaaatggtacaccatctataaagaccacatcaccctcagcgactaccagatcacaaagggaaggggccccaactcaactacaacaagcgtcataacccccgcaattgcaggtccgtcaccaatcgtgcctgtgatgagcgttggttgcattccagtcccaatgtcatcacagctcgatgtgtgggctgaac

SEQ ID NO: 60871 - DNA, 105 bp, Triticum aestivum
  Clone ID: PAT_TA_60871
tccgaaattcaagggtcgacgcacgcgggacgacgacatcggcttgccgaggtgttagcgcggccaacctaaatagattgcctgcacgcacaacgtagtgcaacc

SEQ ID NO: 60872 - DNA, 460 bp, Triticum aestivum
  Clone ID: PAT_TA_60872
ttcccaggtcgacccacgcgtccgcccacgcgtccgtacggctgcgagaagacgacagaagggggggtttgagaattggtgtaagagaaacgattgaggttttctcttattatctaaacccaccaagtctttcaggattttagccagagaagcttgagtctttgattagggacatgtcaacctccgccgcttccttgtgttgttcatcaacccaggtcaatgggtttggtcttaggcctgaaaggttgcttctttaccaacccacttccttttctttctccagaaggagaactcatggaattgtcaaggcctcatctcgggttgataggttttcgaaaagtgatatcattgtttctccctctattctctcggctaatttcgccaaattaggcgagcaggtaaaagcagtggagttggcaagttgtgattggattcatattgatgtcatggacggtcgttt

SEQ ID NO: 60873 - DNA, 443 bp, Triticum aestivum
  Clone ID: PAT_TA_60873
cacccacgcgtccgtacggctgcgagaagacgacagaagggtatgatgaatcccttcagagcgatgcagccgcgagattgccagtcacacttgctctcgctagcttatggctccgtagaaactatgctgataccgtcctggtgagagttgtggattcattaccagaagtgtatccgaaggtagagacttggatcgagaatgtggtgtttgaagaaggtaatgcaacaatacttacactctttgtctgtctcatcacaattctctatctccgggaaagacaacgtagacaagtcgtcgttgttgccgatccagtggctgctgacgtggcacaaccgctcgacgctgatgtggcgcaacacctcgctgcgttcccacggtaatcaattgataatcgttttcgtcattgtaatagcagagaataatggctttttggtgtgtttttt

SEQ ID NO: 60874 - DNA, 442 bp, Triticum aestivum
  Clone ID: PAT_TA_60874
cacgcgttcagatgcaccaccggtaatgacattgatgccggattgccggtgcgtgcgtgggagcttgttgcgtcaaattgctttcgagtgacgaagcccaactccctgtttcatttctgtaatcagataacaaccgtgccgtgccatggcaggcttcaacagtgttgagctccaaggcaccatcgactacttgtcaatcacgccggcggcccgcgctggatgttaccatgtaatggatgaagcaaatgcccactgatttagaaccagcggattggttcctggtacgccgctggtttcagtgtctgaacctaatgatttagaaggtgtcaaaccaaatgatgtatccgctggttcatccaattcagtgccgaacccaatgatataatggatgaagcaaacacccaccgattcatccattatgatgaacctccaactacaacag

SEQ ID NO: 60875 - DNA, 405 bp, Triticum aestivum
  Clone ID: PAT_TA_60875
agcacccaactcatatgttcttccgcaggacccctctcttatttacacgatgagcttcctggttgctggattgatctgggcacttgttacgctgccacggagcggtatgcggcctaacaagacgcttggggttggcctcattgttctctactcagttttccttttcattagagtaagcagtgctatggggatattgccactcccgggcttgaattagttgtttgtgtctattgtacatgactgtcctgtatacagatgaaatggggttgtacattgttcctttgttctgttgttatgcctcaaatttggttgtatgcctgtcaggctttcagagacaataaagccagagcatgcctgcaactggtctacttatttgtacaaaaaaaataaaaaattaagtaaaca

SEQ ID NO: 60876 - DNA, 456 bp, Triticum aestivum
  Clone ID: PAT_TA_60876
ttcccagggccacccacgcgtccgtacggctgcgagaagacgacagaaggggggcgaagtaataagtcgtaataaccctaaaaatcttgccctctttttcgccgccggctaaagctatgaaggtttttaatcttgaccgtggaaacactctctctgttttcctcttctccggtgtcaccaactccaaggagctcttgaattcaatgcttgacggaagtctgaagctggaggtctcatttctcaatgcatcacttattccagacatttttcctctattggctgctgctcagaaagcacttatctccaaatcacgcgattccttatcaaccagaactcttcattctgagcttgtctacaattactcaggatctaagcacattacagaatcattgaaacgatgtgggatttctgagaacactacttacattctagctgcccggttcaatgcttctcccg

SEQ ID NO: 60877 - DNA, 463 bp, Triticum aestivum
  Clone ID: PAT_TA_60877
cggtccaagattcccgggtccacgctgcgagaagacgacagaagggtacggctgcgagaagacgacagaagggaagagcttttgtatgtggtcgcaaaggttagagaatacatattactttgaagcaatatgctgtgaagaaaatgtatgtggaaacataaacctagctgttatatgaccatcctgacttcctttaggaagatattcaaagcagtgcaatctttgttgcccatctgccataacacatttccgtaggttctcatatttcctttcatgtcagaacaatatccaagaaatcgtacaatattcttgtgcttcgccttcatgagacactcgatctctcctagaaatttttcctcgtgcatgtacgtattgatatgtctctcctagaaaattttctcttttaccgaaaaagggtttccccccgctttgtatacagagcaaccaaccgaaccatccaacg

SEQ ID NO: 60878 - DNA, 426 bp, Triticum aestivum
  unsure (1)..(426): unsure at all n locations
  Clone ID: PAT_TA_60878
cacccacgcgtccgcacacgcgtccgtacgctgcagaagacgacagaagggggaagttgcagagaatctagcgagaccaatggctactctggtctcgtctcaaacttacatctaccattgccatattagtaaacaagctctttatcaggcaaaagaatcatactctcatcgtagaatttcccgtcataatcacagagaaagactcgatttttctcatagaaaccatagattgacaataactagaaagcagcaacctttgtctttcaacaccgtgtgttttgccgcagacgagccctccgaaatcagtgctgatgctagaatccgtagtgaggttctgtctccgttcagattagtccgtatgttcttctacctcgcctttatagcaagcggttcattangaggactaatagccacttctaggctcat

SEQ ID NO: 60879 - DNA, 474 bp, Triticum aestivum
  Clone ID: PAT_TA_60879
cctgcccgtaccggcccgagattcccggggccacccacgcgtccgtacggctgcgagaagacgacagaaggatacggctgcgagaagacgacagaagggtgatgaatctgacaagaccagagaactctgtcggagagagaagattgagaaagttcctcactttagcttttataagagcatggagaaaatacacgaggaagaaggtattgaaccggaccagttaatgggagacgttctatactacggagacaaccactctgcggtggtgcagctgcacggccgacctgacgtggaaaagctgatcgacgagaatcgcactggaggcaagctgatcgtgcttgacgttggtctaaaacattgtggtccttgcgttaaagtgtatccgaccgtgctgaaactgtcccggtcaatgtccgagacagtcgtattcgctagaatgaacggtgacgagaacgatagttgtatggagtttct

SEQ ID NO: 60880 - DNA, 433 bp, Triticum aestivum
  Clone ID: PAT_TA_60880
gagaaggacaggaatatcagagatctgaaggctaaggtggaaaaaaggaatatgtgggtcaacgggcttaccaagggctggggttcactggcagatgacctgctaggttctgcatatgatcaagctttgcttccgaccggtgcttcggtagttctacatttttatcatggctgaaaatgcattccaccgtgcactactcatcgatgatttgcacataagcttgaaaccaattaacaattgcatcgcctggaggcacgagggagtctgatgttacgagagcacatgaagacaaggcagctaatgtttctgttcaagatgtcaaccacatcttcatagcctgattctcgtgcctttcctgttgcgttctcccgttgcaacgcacgggcccttttgctagtataatctaaaaattagtatcggaggtttggaccac

SEQ ID NO: 60881 - DNA, 404 bp, Triticum aestivum
  Clone ID: PAT_TA_60881
ccacgcgtccgattccggcaagttctatggtgaccaagagaaagataaaggcctgcagactagccaggatgcccggttctacgctctgtcggccagatttgagcccttcagcaacaagggtcagacgctggtggtgcagttcacagtgaaacacgagcagaacatcgactgtgggggcggctatgtgaagctgtttccagctggtttggatcagacagacatgcacggagactccgaatacaacataatgtttggcccggacatctgtggccctggcaccaagaagggtcatgtcatcttcaactacaagggcaagaatgtgctgatcaacaaggatatccgctgcaaggacgatgaattcacccacctgtacacgctgattgtgcggcctaataatacctatg

SEQ ID NO: 60882 - DNA, 418 bp, Triticum aestivum
  Clone ID: PAT_TA_60882
ccacgcgtccgccccacaaaactttggcacaatgaagtgggtgacttttatttctcttctccttctcttcagctctgcttattccaggggtgtgtttcgtcgagatacacacaagagtgagattgctcatcggtttaaagatttgggagaagaacattttaaaggcctggtactgattgccttttctcagtatctccagcagtgtccatttgatgagcatgtaaaattagtgaacgaactaactgagtttgcaaaaacatgtgttgctgatgagtcccatgccggctgtgaaaagtcacttcacactctctttggagatgaattgtgtaaagttgcatcccttcgtgaaacctatggtgacatggctgactgctgtgagaaacaagagcctgaaagaaatgaatgcttcctgagccac

SEQ ID NO: 60883 - DNA, 415 bp, Triticum aestivum
  Clone ID: PAT_TA_60883
catctacacacaagacttgcattgattccacccccgtaatgttagagatcgagcattcgaggaaggagaccttgtgctccgagtgcatcagaatcggcctcataagctcgctccggcctgcaaaggccccatcatcatcaccaaggtgctccacaatggggcgtatcacctctacaacgtagccacaatgaaagatgagccacgctcatggaatgtagagctgctctgccgtttctacacctaaacactcggatcgccgagttgtaaaaagaatccttcagtttgcttttcaaagacaagatttttgtagtatctaatgattgtcatcccgtaaacatatgtgttcaaatcccccggtgggtggcctagccgcgaacccgattcgcctaagttaagaaaccattccgagtggaga

SEQ ID NO: 60884 - DNA, 249 bp, Triticum aestivum
  Clone ID: PAT_TA_60884
cacgggtcgactgaaattcgtgggtaactccagctgggaactcctgctcctcagctctaccggtcccatcctactgtcgtggacagccgcccaagctagtccagtagggtttgtcgaatttttataagccgatttatcgacgtttatacgaaatagaagaatatccaggcattgctacggaccataggaaaataacgtctctggcgatatgaacatgtatttctttcctcctcactggacgccattttt

SEQ ID NO: 60885 - DNA, 287 bp, Triticum aestivum
  Clone ID: PAT_TA_60885
caaaggtggctggtaagattatgcgccggacggatgtctatatctacgcctacagtcttctcatgcgtctttctcgaagatttttgtttttcgctgagctttttggtcacatttcgctgaggttgtcacacattaatgtaatacgctgggactactacaataactatgtatgccatttcctgctactttgatgtaaccactcaatgtctgcagtacattagtggcatagttatggttggatttgcgaaatggttcacggccgctctaaacgattaaactgcactgtc

SEQ ID NO: 60886 - DNA, 396 bp, Triticum aestivum
  Clone ID: PAT_TA_60886
gctgcgagaagacgacagaacggaacgactttaatgccttcccaccaacacaagcttgttcgtgtttggtcttattccgtgagttccttgctatccaataactgttattctttacattggtacattaaaatcacttatgtcctcaatgttgtgataaattcaccatccttacgaattcttgataccagtgagacttagtatcatcaccactcgttgcttggtcctcgtgatgtttctaaccggaataccgacacatggtgtgtgatgtgtagattctaaactttgagcaatcatcttgttctgaagttattggtctatagtttcactctacgactatggcatattgaatcaacattctgacattggtcgtgcaaggcagaccatatttagggcgca

SEQ ID NO: 60887 - DNA, 364 bp, Triticum aestivum
  Clone ID: PAT_TA_60887
ccagcgcggcacgccaagaggaagttgcgtatgtctgccaagcaccgagaacacaagaagcggaagataacagcgatgaagatgggaaggtggttgaggtagtttttgttggtgctagatgaagatcaaacaagttacttctgccagcgatgaagatcaagcagaagcaagttgtacagcgttcacttctgcgtggcaatgtgttctgctgttggacttcgaaaatttgtgctagatggctggcagaaaattttgtatgcttgatgtatacatgcatatatcaatcaagttacgcctataccattgcagttttgttgacgacctgtagaatccactgaatgaatattgatgaaactttcattac

SEQ ID NO: 60888 - DNA, 410 bp, Triticum aestivum
  Clone ID: PAT_TA_60888
cggacatgataaaatggatctctgcagaatgcgctccgatgaaggctcgccaagggaggatggtgtgatttggatctgaatcctcgtctttttaataggcagctcattcacacagctaggggggtaaatgtaaaaacaccctggctcttcacattcgctcgacacgtggtaagtggtcattactgggcgtggaaaccaatgagtgcaacattcacaagaggccggacactatttcgacaggtacacggaatttggagaaggacccgccctgcaatgccgaagacaatacttcgcgctggactcatcgtcattgaagcctggttcgggggctactgaggaagtcctggattaaggggtctccggacaaccggattatatccttcggccggactgttagactatgaagatac

SEQ ID NO: 60889 - DNA, 372 bp, Triticum aestivum
  Clone ID: PAT_TA_60889
gtcgacatgctcaagtcaatgctcacgccctttcacgagctgcatagctgctgcaactagggtcattggtctatagtatactagtagtacaagtactagttagtaaataaataaaacaaataaatatcggagccggacaaagcaaagcgggaccgggccggacccggcgcggagctgcagaatataatcctgtgcgcgctgcggcttatctgatgcgagcgcagcgcgtagtggatttccacttccttccttgcctccttgccttttctctctcgggacagacaggctgtgattttcttcttgttcttgttcttgttgccggaggaggaggagagagggggtaaggaggcggcggcatggacgtggagatcc

SEQ ID NO: 60890 - DNA, 434 bp, Triticum aestivum
  unsure (1)..(434): unsure at all n locations
  Clone ID: PAT_TA_60890
catgacaagataattatgcaacgtagggagtggaggagactgttcatgactcggtcatgacaagattattatgcaacgtagggagtggaggagaactagctgcatctccagtggaaagcaggcaatcccttacaattgaattaagatcatcttttttgtggggattattatgtaacgtanggagtggaggagactgttcatgagtcggtcatgacaaggttattatgcaatgtanggagtggaggagaactagctgcatctccagcggcaagcaggtaatccctttcaattgaattaagatcaaattaggaagaggaacggtccaggctctgatagatgcgccttatgtggggcagttgaaaacaccgagcacattttttttcattgctcgctggccaaatttctttggagttgtattagacattggcttcatg

SEQ ID NO: 60891 - DNA, 302 bp, Triticum aestivum
  Clone ID: PAT_TA_60891
gggtcgacgctgcgagatgacgacagtcgggtgaggctctggctgggatttcgctgtttgtcagttgcctaacgctagcaggctgttgtatgcctgttttgcttcttatcgtgtttccttcggtagagcctctctgctccccaacttgcaatgccatcttcattctgctggttcctccagcaatgtatgggatgcaatgtaacaaaactatgaaagagctcatctttcgcctatttgaggctagcctttggagaataataaattaataataggctgccattttggcttcctttgccggattt

SEQ ID NO: 60892 - DNA, 434 bp, Triticum aestivum
  unsure (1)..(434): unsure at all n locations
  Clone ID: PAT_TA_60892
cttgagcactcatgttcatgctcacggaagcaatgtagaatttttcatggaagtttctctgtaaataattatccccttatatatatccattgtattataaaaataatgtgccaagctttggttttaggatgattagattgcttgcttactatgtgcagaacaaaaacagaaactttggctgtagcgcgtgattttacattttttcctggaaagtcaaatgggtctgaaactttctgcacattacttctgtataaatttttcaaattgtcaaatttatttcataatgtttggagttacagaagtttactaaacctccagattactacagactgtcctgttttagacagattctattttctatgtgttgtttgcttattttgatgaatctatgggtagtatcggggggtttgaaccatggtgaagttggnatacag

SEQ ID NO: 60893 - DNA, 438 bp, Triticum aestivum
  Clone ID: PAT_TA_60893
cgagaagacgacagaagggggtgcgatctgtagctatctaatgctcgggcgggaaaaaaataaaacacatacgggctaacaaataaaacgaccggttcgatctaatctaactaaaccgagaataaaccgtaactaaaccgatctactaaaaaacctaactcttggctagatctaatctggagcgttggatatcgatctagcggatgaaggggaaggtggcttacagatacgttggcgacgtacggaggcgacggagcggcggtcagcgtcgaacagggcggcgattccggtggtcgcgggcgtcggtggagtggctgaacggatgcagtaaagcgagggcgtcgcgggggtggtggagttcgcgcttggagatgacggaaacgagcagggcgatagtgacagcggttgggcgctctgcagctccggtggtcggcgtac

SEQ ID NO: 60894 - DNA, 439 bp, Triticum aestivum
  Clone ID: PAT_TA_60894
caatggtatgagggctggaggcatactgtatcccatgacgcggtcgccggggttgacggcggtgtggaagtagtcgggccagcgagccaggtacgtcatgtagaaggacatgttgaactgcggcgagcgaatcgacgtatcagaccgggaagaggacggccggacggcgtcgtggagaaacagtagcaacaaagggagcgagagatggatcttttggggatggcttacggtctcggtgaggtggtcgaggttgaccgaggcgaagcggagcagatcgtcgcagcagaaccggcgaatggtcgtcatggtctccctcccgtcctcggcttccggcggcggcggaatctcgtggcggagcggggcgggggcggcgctctatccggatttccgattcgtttgtgcgggtcgggttggaaccaggaagaggcttcctgcgatg

SEQ ID NO: 60895 - DNA, 182 bp, Triticum aestivum
  Clone ID: PAT_TA_60895
ccgcctttccaagtaacagttgtaaagtccaggtatccgtgtgtccaaacataaaggggaaaacccgaggaatcacccccggtgaattccactcgatgtaatctacaaggtgaatgtaagaggaaccacccccgaggttcacacttgaggggttgcacgacagagtcgtatcagaagtggtt

SEQ ID NO: 60896 - DNA, 461 bp, Triticum aestivum
  Clone ID: PAT_TA_60896
attcgcgggccgacgctgcgagaaaacgacagaagggcaggtagggtcatgatctcgtaatttattaggattaaggaagcaatataaaatacacttgctttacaacctgaaaatattgacagaagctaagatttgatcctgtgctcacatagatgattggattgggcagaaatttggaggagtgtgcaaaatttcatctcatttggatactcctagctagtacttccttcacaaagccttctgtctgacaaaaactttgaaaatcaccgagggaagttggctaggcaaatgaggttgaattttggcatgaggtaattatttggacataaaaatgcccaaaaagtttgggagcaactagagaaagataaatgacacttccttcacaaagtgccgttcaggacataatagaaaaaggagtattggggaattatttttgaactggccaaggaaatgtttgggca

SEQ ID NO: 60897 - DNA, 240 bp, Triticum aestivum
  Clone ID: PAT_TA_60897
ttataccgtgctgctctgcagttttttttactatatatacttggaaaaaaagagcctaatgacgttgacgactgccgaccaaatctctactcagaatcacggcctgcgcaatgccagcaacggaggtcgccgttccgttcccttccttgccttatcctcggttgctcccatctcttggcactgattaagagtcagctcactctactaagtttcaaacatgaaaaaatctcagttgacaaa

SEQ ID NO: 60898 - DNA, 436 bp, Triticum aestivum
  Clone ID: PAT_TA_60898
cctgtacgggttcatggagcagaaagtgagcagcaacccgagggaggccttcgtcaactaccgcgacctggacatcgggcagaacgtggttggcgacaacggcgtgccgacgtacgagagcgggaggatttggggggagaagtacttcatggggaacttccaccggctggcgacggtgaagggccaggtggatcccgacgactacttcaggaacgagcagagcatcccaccgttcctacccgtctaggctgcaacgagtgagtgaacttctcgaaagaaaaaaaatgaagtggtaacgagtgaaggctgaagagtgaagagtgcggattgacgtgtacgccagccaacatgcatgcatgggtgtcacattgtgtttgtcttgaataaggaataaagattgggactgattacatgtcagtggatgaagtagattttg

SEQ ID NO: 60899 - DNA, 380 bp, Triticum aestivum
  Clone ID: PAT_TA_60899
gaacgtgaacctggggggggtggacacctcagacgtcatcgcggaatgcctcttaccaccgtgcgcaactcatcactcgtgcaatgccgagagagccatatcgtgactggtgtagttcctcaaggtgttccatgtgctccaatgagcaatttgcgacagttagttcaccgatgccatgcacgccatacggcgcagctaggattccatcgtgatggctgaagacagatgtgacaccccaagctgacctccggcattgcttccatcctggactcagcactgtctatcgccaactctcgcttctatctcaagttctacgattcataccgctcagactttggatgtgatggatccaccttttatacgcatcatatggcatggag

SEQ ID NO: 60900 - DNA, 433 bp, Triticum aestivum
  Clone ID: PAT_TA_60900
ctcctcctcctcctccatggggacgggggccgcgccggcgtagaggctcttcatggcctccttgtcctcatcgttgccggattcggccatggcgtcatagccgccggccgccgggaagccggccatggcgtgtggagaggagaggaggtgggaggaggccgtggtggaggggatctggatcggggcctcggtggattttttttgagataaacgggggtgggttgacaatggagtgggacattgatggcatgggagtatactagtagcgcggctgcctctcctgcgctacagctatccacatagtagtagcgcgggtttcccgcgctactactatggtctgttcgcgggtcatggttggagatatttactagtagaatgttttttgtaccacacgctaccagtaaatattactagtagcgggtgtcaacatagc

SEQ ID NO: 60901 - DNA, 429 bp, Triticum aestivum
  Clone ID: PAT_TA_60901
ggacttggcgcaataaccattgcaccgcaatctctttgatgtttatatccgaaaacaacgatatttaagccttgcattagtcccaatataaattatttgacaaaagaaaacaaaaatttaaaaacaaagcataaagtttaaaaaagttcattgattttgaaaggaaagttcacaattgttttgttaaatgttactaaaaacaaaacaatcatcattcctagaaaaatatgaaaaaaaatcatggatttggaaaaagttcatcgatgttgataaaaaaatttacgaatttgaaaaaggttccccggattttaaagaaaaaccacaaatttgaaaaaggttcaccgattttgatacaaaagttcataaattttaaatagtttgtagagttgaaaaaatggttcacggattttcaacaaagattatgaattc

SEQ ID NO: 60902 - DNA, 308 bp, Triticum aestivum
  Clone ID: PAT_TA_60902
gtccacggtacttcagagaaggagatgcccaaaggttcgacgaaaatcacaggcaagaacacattatttgcgccgcgggctttggtcaaaccacttggatggaacaagaaagacgagaaaccagatgttgctgcggaagagctgaagtcgaatgatgagttcagaaatctgttgcttaagaagtgatgtctgtaggcaggttagttcgtcggtgtcttcacgtcccactaggacctctctaccttgcatctccctgtggaacgtacctccccgcgtctcgaatgaatgaatgaatataatgaagtgtt

SEQ ID NO: 60903 - DNA, 350 bp, Triticum aestivum
  Clone ID: PAT_TA_60903
ctcgaagacgacacactggcttgtacaagagtgctaacatgccttgatgttcggtcaaatcatcaaggggatcatgtaatatcaaatggtggccagtctgatgtcagagatcatactggtaacaaccaggtaatgaaaccttggaaacccagtggaattaacaagtcaattactacatagatggggctgatgaggtcagcttcttgaatataactggtttccgtgcctttccattgggtgatatgccaatgctacatgtgctacgttacgcatctcagaaagtttttgtgccacttacagttggtggccgtaacatacacttcacatatcacactggccgataccattca

SEQ ID NO: 60904 - DNA, 435 bp, Triticum aestivum
  Clone ID: PAT_TA_60904
cgccattgtaaccgagtcgctgcaagtcatgtgccggctcatggctgctccgggagagactggcgcccagctgcgcagacaaatttcaagcagcaaggaagtaatccacggcatggaggaaattctcaagtgttgcggatgcggtgaacaagttcgcatattaaccattgagattctcacgcagctacccgtgggcttgggtgaggagtttccgtgtgggaacaaggaaagcagagaaaattttatcaagatgcttccttctatcttcactgatgaggccaaagagcaccccatcagaaaattggctggtgaagcactgctgaagctaagtcaaagcgaaaccaatgctgccatcatcttgaaggcaaatgatcatcttgtccgtgatctccgtaaaatcctactagatgctgcggccaagggcacaaatcgaat

SEQ ID NO: 60905 - DNA, 423 bp, Triticum aestivum
  Clone ID: PAT_TA_60905
agcctcgacaccgtaggcaccgtcaagacaaagatccactgcatggagggcttccccacaaacctgcagtgcctcatcttcaaaggcaagcagctcgaggacgacgagcgcacgttggccgagcacaatatacacaaggattccacgatccttctcgtcctccacccacgccccagaggtgggatgatcatcttcgtgaagatgttgatagggaagaccctcactttcgaggttgagagctcagacactgtcgagagtgtcaaggtgaagatgtaccagaaggaaggtattcctccgatacaaacacgcctcatcttcgccggcaaggagctggacgacaagcgcaccctggcggagtacaagattcagaaggaggatacccttcatcatctgctctgcctttgtggttgttgatcgagatgc

SEQ ID NO: 60906 - DNA, 442 bp, Triticum aestivum
  Clone ID: PAT_TA_60906
cacgctgcgagaagacgacagaagggtacaaaaatacttatcgggttgcatggtcattagttaccatcaaaaaatgcataaaagacaaagaaaagggctacaattactagaatacgtctaaaaaaaagcatacctcatcactgcagtttggtgggacatgcacatgcatgaacttcccaagaccttgtaaaaccgccaaacaagcaaaaatcgacgccaaactggggtttcaactggtgaattgttgagaatgaaaatgagtaaggaaaagtataaatagacaaatgcatttccagtaagtacatgaactgattagaaggaaaagaaaaacaaagttaccggtagtttcccataagaaatttcgtctgcttggacatccatactaagcaattcagatatcttctcttttttccaaacattgatagcaaatgcaccatcgggc

SEQ ID NO: 60907 - DNA, 423 bp, Triticum aestivum
  Clone ID: PAT_TA_60907
gtacccgccgcacaaccgcagcttctacatcggcagccgcatgaagcaggagccaacgtccccctccccgcgcaataatgaggatgttgctttgatttctctatgaccggtggtcattttgttttgtttgatcacacatttgtaaggctaaacttgttacctcatatgttgcgcatgattttgaacgtgatgaactagtatgatgatgaactagtgatgtatatataaatttcatgtattcatatgcaagcacttgtcaatatatgtcctatgaatatatatttttttgcgaaattgcgagcccctggcacggaacagatttcgtaaacccgtcccgcaagacgcgtttataccagatctgctagagatgctctgcctccaaaccggacaagtaggaatttttgtgattaaggattgaatggc

SEQ ID NO: 60908 - DNA, 362 bp, Triticum aestivum
  Clone ID: PAT_TA_60908
ttcaagggtccacagaacacgacagaagggtacggctgcgagaagacgacagaagggggaggttgagattgagcaatgcatgcctttatcacttgctagattctaaacaatctaatgttcttccggtctggctggacatcatatctatcctaagtagatcatgccccttctcattttcatgcttccctagcgtagcacgggcaccttgctactagtacaccaaaactcatgcgcccggtgctaccgtcatccatggtctagcgcaccgccactccacttaccaaattaagtggaaaccttgttgctcggggcattgttggatatttaattttatcttttgcacaaaaaagagacggcatagc

SEQ ID NO: 60909 - DNA, 435 bp, Triticum aestivum
  Clone ID: PAT_TA_60909
catctatcaacaagacctgcgtcgattccacgccagaaatgtgagaggtcgagcatttcaagagggagacttggttcttcgagtggatcagcagaaaccacacaagcttgctcctgcttgggaaggccccttcatcatcaccagagtgctccacaacggagcataccaccttttacaacgtcgagcacaagaaagatgagccacgcgcttggaatgcggagctgctccgccccttttacacttaagttttcaggctgttgagatgtaataagaaataccttctagtttgattattaaagacacagttttttgttgcaatctcataaatgattgttgttccttttttagtctctaaatcccccagtgggtggcttagccgcgaaaccgtttcgcctaagttcgaaaaatcctaccgagtggtgagcaggcctctca

SEQ ID NO: 60910 - DNA, 264 bp, Triticum aestivum
  Clone ID: PAT_TA_60910
catggggcccaaggatgaccctgagaagttcaagaagatcagggagctggagctgggccaagggagcaagcagtgctgcaagttacttggggccagatcgagtaagatggcggaacatggcgtgtggcggcctaatttgcctccaagagcagtactgtttacctgacatcaagttggtgtcatgtactgtccatgatgtagtgaactgtacgagtgaaatgaaattttatttgctgttgggaaaaaaaaagagaagagccgaga

SEQ ID NO: 60911 - DNA, 426 bp, Triticum aestivum
  unsure (1)..(426): unsure at all n locations
  Clone ID: PAT_TA_60911
gggaccacgaaagaagggtacggctgcgagaagacgacagaagggtacggctgcgagaagacgacagaaggggccgctggggaagagcttcaccatgacgtggaacatgcgcatccaagcatagttcggaaagttgtgcttccatctgcatgggcgttcgtcgttcgattcgtcgtgtgtgtgtgtgtctaatttattagagcctatagagtagttcatctcatcgtgtttgggtcggttctgtaacttgtgtgggggttggttacctaccctccaacaccatttgtgaaggagccggatcccctgacgtacgggcacctgacattggaccactgacgcgtgggtctggatccacacgtcagcgagtgcgccgtacgtcagaggagctgcgtccatttgtgaagctcactcttgcanggaataaaa

SEQ ID NO: 60912 - DNA, 378 bp, Triticum aestivum
  Clone ID: PAT_TA_60912
ctatggcaacgaagaaatgggccttgccgcgatgatgaccgacggtcgagtctaaagttgtgggacggaacatgtcacctactcacgtgttccatgaagcaatcaaggacggatcgcactagattctgcatgtcgggtagtaactgtcaccataaggaaaaacagatctgcgatcgtaggcgaacactgatcaggaccataggaggtctacaaatacgggagggcacgtgttcaaattggttagcatcgaaggagtaaagtgcaagcgtcaataccaatcatcggatgctacatcgctgaccatgtcaatggaatgacagtcggacgaccggtactatacgagaagatcagacaggcaagaaaatcgatcaatgccat

SEQ ID NO: 60913 - DNA, 398 bp, Triticum aestivum
  Clone ID: PAT_TA_60913
ggaagctgcggcggacgctgaactgatggctcgataggcacacgacagcatcatatgatccgcgtaaaatgtgtcatcctatcagacggattgatcacagtcagaatgcccacacctgtgtgtatcgccaccatctctatttgacagataagctagtgtctgtcatgtcgagtagtagtctcctgcactcagtcaaggaggatggatgtatgctctgtccgttgcaatatcaccgcgtgatagcactccgtgatggatgtaatgattgcgcgtcagtcgaactactgtggcttcacttgtcgaagcctgtaccattgtggaaccgctactcaacaggctcaacccctagctacacgtccaggagatgtcaaagatctaccagaatgacctgagcattc

SEQ ID NO: 60914 - DNA, 394 bp, Triticum aestivum
  Clone ID: PAT_TA_60914
tgatgcgtccgaaaggttacgcgcagctgatctgtacatgagcggtcgcaattctgcgcacatgtgtgagtagcaacatcggccagatgacagcgggtctgtttcaggtgttggacctgtcaaacactaattcacagttgtcaggtaagtaatcgtaaccagatggctcatgtgacgatgatgccaagtgcataaaagagcacttgtctgggggttcgaagctctgcatgctcctagcccatatctgatttgatacaacttaagacatctcctgacctttacagcttcccatgccaatggcgatcatattacactgactgatctgggatgtgtctgacgctacaaccatatgtggcatgcagtaaagttccatttaaccagttggagattcacc

SEQ ID NO: 60915 - DNA, 286 bp, Triticum aestivum
  Clone ID: PAT_TA_60915
cacatccacgtcggaatgctcaaggatgatcgtaccctaaggttagtcctgatgtgcatcccgttgatactgccgcatagattgctcaggtgcatctgtgcgcttgcgcaagtcactgatgtcaagaacacttgactacttcattcacagagtcatctgttacaagagttcgaacgtttctctctgcaggcttccacgacattggcgtgatgtccaacctagctagtattgaaactgcttccagccaattcacattcaatatcatcatccacgtgtttgcccacag

SEQ ID NO: 60916 - DNA, 370 bp, Triticum aestivum
  Clone ID: PAT_TA_60916
ccaaccatccacagagatccaaactcaggtgccatggagacagtcatgggggtattgccccacatgttttgccaaactgctgctgccatggcaagtgcagtgacggactatgatatcatcatgcctcacaacgactcgcttaaatttctggcttatgctcacgatttaatcatgctgcgacacttactcagcatcagtcttccatcaatactacgcattacatcatgatacatggcagtgtttcatcttcatccttaatccatctggcttatcattttcaaaaggatcctgacactcgcgtggctatcctacgcattcaaggttctggccatagattaacatttactgcaccacatcatgttgtaattgc

SEQ ID NO: 60917 - DNA, 400 bp, Triticum aestivum
  Clone ID: PAT_TA_60917
ctcgcgggtcgacacgagacaccaaactgagtcgtggtagccggaatcggtgtcaacgatgagctgaggcggaagacaccacaggatctcactgggaacagggttacagggcacgacagcacacactacagggttcgatggcctcctggcactgccaagagcaagttagagtgctcggacgcgagctttgctcgttgtggccgtggcggagaggtggacggcagcgacgagctcgcgggtgcgacgatggggcaaacgaacgggggtcagaggacaggaagtgaggggagaggaatatgagtatgttgagcctgtacgtgagagacgtgggcttggggggggctcgatggcgatgaatccaatggcgatgccagtaaaacacgatgcccttcgcaaaaat

SEQ ID NO: 60918 - DNA, 379 bp, Triticum aestivum
  Clone ID: PAT_TA_60918
tgacgcgtcttaggcctcgcagatgatctgtattcggggaatttctgcatgtcgtcggatgtattacgtgtctttggtacaagtgtcagcatgagtgtgtatcggactcctaatcaaatcaaagcactcctgagtgtgtcattcgactaaatctaagcgtcttaatcactctatctttcgagcatctggcatgggattcagtgtggagttttagcgttttggacctcctcgcttggcgactcacagtcactggactcataaggtacttgaagaaacagttgcacacgcttggcatcagtccagcatgcctgcaaaaggtaccaatgcaccctgtactacagcattttgtacacagccgtatgtaccccagagacattac

SEQ ID NO: 60919 - DNA, 365 bp, Triticum aestivum
  Clone ID: PAT_TA_60919
ttcaagggtcgacgcacagtcccaaatgtcggtcagcaaagagcgagaagacgacagaagggtgttccttggagatgtgtttgtttcaccggttgataatacctcttgttatctgctgcaaaaaaaaaaaaaaaaaaaaaaaaaaaaaaaaaaaaaaaaaaaaaaaaaaaaaaaaaaaaagaacaaaaaaatccaaacttaaaatatgaatcaacacaaaatcatacctcttctataatatcaccaaaattcaaatcaatggacgtcattttacaacttcgttatcagaaaaacccttcagttaaacaacttaatcaccttacagaacatcactatttcaacatctggcataataaccaagaggc

SEQ ID NO: 60920 - DNA, 389 bp, Triticum aestivum
  Clone ID: PAT_TA_60920
cacgcatgcgtcggaacattagttcatcatggctagtgcactggctggcagcacctggccttctatgtcctctattctccacatgccgttcaccttgcgttgccaagggagatcccctgcaatgtcacaacattcttgctgggtcagtgtgatccgatgttaaatggtatatttttccctatcgtgtccttgcacaaactttatgcgattgttatcagttggtcagacgtcatgacagtgcttccttggaacgttattgaagcaactgggacacatttaccggattacttccacatgattatgtctgaatacagattatgacactacgagttgtctgggctcatcgaaaattggcttcctcccgtcaatgtactgcttgctttcatctt

SEQ ID NO: 60921 - DNA, 438 bp, Triticum aestivum
  unsure (1)..(438): unsure at all n locations
  Clone ID: PAT_TA_60921
ggggccacataaacacagaagggtacggctgcgagaagacgacagaagggtatcatctgtctgtggattagtagccgtatttagcggtactctatatgccatgactaaaggtgccatcaaccagttaaccaagaacctagcatgtgaatgggcaaaagatggcataagaacaaactctgttgctccatggtacataacgacttcgcttacagaaggacttttggctaacaaggaatttgaggcctccgttgtgagtcgaactccactggggcgtgtcggagaaccaggagaggtatcatcgctggttgcttttctttgcatgcctggttccacttacataacaggccagacgatctcagtggatggaggtatgagtgtcaatgggttctatccagcttgaagactanncaaggaagaggcatatttcgctttgttgcc

SEQ ID NO: 60922 - DNA, 178 bp, Triticum aestivum
  Clone ID: PAT_TA_60922
actcgcgggccaacagaacacccgaaagtgagtcctattagacatggtgtcccattttggatgttttgtttacaaaacattgcaatccaggatatgtgctcacattttaccaaaaagtacattaatatcttttcatgattgtacttattataaagccacaaaaaaaaataaaggaaaa

SEQ ID NO: 60923 - DNA, 212 bp, Triticum aestivum
  Clone ID: PAT_TA_60923
ctcgcggtacgacgtcagtccctacaataattctaatcacagcatatgtagcttggctctcgttactattctcattactaatgatatcatcagggcgcttcccccttgcagcaactgctttagttctcatacgcttgtacccagttattagtgcactgctccgtggctggaaaatagaaaccacagaaaaaaagataaaaaaaagagaaaaa

SEQ ID NO: 60924 - DNA, 422 bp, Triticum aestivum
  Clone ID: PAT_TA_60924
cccaaaataaaaaccgtcaaagaacaccttcggcggtctgccgtgcagaagagggaagcaattggcgaagaagtggctcgactgttgacagcagagttcatccgtgaaatctaccactccgagtggttagccaatgtagtcatggttcctaagaaggataattcacttcgtatgtgcatttatttcaagcatatcaatcgggcctgcccgaaagatcacttccctctccctcgcatcgatcagattgttgactcaactgtgggatgtgagcgcttgtctttcttagatgcatattccggataccaccagatccgactgtatggtcccgatgaaataaaaacagccttcctcgccccattcgggtgcttttgctatgtcaccatgccttttggtctgaaaaatgccagagccacattcatgag

SEQ ID NO: 60925 - DNA, 158 bp, Triticum aestivum
  Clone ID: PAT_TA_60925
attcccgggcctgacaactgcgagaagacgacagaacggtacggctgtcgataagacgacagaatggtacggctgcgagaagacgacagacgggtacggctgcgacaatactacagatgggtatggccgccagaagactacacaagggtactgctgtg

SEQ ID NO: 60926 - DNA, 335 bp, Triticum aestivum
  Clone ID: PAT_TA_60926
cctatagtgagtcgtactacacctcaagatgttgtgccgacccagtctacaaggtgctcacaaggggtatgatgtgcacgcgtgtgttcatagggatgattgtatgtacgtatgtatcagcgtatgcatctgtactgtgttaagagacgtagataatcagacatctattctaaattttagtggtgaacactaatgaggcggccttcgcgtttgtatgagtgtatatatgcacacacacacacacgttgtacataagcatgattaaacctttatgcaccataatgacacctatatgcacagttcaagtctcaatgacaccgccatgcttttaaatg

SEQ ID NO: 60927 - DNA, 411 bp, Triticum aestivum
  Clone ID: PAT_TA_60927
gtcatggactcgatgggcacgcgaaacgtgaagctccaggtccgggatctcccgtgcctcatcaacagctcgggcagcagcagctgcttgcagctggaaggacacgattcatgacacggtgaggaagtctaaaaaaggatcttttcttaccctcaactgtatcatactgtggtaggtgtagtctacgctgtgtagcaacagggtttggtagtctgtactgtacgcgtgtagcgtgttatgtagcggcaatggcgaacaggaagtgtagcgatcgtcgaatgtcatggaggtccctgagaggatatcatgacaataatctgttgtcatgagggtctgcggtgcctggctgccaatgtatcgaaaactcgaactcctggctgtgttatgcatgccggaagaaaacaatgaatg

SEQ ID NO: 60928 - DNA, 390 bp, Triticum aestivum
  Clone ID: PAT_TA_60928
gacgaccttcagatccacggacttcccgaggacagcgttagccgcttccggcagtccgcccctctgactcgatgaatgggcactttgatacgcgagggatttcgctgtgggggataacgtttcgcatgggactagatacgtgcacatagagctcaggagaataccagaaccaactataacagcggcgatccagtctctcgagcactatcagtcccgccagatcaggcttctcgggcgcgcacgtggactgcactatgatcgagaatgtgcgaattgccgcggccatcgtcggcagacgaatgtaccaccaaatgtcctggatccctgcgctatctctggacagctccaccagatcatcttcacactaatgtaacgtgatagatgcccacc

SEQ ID NO: 60929 - DNA, 391 bp, Triticum aestivum
  Clone ID: PAT_TA_60929
cccagcagcactcataggcggcttctcggcattttccgtttactagacaatatactagtattaaaacgtagcggaaacagatggaactagttgctgtcattgtttttttttctcctgcagtaccggagatgaatacaaaaaccctggaaccaagtactgaaatgaatactaccaaaaacgaaaatggaacaaatacggcacggatacggagacgaaagccgagtgttaaccggaactaaagaccccttgaaccatagacaaaataagaagaaaagaacaaacttgttcagttaataagatgattactaaatattatgatataccatgactataaaataggatatgtcagcgacagcggtgtgctcgattaaggattttctctcgtgctggc

SEQ ID NO: 60930 - DNA, 399 bp, Triticum aestivum
  Clone ID: PAT_TA_60930
tgcggctattgacaaacctggcacaatgctcctcacgcattatcggcaatgcaggagtggtacacgatgacatgatggcacacacacatttgggcgatgacaagcttctgatcattcctatgatgaccaccggtgtactggaagtcgaagacggccactttgtacatgtcaaccttagcaagcaaattcatcatggtgttgatggagtcctccgccgatgccgggttgttggtgtacaccaccaagacgtcgttcgccctcatgtgggtgtccacatgatacacaccatgctccattggagcgccactagatatcttctctgtattacttcgatgcatctttcgaccgtcatgtttattaggacacccatcatcagtgttagctttccttgcatgatca

SEQ ID NO: 60931 - DNA, 327 bp, Triticum aestivum
  Clone ID: PAT_TA_60931
acgcacgcgtcacatctgcactgtgatctgcacgcccagattaggaagatcatcgccgatcaagatcgcgacgaccacattttttgtgtccccccaatgctcataggtgggcaacctagccacggatccaggctatcaaaactcgcatccagtgcggatctatccgttgcaagggtatccgaacagtgtgacacaagcaaatagtggagtttgagatcggcggaagtactgtaaaacggtcgcgtactacatgtatgtgcagatgtacgcatcacatgccttgaggcgttctgtggtactaatcggaccacaatgcaacggtgaaaa

SEQ ID NO: 60932 - DNA, 427 bp, Triticum aestivum
  Clone ID: PAT_TA_60932
gaaccgaccgcatgacgcaatcaaaatcaacagtgtactgaaatgtaaccgaccgccggaaatcgcatttggatgctgacgagtagcgccagtaccgaatcccatcctcacctagaaatggccctgcgcggtctcctcggctgggttgccggacagatcactggtggacgacacaactagcacactttgattaagtagaaagtacatccattagatatataaactactaatacgcatacgtgaaaagtgcacgtacggtggatggactagccaaaagtgcagcctcgttcttaaatggtaaataataaagaaaaggaatgatagatggaatcttccctatatggtgccaccgatctggatcgccattgaccggtcctcctgtagtgcatgatcatccgaaggatcgaggtcccagcccccaagcccg

SEQ ID NO: 60933 - DNA, 435 bp, Triticum aestivum
  unsure (1)..(435): unsure at all n locations
  Clone ID: PAT_TA_60933
ccaattacctgtcagttgtttcctaatgtttgggatgtcgtctggggtgaatcttggaacaacccttgcttcgcaagcactagtgaatttaagagcagaaaccccgcagtcgaacctagacgacaaaaaaatatggaaaacagtatgttcttagttacctaatctcatatatgtactagcacttagatgacctagataaagaagaagaacatgacatatcaaccggttttgagacgtatggttgcttactcattgttttgcttcggtacatcgatattgattagtttaaaaccatccatgccaatatgagattttgggtaatgagtcgcccatagaattcgaacacttgaaaccatacgccttgcgcaatcatccagggacttgttggcaagagtcctccgcgaatcgagcacctcanactttctgtcccttaaa

SEQ ID NO: 60934 - DNA, 336 bp, Triticum aestivum
  Clone ID: PAT_TA_60934
gatcaaacctaccacgtgcacgtgcactcactcacttgagcatttccataatcaaccatattttaccaggatcatgtgtcaaagatcctgccaacacatcatacgagcatgatgcataccggtggaagatgcagctgcaagggaagatctcaccttctcgaatttcaccttagcgaagacacgggaagtatctctcgatgatcaactcacagatattcaccagtccgcatccaatgatcacattgctgtgctagtgtgacacattcaacgatatggttggttaactacaatatcactttgcaagtctggctacgtgatatcaattatccataaggg

SEQ ID NO: 60935 - DNA, 422 bp, Triticum aestivum
  Clone ID: PAT_TA_60935
gacctatgtatgcatgggcatgtgatgtgagtaaaaccagacggagagggagagggatatggaatcagatgaacaatggagaaacgacggagatggagggcgcatcggcgatgctcaccggtggtgatgtgctctgccgtggttgcatggatggcatggggaatacaagcgatctcttggacgtcatcgatgcgacgatgatgacgttgggtgccatggttgagatgttcttgggcaagagcaccatggatagatgggacagtgatggagacacgacgaatgtgttagacggggaaagtgagggatagaggagggattctgccgatgatatggagatttcacatacctctaattagtacttgccaaggttatatcaccgctctactactatcaacttagtactaacgtgggtttgtacccct

SEQ ID NO: 60936 - DNA, 438 bp, Triticum aestivum
  Clone ID: PAT_TA_60936
catgcactgtgacgcttcagatattacaaatacaagttgccacagcccaaggaagagccgcatggtgataaccttctggaggaggaagaggacgataaggaagaaagggaatatttagctacattgacaaagaagcaacttctattccttgaggaagatgacgctacatcggaagaggatgataaccttatggataaaactgaggatgattgtagtatggagtttcttgaggagaagggatttttcattagctttgaagaagacggaacactcgattggtttttctactctgcttactgcgaatgtgcttccctgagtgactatcaacgcctagtcctaaaaaaattatggtggtaccgagtacagcatgtggagtgtctaccctagctaccgtcatagctatgatattgaacgagagtatctcaagtactgccagga

SEQ ID NO: 60937 - DNA, 410 bp, Triticum aestivum
  Clone ID: PAT_TA_60937
agaagacgacagaaggatacggctgcgagaagacgacagaagggtacggctgcggaagacgacagaagggtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaacgaaatcggtggtggcaagtaagcagctgtgcgtggttgcctacctgcgata

SEQ ID NO: 60938 - DNA, 421 bp, Triticum aestivum
  Clone ID: PAT_TA_60938
ggtgacggagatgaggggctttatgggcctgggagcctccacaggcgcgagggtcacgttgagcaccgtggatcggccgtcgtagtccacccaaacttgcatggcatcgccggcgatgagagtcaggttcttgaaatcgccagtgtcgtcgtcgtagtagcctgcaggttcggccacgacggatgccaggccgttcacgtcaacgccgacgtggttgctgctgatgtcccgaaactccgggttgaggatggtgtcaagctcgacggcgaagacgtggttgctcgcgttgccgttgttctgggggttgaagaggccgaggaactggctgggcgacgccatggacaggtttttggtgggcgcgacgaagaaggcgaggccgttaccgcccaacgtgaccaggtcggtgacaatggcgaacacg

SEQ ID NO: 60939 - DNA, 143 bp, Triticum aestivum
  Clone ID: PAT_TA_60939
gcctacaccgcactgccctgtatagtatgggactaccactaataagctcgagactctttcggtttcctcctgcagcttggcggagtaagtcttggaagagtggtgcaccggagatctgtacaaattgatataagggcatcttc

SEQ ID NO: 60940 - DNA, 429 bp, Triticum aestivum
  Clone ID: PAT_TA_60940
cgagaagacgacagaaggggaatgcccgtgcgttgctacggcctacaatggatagagaaattagactacaatgattaaggtcatctcttaggtcaaagcatatttctccttcatatgtccatgcgtgttcggacattaaacaggctcccaaaattcaactgtttggatagtttggctcttcaaatccagaccatacgtggaggagaaaaatggtcttccggactatctgccatgtcacgtaggtccaacaaaaaaaaccaccccacgatgtagccttcccttttcctgttggatccccccattccctttcggtttccatcatagcggaacatttcacgttggagccctctcctttaaaactggatgacacccatctcacattcgccgtgccgtcctcgctcctttacactgtactttcccatgggacgc

SEQ ID NO: 60941 - DNA, 303 bp, Triticum aestivum
  Clone ID: PAT_TA_60941
gtgcgccgtaatcgccggatgcgtgggcgcatcgccaagaaacgagactttgctacagcacccttctaattaccttcacatccctatcgaaaaagctaccatcacatccatgtaaaacgggggtctacagttttgcctgttcatagagcttttcttgtaacgtagtattagcgagttctgttgcagcagtagatctttctttttttttggaccgaagaccatagaacaatagttctaccgtaactttcattcaaataaagcaagtttatgtacagccaaaaaaaaaaaagaaaaatgcgaaaa

SEQ ID NO: 60942 - DNA, 416 bp, Triticum aestivum
  Clone ID: PAT_TA_60942
gtatcctgacagacttttcgcctcacgccgcttcacgacttcccggcgaccacaatcacaacatcaaccttgtttcctctagatcaacaatacctttcgaacaacctagctcatgataccacttgttagaataaatccgagacgctccgtcgatctattaaggaccaatcaatcacacgagcacgacaccgagatttgttaacgaggttcaccgatatggctacatccccggggcctgactatggacgctcctctcgtgacaccgtcacaattccacacccggtcgccctggacaccggcacatgccgccggcttcccccgcgttccggtgctattatgttggcataggctacatcgtgtgtctacctccgctatatatgaaagggctaggatacaagtgtcctattaggacataa

SEQ ID NO: 60943 - DNA, 410 bp, Triticum aestivum
  Clone ID: PAT_TA_60943
gattgggacgaatggtggcatgggaacaagactttgtctcaccacttgaacgactggtggaacggccgctagccacctcaaactccatccatctggatcgatccatgcatgtaccacccactatactactacctagttacagcaattccttttcatcttgctcaaccacttatgtactattagctagctgccgctggtgtctttttagttctatatttgttgtactgaaccagtcgtaagagagggagtttttagttccatctacctagtttttttctgcgttggagcaattcaggtgtactacacccgagagtagaaaacattttgttattttttggtgaaactttgcaaatacctaaaacatttgttcatgtttgatgtcacaaaatatatagtcaaaatttgcgtgc

SEQ ID NO: 60944 - DNA, 225 bp, Triticum aestivum
  Clone ID: PAT_TA_60944
gggtcgacttccatcaaagagatattcatcatctcatcgaaagacgggacacctttgcctctatcagaattagtattatccatagcgtgaagtagtattactagttgaaaagctagttttatcaactaaacaaaatcttggagacggtgctacaaaactaatcattgactgcattagcacttcggcttacagaagcaacaaataaaaaaagaaaattgaaagaaa

SEQ ID NO: 60945 - DNA, 411 bp, Triticum aestivum
  Clone ID: PAT_TA_60945
cacgcgcgcctttgcacgtaagctttgagtgtttgtgctgcctgcagtgtgcttgatacaatcgtcacgctcaacgccggcggcatggtagtcatacgtcttctttccgtcctttctggaactgaatatgctgctgcttactcccagcccatgtcatcgtgttcgtgccaaagctgctacgcatgccaactgtggctgcaacgtgcctgactgtgcctgcacagaccggggacagcttgccatcctataggagacacctttgtgcgcactgctcatcggcctacacgatccacagttgactgtactgtccatggaccgactcggtcagctctcgttgtgccgaaaccgctctcatcagctaccgaatcgattgatcatacactttttaccagcttcctggctgaatgccta

SEQ ID NO: 60946 - DNA, 222 bp, Triticum aestivum
  Clone ID: PAT_TA_60946
ctggtagctattcagatcgcatattacacctgaggaggtcgtgtttggtgcgactcatctcgtttctgcaaacttgtcctcgcttggtgccatttttttattttttttgagaactagtactacttgcccaatgtccgtccagtagcgtgttttatatgtgcgaaagctatatcagtgattctctaagtattgacctgaacaaactgcacgaaaagcaaaata

SEQ ID NO: 60947 - DNA, 450 bp, Triticum aestivum
  Clone ID: PAT_TA_60947
gctgcgagaagacgacagaaggggtattttttatatattccaaaaatattctccataaattttcaggtcaatccgagaactttgatttctccacaaagagcacaccatggcaattctgctgaaaacaacatctatccgcgttagttccattcaaatcatgcaaactagagtccaaaacaagagaaaaagtgtttggaaaagtagatacgatggagacatatcaactcccccaagcttaacacattgcttgtcctcaaacaattcagttgacaaactgaaagtgacaaagaaaaacttttacaaactctatttgatcttgttgttgcaaatatgtcgaaccaatgttcatgttttcagcaaggattatgaactaaccatattcacaataacacttaggtctcacatttactcatatcaatggcataactaactagcgagcaataataagat

SEQ ID NO: 60948 - DNA, 246 bp, Triticum aestivum
  Clone ID: PAT_TA_60948
attcgcgggtcgacatcatatatgtggcaaagccacgatgcatattaattcagacatgtcactcttgagtcaatgcccatctgaatacagtaccttgttctagtaccgagttgtgatcattgagttgtaaatgagtagaagtgtgatgatcatcattcatagagcagtgtcgcagtaccaaatcgagaaaggctatgagaatgaaaaagaaaggcctagaattttacatttgcgagaaaattgatt

SEQ ID NO: 60949 - DNA, 345 bp, Triticum aestivum
  Clone ID: PAT_TA_60949
cacaactccccatactgagtcgtaataaccacagaatggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacacaagggtacggctgctagaagacgacataacggtacggctgcgagaagacgacagaacggtacggctgccagaagacgacagaacggtacggctgcgagaacacgacagaacggtaacgctgctagaagacgaccgaagggatattctcc

SEQ ID NO: 60950 - DNA, 430 bp, Triticum aestivum
  Clone ID: PAT_TA_60950
ccaaaggtttagcttttgctgagtatgaaacagaggagattgcccagtatgctgttaggctgttttctggccttgttcggcttcacaatagaacacttaaatttgcggtgcgttcttttttctccctggttatttaatttgctgtagtatagattgcagtgtgttgttctttgggtatggtgaattacattctctgtgaatagttgattctgggtccaatccaatacctgaggttcttggcattactaggtttctatttatatatttatttacaaagcagtagcaaaagattcaaccctgaaattatgccctttatttttgacagatttctgggcaagacaaagcatcttcaaatgtcaatgttcctgtaactcctaaaatgaagcctataccactatcaaatccacctcaaccaatgagatttggtgat

SEQ ID NO: 60951 - DNA, 332 bp, Triticum aestivum
  Clone ID: PAT_TA_60951
cctaggattgaatctcctcgagaatttgtttagccgaataccggtgtttgtgttttgccattatcgaggtgcagctcggcagggacgatgttgaactgtgctacttgtgagctgcactgtgatttcctcgaagaggaaaggatggcgcagtacagtagagataagtatttccctcagttaagaatcaaggttatcgatctactacgagaaccaagcaacacctctttagcagtacctacacataagataacagagactagcacccaacacaaacaatgggttgtcaatcccttgagggttaattgcaaggatcaactctcatagtgatagat

SEQ ID NO: 60952 - DNA, 426 bp, Triticum aestivum
  Clone ID: PAT_TA_60952
caccttgaatgatctgttttcactggatccagtttcatacgaacatcttttgcagttaaagcgttatgagggcaaactcttggatttggaattgcgtttcgttaccacaaataatgaaaatgctgaccaatctgaagaattgcttcctggtgggagaggaatgcgtgttactgatcataatgttactacttatattcatctaattgccaaccatcgtttaaactatcagatccgtagtcaaagtacacattttttgagaggttttcaacaactcataccaaaagaatggattgatatgttcaatgaacatgaagttcagtttctcatatccggctctccgaaaagtttggacattgatgacttgcggtcaaacaccaattatgctggaggatatcatgagggtcatcaggttattgatatgttctg

SEQ ID NO: 60953 - DNA, 424 bp, Triticum aestivum
  Clone ID: PAT_TA_60953
gggcagcacgcagactgcggtggagctatgatcagcaaattgtcgaacaccacatggcccaaaggggccttcatggagacaatgaaggtctggcaacaagagtggttctacatcaccgagccgcgccgcactaagtgggcagcgattccggagttcagattcggaccccccatgaggctcacctcctggaatgcgaagggccatgactgggggtcccagatggaggtgcatgagctgcaaatgtgcatcactaacatgctggggaagaacgttggtctatccaacgtggttcagatcaagctcttccgctgcattctcccctaccagcgccgggcctcccccatgtgggaattcaaaccggagggaccccgggcgttgccccacttcctctgcaccatgaacgagtcatgaggacatcaatacc

SEQ ID NO: 60954 - DNA, 346 bp, Triticum aestivum
  Clone ID: PAT_TA_60954
gaatttggtaacctgatgagtccttgacatgaagaattgtatagtctggtctgtctcgctggcacggtgaaaatgttgcttactttagttcagttgatccctagtatagaggaaacataagaaaaccgtgcgtcggttctattctatggatgatggatgtgatgttgtatttagggggtctttgacatgctgaattggtggtgctgcgtttctgatttcatttgtgtagccgtgtggcttctggacgagggcaatattgcttcctggctcatatgaattggtctcttggcctgcctagtgggtggcgtttctcatcataataaagaaaatagaggaattcaagaaa

SEQ ID NO: 60955 - DNA, 225 bp, Triticum aestivum
  Clone ID: PAT_TA_60955
gaaatatgacacggagacttaatcttgatatacctcagaacaatacattcttgttaccacgagatgtattggccgctacggatcatttgattggaatgaaatttggaacgggtatacttgacgatgacgatatgaatcacttgaaaaataaacgtattcgttcggttgcggatctgttacaagatcaattcggattggctcttggtcgtttacaacatgcagttc

SEQ ID NO: 60956 - DNA, 393 bp, Triticum aestivum
  Clone ID: PAT_TA_60956
cactgcgagaagacgacagaagggtacggctgcgagaagacgacagaagggtacggctgcgagaagacgacagaagggactcaccatgttgctaccgcctcactaaccagagagactccagtttcatgttttcacgccctggggcatggcatctcagttgcttttgcaactccagcttgtgtacgggcaatgtttagccctgccccacctttgtttaaagttgagtggtagttgaatcatctcgtccagggtaagcttcgagcgctttgtgcatagccatggatgagatgaccaataagttgattcaatgtaaagtagaataaccacttgttcgtacggccgttggcgattccacgtttagcccgttcaaaaaaaaaggagttttgaaaataa

SEQ ID NO: 60957 - DNA, 442 bp, Triticum aestivum
  Clone ID: PAT_TA_60957
acaagacgacagaagggtacggctgcagaagacgacagaagggtacggctgcgagaagacgacagaagggctgatccaacaattgaaggctagatttcaccagaggcacactaatatccaagtcaaccttcacatactcgatggcacacgactttagttgttagatccaactaatgaatgacagaacgacgcttttgccagaacggggcttttgcccaaccaacataggaaaattgacgtgtgattgtatggcaaagccacgatgatcgaagaagctctctaacgcttgtaccagattcgacagcattagtcgtgcactgcacgctagcattacaccgctacagagcgtcaaaactcctatggggcaacccgccacctgcatgtgtgaactaatcctaaatgggaccctccacaaatcatttgatgggtccatagaatgtgg

SEQ ID NO: 60958 - DNA, 237 bp, Triticum aestivum
  Clone ID: PAT_TA_60958
cggagttgtcttcaacgtcttcgagcatcttgcatctggactcctacgcagatgggcctctctaatatctgtcttctctgttattcaaatctcctccgatcatcaggttgtcaatctacgacccagggacgtcccaatcatacggatagatcaccaaagccacatgtctctgagactttggataggcatttaccgacatctgcattattaagactgccgttacctcctcatcacgat

SEQ ID NO: 60959 - DNA, 369 bp, Triticum aestivum
  Clone ID: PAT_TA_60959
gtcgacggaggtccgtacactcgatcgaaagagacggaggacatactctagcgatgcttgctaccttgtggggcgacactatttgtctcacgcatacagggctagtttggatcgagtcctcgacattgtgcctggaggaaagtgctgcctggagcctggggtggtggaccttttttgcctggccaggcaaacctgggcatgtatgtatggttccatccctgggtggcgtttttgccaattagtgactaaagaacttttacacgatggaccatactgcacatgactcttgaaagtgccaggcaactggccaagcgaatgacacatgacgcctgagtcacgcgattatcatgagacattcatcattgtcaa

SEQ ID NO: 60960 - DNA, 399 bp, Triticum aestivum
  Clone ID: PAT_TA_60960
gctaagacgacagaagggtacggctgcgagaagacgacagaagggtacggctgcgagaagacgacagaagggtacggctgcgagaagacgacagaagggtacggctgcgagaagacgacaaaagggggaagagccagaggagtggaggaggcttgagcaggagcctcaaggagcacagggccaggctctacatcatccagcgctgcgtcgtcatgctcctccgctggcacgactgatcgactccctcgctccatggatggatccgtccttccattccatggatggtgtttgaagcaaagatatactttttggttttgggtctgtgattgtgctgtgccacaatggtgtcggcacgtagtacttgtacataagaggcgagtcaaattatagaagtagaag

SEQ ID NO: 60961 - DNA, 371 bp, Triticum aestivum
  Clone ID: PAT_TA_60961
gacggttgccggggattttcgtgggcagtgactccggaagatgatcgtgttccactgcctggtatccagaagcaagggatggacacgcaagacagaccgagtgcaccgcgttttatagatcgtcacatccaccggattcccccatgactgagactccaatcgcagaagcctacagacagggatatgtcatgacattgccccaagttggataatggtagtactgtgaatgccgcattcagcagcccgcaccaatgtgatattcgtgtccaatcgcctgtccaaataaggggagatccctagtctcacggttccaacaatgtgcaaaaagcaccacacctgtgggaacatgtaccgctgtaaatgcacagcaa

SEQ ID NO: 60962 - DNA, 434 bp, Triticum aestivum
  unsure (1)..(434): unsure at all n locations
  Clone ID: PAT_TA_60962
ctgcagctagaggaggccccgacctgcagcaggccgtgcgcaccactcgacgctcaggatgtccaagttcttgccactcatgtcgtttaactctgtcgtgctcctcatgaatgaccctgctcacgaaccccctgagacccccctcattttgcaggagcttgccactctaaaacaaactctacaccgtttccattcttcaggagttcaggtacctaggctgctgactatgaaaacccgctcgtgctaattagtattattaaactataattttcttgtaaagtggaaaatgctcatgccccttggacgttggccatgggattttttatgttgtgttcctcccgtccgtccatgattcgaaatgtgttctgaacacttatgttagaacaaaaactgtagtgttcctcacgttcgtccttgattcanaatgtgttgtg

SEQ ID NO: 60963 - DNA, 392 bp, Triticum aestivum
  Clone ID: PAT_TA_60963
gtccacaacggcctgcaagaccatgcagttcctgttctcacagtcaagccagacattgctgttaggctgagctgaagagcacatgacgatgtgtgttgtgtctatggcgccacagcagttggggaggccctggagcttttcgaactttgctttgatggtcgccatctcctcagggtcaggccacttcagatgactgattgcgtgatcctccaaggactcgatgaacttccaagtgatgtttgagattgctgagtggttcattccaaagcgattcccccttctgtcgtcttctcgcagccgtacccttctgtagtcttctcgcagccgtacccttctgtcgtcttctcgcagccgtacccttctgtcatcttctcgcagccgtacccttctgt

SEQ ID NO: 60964 - DNA, 388 bp, Triticum aestivum
  Clone ID: PAT_TA_60964
ggggccacataccatcataaatgtgcaccatgctctttccagaatgagcgtttcagtaagcattcaagctgctcaacatatatctcgtagccgataaacggggagaattttcatttccttgattagagagagaactgcatgtagtttcagagatcaggatgtgtgcttaaatttttatacaggaaactgcgtcctgtagtttcaatgctgattactggttatattccttgtgatagaacctgaagctacttctgtgtgcgtggtcttggtcgtttgtggtgcctgaaagccatgtcgtacttcagactctgcttgggactttggatagttttgctcatgatatggcgcacttctgttggtgacaaatggtagaagggctgataaaata

SEQ ID NO: 60965 - DNA, 274 bp, Triticum aestivum
  Clone ID: PAT_TA_60965
cgcggtagtgtacatcaacgctgctaggatcacacccctagctgaactggccaacccaggacaacgacgtgctcgagaacctcacggtcgcgtggtcatggcagtaaaagcactcggagtggctatgcaggctcggggcggaacattttttgcggctctcacacagctagtagttacatgtcatttatatggcgtttcaggtcagttggccacttcgggtgattttatgcgtatatctctactgagtcctccaattgtctcaaaagagggatca

SEQ ID NO: 60966 - DNA, 372 bp, Triticum aestivum
  Clone ID: PAT_TA_60966
gattgggactagtggtggtatgggaacaagactttgtctcaccacttgaacgactggtggaacggccgctagccacctcaaactccatccatctggatccatgcatgtagcacccactatacctagttacagcaattccttttcatcttgttcaaccacttatgtactactccctccgtttcaaaataaatgtctcaactttctactagctctagtacaaatttatactaaggtcaacacacttattttaggacggagggagtattagctagctttcactggtgtctttttagttctatatttgttgtactgaaccagtcgtaagagagggagtttttagttacaagctagcatgagaagtcacaaggcagc

SEQ ID NO: 60967 - DNA, 350 bp, Triticum aestivum
  Clone ID: PAT_TA_60967
cgggtcgagacttagaaaccaaacacacagcacgacacaagatcggcatgacaaaacaacctgcgatcaagatttgcttgacattgagtgaacatatgacatagtgaaaaaaagctcataaatttaaaacagataaataaaaataaaaaggaaaaaataaaaataaatggaaaaaggagaaaaattatatttaaataaaaaaaatcaggatttctaatagttcataattaaaaaataataataaaatagaaaaaataaatggaaaacggaaacaaaataaaacaaatacagggtgtcatatggaagtccacaaaaataagaagaactaggaccgattcatggcagacttc

SEQ ID NO: 60968 - DNA, 382 bp, Triticum aestivum
  Clone ID: PAT_TA_60968
gttaccgtccatggcgatgatgattagcggtgttcttgatgtatataccaagatgatggagactcgtccctaagtagccgaaacaccttaggaaacggaaaaaccacaactcaaaatctcaaggacaaaagtcaaacgatggtagtgtaatcggtggtggttttgtggaagctcaatgggattgcgaaaatgcaatgattggttttgggacgcaatgcagaagtggagggtaaggtggtgaactatgcacggtgtcggaattggaagcacggtccctaagtagccgaaacaccttaggagacgcagctcacaacacaaacaaaattgggttaagttagggtggcggaagtgtatggtgggtaagcctatacggaagttatgg

SEQ ID NO: 60969 - DNA, 332 bp, Triticum aestivum
  Clone ID: PAT_TA_60969
gacgcaaccaatgctaggattggaagactacaaaatgaggtggctcagttggacatggagaacatgagtgaggaagacaaaaaccaactttccatccttcatatgaaaaatatccaggaagagaatccaggtatggtggcaaatcttatcttcacaaaggaacaagatctcggtcttgaagatctgaacaagctcttcagtgagctctctcgggtcgaaaaagacattagattccggctacctccattgcatggtcgcgaagacaatattggtggcacatgtgtggcacaagatctgcaactaccaagtgttctaccggcggatcatttggg

SEQ ID NO: 60970 - DNA, 283 bp, Triticum aestivum
  Clone ID: PAT_TA_60970
gggtcgacgtcaccaccgacgcttgttgtaagtacgtccttgggtgttgtgttgggcttgtggtgctgtgcccacagctgaaccattgttgcgtgtgtgttgtgttttgtgcgtctgtgttggaccttcgtgcggtggcgtttggtgtgttcgtgtctcgagtggtaccttatgaactttgtgcttggtggatgctttatttataaagcggggcgaaagcctttttcgataacgtatcaatacaaatatgttccaacagccaagaaaagcctgccacgtggaa

SEQ ID NO: 60971 - DNA, 415 bp, Triticum aestivum
  Clone ID: PAT_TA_60971
gaaaacgtcttctcccactgaacgaacatcctccccggaaaggctgaaacaaatctcagaaatgcgagcaccagtgtccggtctgggacttgaaccatggtgggttgataccaccttgctactcgctgtagcgtggtcgaaccaccttctctttccccgtggttcactcgaatgaaccgacatgtcttagttgcagcgccggctccaaaatatatgcacggtacgaggatcatgtcgcgctgtttgagcaagggaggcacggtggcttggtttttggaaattttgagccgatcttctgggggagattagtgtgctttccaaagtgggattccagacgatatcacaatgctaagacaggggaaaggattcccctcttagcctgcaatagtgcgtccaggggtagtgcgagcccaat

SEQ ID NO: 60972 - DNA, 392 bp, Triticum aestivum
  Clone ID: PAT_TA_60972
cacgacggtacacgaatgtatttgtatcaacacggtattgacacacaactatcatgttttcagaacaccgggtgcatatcacaagtgcattgttacaacaagcttacaaaacggtgcataaggctttacccatgtttagacatacaacacactcacattggctcaacaacatctaactgtactagctctaagaactaattacaaccctgtgtccagcaggcacacatcaacggctctgacaaatccagggattcaacacccatgtgtgtcaaatgcaagcacagctgattgcatcatgcttataacttcatatcggcgcgtttggacactttattctcccagatgaacaacatctgttgctgttcctaaaattcgtgtgtcaaatctgaggg

SEQ ID NO: 60973 - DNA, 205 bp, Triticum aestivum
  Clone ID: PAT_TA_60973
ggcagtctcggggactacacccagtgggtgcactcagcgtgcccccactggaatggtatccactcggaacggtccgcccaacccgagtgacggccaaacaacaaaaaagacacgttccaggcgtgaagaaattccgagtaatcagttactcgatgtaggcccatctctacacactatggtatatggttggttgcatagattgcaa

SEQ ID NO: 60974 - DNA, 322 bp, Triticum aestivum
  Clone ID: PAT_TA_60974
tatagatacttaccagaaattaattaaatcctacacttaaaagacctagccgcgaaattctacagcaatcttatggagaactactaagatagaggatgatgttcttagaaagaaagtccttataagcataatttcaaacaatatgaagatcaacattaatccactggtttacatatacctcgtagcagcagtttagagtagaccggttttgagaaatgaaccttttttggatagttttcacttttattagtttaggttttaccttttcttttttgtctcccagtatagcgtaattttacaagtttggttttcatttcttttc

SEQ ID NO: 60975 - DNA, 425 bp, Triticum aestivum
  Clone ID: PAT_TA_60975
gacggccatccaccagccggtcgcctacaccatatggagatgatccacggtgccatgccgctggccggcatcgtgaaccatctggcatagctgctggctgctcgcgcgcatcaccgccatgggtctggagtgggcacttttgcaattattagtgtaggtgcttaggcaaatgcttaggtgcgtacgatgtggtagatgcattggaatggaggggtgcctttatatgagtgcaaactgtgttgcattcacatcgtgctgcctctcttttcccagtcctcccattacttcccttatgcattcgcatgatgctaattgaaggaggatgcatcattggtcgttcaacatttcaggaacagctaccctctccctcatctgcattatagctgtattgggaactgcgtcgcccgctgtcaaatcaaatagta

SEQ ID NO: 60976 - DNA, 333 bp, Triticum aestivum
  Clone ID: PAT_TA_60976
gcaactcctgccgtcgatgctctatggttgtagcacttcggtgcgtctcccccgccctcgcggtctgcatgagttttcatgaacaacgggcagcagtcacaccatgacacggatgtgacagaataacatgttggtcgtagcaaaaagcaatggcggttgcaacacaaacactgtcggagtcgcagctcatcatgaatggaaattgccagtcatagcaaaaattgacgacaattgcagcagaatcatcatcgtcgccgtgaatggctgtagcagaataattcaccggatgtagcaaaaatccacgacggttgcaacagaagaaaaatcatcacc

SEQ ID NO: 60977 - DNA, 378 bp, Triticum aestivum
  Clone ID: PAT_TA_60977
gcctaaaaatgaagttcttcgactgaagactttctgaagactttgaaagtgaagaaattggtgtgaccttgaagacttggtattagttcgaggaacatgaagcgtgaagacttttgtttgcgtagtttcattttctctttttgagtcataggagacaacgtactgttaaagggggtcgaggaaatactaaggaaaaatttccaagtgatgctcaactcaaaatcgtacacctagcaatcccttcgagtgaagccattagaaatctcatacagttcagtcaatttcttcagttacagagacggagttcttctgggctctgaggaatttgtcctgactgaggagttacgagttcagcagtgcggattgcctacacagtga

SEQ ID NO: 60978 - DNA, 418 bp, Triticum aestivum
  Clone ID: PAT_TA_60978
cggggtgttattctttcttgcgctgttatcgctatttttactgtggcgggatttagagcggcgcctccttcgtcgcttttgttgctgcttgaggggattatcctctgttgcatccttccgttcctcgccgttgttttcttttggtgtatccaccatatatatatatcgtatgatgaggtggctgtccagcgccccgtgggcggtggttcctgttcgtctccagcattgtcgtccataccgtcgatgtcttcggagtcaaagtcgagcgtgtcggttaagtcatcgacagtggctattaaaagggtggtgggtagggaacgaatttcctcgtcgtccgcttcccactcaagccggacatagttcggccaagagtctcctgacagagagagagacctcaatgaatttagtacatcgccca

SEQ ID NO: 60979 - DNA, 320 bp, Triticum aestivum
  Clone ID: PAT_TA_60979
gggtcgacagcatcacggaaactaaatctaaggattttaccaactccgagaggggcctgaactcgtaaacttgtgtgtacaacctcgccgtagctagggccttgtctcctcatacataccccctactctttctgtcagacttagtaccatgactgcatggtcggggcatcatgggtacatatgtgtgtgagatactcaaattatcatggtatgtgtgtatgtaggaactcagcagtgaacttgcaccggttcatgttcttcacattgtgtatctggtcctgcataattgcggaaaaaatgaaggaagggcgtaacagaac

SEQ ID NO: 60980 - DNA, 320 bp, Triticum aestivum
  Clone ID: PAT_TA_60980
cacggtgtggaacttctcatggaagcttcttgcaaggatatttaatcttttgaataattcttccggtatcgtaaattggatcccttgcagttatggttctgaccatatttcctccttgatcacatttactgggtaagttaaaattacttatcctcttcaaatcatttcccctgtccaacctctactccgatttaccttctggcattacacctagtacttgatactgggaagctttataccccatcacatcattcctagcctgatcagctatatttttatcatgtcaactttttaactgggccacctggtccttatgccgg

SEQ ID NO: 60981 - DNA, 254 bp, Triticum aestivum
  Clone ID: PAT_TA_60981
ttcgatgagaggcgtgaagatacaggggacagtggtttgccccagacgagtgttcacagtcacttcctgtgagaatatattatggtcgggaattaagtcagctacttaccgtttatgggatgtgtcgtgaaggttggtcacattttggtggtaatatgtacttgcatgaactaaatcatgactcatttttaatcatcagctttagaccatatcaatgtagggtatatatgctacagcgatcgtgctacaggatg

SEQ ID NO: 60982 - DNA, 176 bp, Triticum aestivum
  Clone ID: PAT_TA_60982
tccgggtccacactttcttccataggttgcataagtagatgagtagtgaggagtaaatgtaagaatcctgtatgatcttggtggaggcattcttttgcctttcttctttaataagtactagtatataatatgcacactcgtgcatattccaaaacaaaaaacataacgaaacgaaa

SEQ ID NO: 60983 - DNA, 268 bp, Triticum aestivum
  Clone ID: PAT_TA_60983
gcacagcgttgatgaaccaccgtctcttatactacacagactcgatagactcgctgactttaaagcctgtgtaatgcgtggcacacgccaatgtcgagtttaattgtcgtagtctccggccgtgatgctcgtatcgccaagcacacacactgccattgcatgaagtcgtccattgcgtagactcatagtgcaaagccgtgatattgggtctcgttgatggacgctaaaccgagtacagtgtgtgtgtgtgtcccttgctgcattggcg

SEQ ID NO: 60984 - DNA, 429 bp, Triticum aestivum
  unsure (1)..(429): unsure at all n locations
  Clone ID: PAT_TA_60984
cctcaggtatgctacctcttttcgaaccatacccttgttctattgcccccatctgccacgtcgctgcatgtggatctttttccactccaccatctccccaatttgctatcctctgctttgctggtcacccagacgaaaaccttaatttgcactattaaaggaaaccctacttcatgcagactaatccatgtctgggataataaggaaagtaaggaagaaagtattgtcgaagagactaggtatcgaacccgcatctaggttgaaaaggggaaaatcagtagctaaggaacgagtctcgtgtctcttgtttttttttgacatggtcgtgtctcttggttgaaaagggtagaaagacatgaaaatgcaatagagaatgaacaggtcaatcagtttgttttcctcacatangaaaaaggtggctaaagagaa

SEQ ID NO: 60985 - DNA, 375 bp, Triticum aestivum
  Clone ID: PAT_TA_60985
gcggccgcatcgactcagtcgcatcaacacgggtgcgagaagacgacagaagggggccgacatgactagtcgtaaacccaaggcggcacaaacttataggaacatgcatacatgacccagcaacgaaccgtgttgatcatgaacatatgaacgcaactcgtaggatgctgcaaggacttaaaggaataacgactgtcatttccctgaaaggacacatacattaacgaagaaggacacatgccgggcagcctaagtgttccggatcagtagcaagctaccatggatcagtggaagcactatgacacattttcccatatgagacgctattaagaataaacaactacgttgtccgatcccacacacaccaatcatttc

SEQ ID NO: 60986 - DNA, 406 bp, Triticum aestivum
  Clone ID: PAT_TA_60986
ctgcccacgaaagccactgctacttagccgccattcggtgggccggcgccctgagtcgaggaggtggacgtcgtcgatggatgcatatcttcttcttgcctcctgtaaccagcactgcatcacctcgtggccttaatgttttattagtataggagtatatggcatttttattccagtagtaacgttttcactgtgaggtggggcgcagttgagcaaaccgaccatcggcaaatccccaccccgcccaccgggcgtcggctgagtttagaattagaagagagaaacgagggagaagagctagctgtagcacagacgctgttgtcagatgggactcgcgttgatagaataggagtacagagcactcgtacctcttttttgggggataaagcagtcatatgtctaatac

SEQ ID NO: 60987 - DNA, 366 bp, Triticum aestivum
  Clone ID: PAT_TA_60987
ctgagttttggacttttaatggcccatgcctttcatggtccaatacctgcccggtttctctttcggcctgctaaaggcccacaacacagttgggccatttacaatacaacctgactttcggcctcttagcggcccatgctcttcatggtccaatacaagtccgctgtctctttcggcctgctaaaagccgacaatatggttgggccatatgtacaccgaacttattaacggcctgttaatggcccgtgaaatcaaatgggcccacatgttgcccgctttgatgtcagcctgttaacgaccccggatgtaagacggccgatcattaaatttcggcctggtttgtcccaaagaaaaatggcctggtaa

SEQ ID NO: 60988 - DNA, 431 bp, Triticum aestivum
  unsure (1)..(431): unsure at all n locations
  Clone ID: PAT_TA_60988
gataaaccaacacataccatatcattaaaggcgtcagcgtgttgtgccaaaaggaaacctcaaggtatatggagaaatagccaaaattgaatacacgtgtacctcaggccacttcctcgaggagtaaaaaatagagcataaatattgcaagattttcaaaggatangaacaacgctaatttatagtggtggaatacagatggtgcactgccgagccacccatgtgtcatatatttgttttatgtgcttttctatgatatcatcgagcgtacaaacaagctcgtgggaaaaaaatgatggcatcatccaccacgtcgaaaacaatacggaggcataaaactaagtgtgcatcatagtacgccaccaaccttaagtcgagtgtgacaaataagtaaatcaaagctcttaccatgtgtacacttcaaatgacaa

SEQ ID NO: 60989 - DNA, 329 bp, Triticum aestivum
  Clone ID: PAT_TA_60989
gtgggtcgacgtcacaccctatagtgagtcgtaatacattcccttcttgaaggacatttaaggacgcgttacgtctcttcttcgacgcagcggcaaacgacgaacctcggtctcgaatcatgtcatggtttgtattctcggaattaaatcgcactgtcaagaaaagagtgacgcagctcatgtagatgagcattaagagttttttttttcctttgtcgtttaagagaatgaatgaaaccagacattttcttgagcagtttgttgaactgagaatatgtttgttgcatcccgtccgttggattaataaagagatcatatatatctgttgt

SEQ ID NO: 60990 - DNA, 441 bp, Triticum aestivum
  Clone ID: PAT_TA_60990
gaacatgccaaaagagcacacgatttgaggatatcacgagatatgatggtgaacgagctccttatacgaggactcagatgaagaagccttcggcaagtagatctggaatggcatcaatagactatgatcttgatgctgacttctctcaccgcaagtccgggcatagttgatctaggcagcatgcttctatggcataagcagcacctttggactttgtcattcgtcgatagtccaaaattgaccccgaatagatactggctcgtgctaagcaacaagttcaagaccagcgccggctgacgatgagctagaaactgcagtagctgaaaacgccgaataagaaaaacctccaagcttcgaagcttattgttgaacggcgtgggatggtcaaatacctgtaagctagacacccccgacagccttgcgatgcatatgattgtgtgc

SEQ ID NO: 60991 - DNA, 436 bp, Triticum aestivum
  Clone ID: PAT_TA_60991
gctgcgagaagacgacagaagggtacggctgcgagaagacgacagaagggcatctatatgttcccctgtgcctgtgttggcagtaggatgatacaagtacatgggcaggcatagcatgcagacccaagtccgtttcaaaggagctgtgagttgggtttgctacggatatgtgccatcacatcagagtccagtaacactaattcagacagtggcagttatactgcagtgcagagcttccaccaacatgttgttgcagcagcatagcagagtatgcatgctgtgttgctggctgttccgcgatacacatctccagttagcagcactgacccagcaccaatccgatcatgccgggttcctctcaaaccagggacagtgagcaaggaaaaggcccgacaaatgtgtgttgggacaaggccatgtgatgcgtgccgctatc

SEQ ID NO: 60992 - DNA, 409 bp, Triticum aestivum
  Clone ID: PAT_TA_60992
ggagagcgcggacacgaagatggacgcgtggctggacgttgacatgaggattgctagccactcccggggcccctcctggtatttcttcttccaatattttttaataattttaaaataaatctccataaatttttaggtcatttggagcttttcggagaatagctatctcaagtgtaactcttttcaggtcgagaattccagctgacggcaattttcctctccatataaatcttgcataataagagagaaaagacattaaaattgcatcataaagtgaaatattgacccaaaacattataaatatcagtaggaaaacatgatgcaatatggccgtatcaccgttggtgtaccggagcataaggctttcgcctgaatccattcacgcaccacactgaggaagctcgaacac

SEQ ID NO: 60993 - DNA, 142 bp, Triticum aestivum
  Clone ID: PAT_TA_60993
gatatgactggttatccatgtgcgacatgtcccctactccaagtctctctcacatattgtactcgaaatatatcccacacttgggtcagatcaatacaacagcactattcatacaaaggtttttcaccaaaaggatgtcaca

SEQ ID NO: 60994 - DNA, 171 bp, Triticum aestivum
  Clone ID: PAT_TA_60994
aacctcaagatgatatgccggctcagtctctcggacgtgctcataggggtacggtgtgcgtgtgtgcgttcatgggagtgagtgtatgcgcgtgtatatgaacgcttgtgtctgtactgatgctataaaaaactacgtacgaaacataaaagtcaaaagtccattgataaa

SEQ ID NO: 60995 - DNA, 333 bp, Triticum aestivum
  Clone ID: PAT_TA_60995
gtctaggactcccgggtcgacacgacacactggtatggctcctataagacgacagaagggtacggctgcgagaagacgacagaagggtacggctgcgagaagacgacagaagggtacggctgcgagaagacgacagaagggtacggctgcgaaagacgacagaaggggtgcattggactaagctagaatctgcaagcattcaattcaagggagaagacaaggtaatatgggctcttggttaagtcaacaatcatgcatatgagagccacttaaacattttcattatcgtcttctcctctcaaccccgaaaaaaaacaaaaaataaaaacacaa

SEQ ID NO: 60996 - DNA, 365 bp, Triticum aestivum
  Clone ID: PAT_TA_60996
gcgggtccatactcttccagatcaagtttcataaaaatcacactaatattcaacaccctccaaaatagtgggatcactaattcctaaagttgacactcttccaaccccactttcgattatagtattattcatactccaaaagatataagtgaagttcatggagcattctacaattaatatagactaaccaatatcccagctcaaaatatataaatgaagcacacgaagcattctgtaaaaccatactcaaaagattaaagtgaagcacaaagagcaattctataagatcatacttaaaagatataagtgaagcacatgaagtattctacaaatcaatgaagggctatctcatactatcatggtcc

SEQ ID NO: 60997 - DNA, 377 bp, Triticum aestivum
  unsure (1)..(377): unsure at all n locations
  Clone ID: PAT_TA_60997
gctccgagaagacgacaaaaggggtgtcgtcaagctgtcattgttggaatttgtttctctctcgttcttcttgttttatctttatgcttcatttgttgttcaccccagcaatacggtgatgattgctttgtaatacaaagtgggaggaaaccctattttgaaagaatggcttgcctggtcaccgtccgtcgaggcgagagattagcttggcccgagagctcaaaatcgaaagcctaggcatgcgcctgttgcagcctggatgctactcggtcgtttcaaaaagaaggaacttatagatgaggagcgaggtgcaaccaaaaagctgcgtcccgtccgacaagatgaaccggcaactccttgtcnctgggcgacacaga

SEQ ID NO: 60998 - DNA, 435 bp, Triticum aestivum
  Clone ID: PAT_TA_60998
ggcggagcagaatccatcgacggcggcagaatccaacggtgggaggtcactggtggcgagaagatgattcggagacccgaggaggcagagcaggatacccgcgggctgaggggatttgaagtaatttccaaaatctcacccgtgggtatttatatcccgaccctgtcagtgtgaccgagtggaacaactcggtggcaccgagattgcagaatcgcaagtggttgctgcaactcggtgtgaccgaagtgttcaaatcggttggaccaatatgtaaacctagatcaacttagtgatcttggtttgaccgaaatggatgtctcggtcagaccaaaatgcacaaagaggttttggaagtttaagtctatgatgaatcggggactctgagtgctcctcacacagagtggttcaaatctgacttgatcaaactttgtgatg

SEQ ID NO: 60999 - DNA, 435 bp, Triticum aestivum
  Clone ID: PAT_TA_60999
cggctgcgagaagacgacagaaggggtctctcgctcactcaaaaaaaatattccttggatctccttcgacgtgcgggaatgctgaagtgtaaatctgttggtgtgcttcttactcctgatgatgctacagagtatcgcagtattgttggtggcctacaatacctcactatcactcgaccggatctttcctttgcagttaaccgtttctgggaattacctcaaggcccttcttgacacacattggtctgcatttaagcacattctgcattgcgttcgtctcactgtcttttttggtttacaccttcggcctgcttcgtctatggtgttgtctgccttttctgacgcggattgggcaaggagtccggatgataggcgatccacggggggatatgccgtgttctttggtccaaatttgatcgcctggaatgctcgaaa

SEQ ID NO: 61000 - DNA, 287 bp, Triticum aestivum
  Clone ID: PAT_TA_61000
ccgggtcgacaccatactctgtttcttggtggtttgcaaatactaggtggatgaatcaccaatgaagttggtactacgtgctgtctgaagaaagggaaggagacaaacagttggtaaaggttactacaagtgtacagcgagatgcaaattagaaattgcgtggaatgtacgtacatgcatgctgtgtattttggaaggatggtaacgtttaatctttctgaacatattatgaaaaatttcatggttagggtgccatggaccatggtacgacaacttctgttttcttt

SEQ ID NO: 61001 - DNA, 316 bp, Triticum aestivum
  Clone ID: PAT_TA_61001
gttgcctcctctgtgcgaatgcaagtagctgattcccatccttcctctcgttccacccatgccaccattgcatgtgcatcatcagagtcacaaagccagaccacatcaatcaaagcgcacaagggccaaaaaaacacaacacccgaccaaatttggaaaatcaacatgatgactgaagcaaggatcatgacaacatataggatatttaaatcatataggatatataaaacaaacgcaacagaggtagctagaaaggaaacaaagatacttgatctatagtaaaaataagaaacaacctccaagataatacgcctgc

SEQ ID NO: 61002 - DNA, 434 bp, Triticum aestivum
  Clone ID: PAT_TA_61002
ctgcgataaaacgacagaaggggatcatggtgcggctcaagaaactcagctatgggcacttcgacaagagcactatgacccgtgctcgtcgcgcagaaggtctgcgtagaaggtctgcgtcagggtatacatgggtgtcaccaccagccagctcgacgagctcgccgccgagaccgccgccgcactcaccgcctcccagcctgactatgcctctcttgcggcgaggattgttgtgtccaacctgccgccaagtggaaatagtctgtgtggcgctcataaataaagagcattcttgtagaaagctgagggacgaggttcgtaaccgagagtcatgtgcagagctggaggaagaagttgcgaggcttggaactctccttgtgaaaggctcaaggacagcagtgaggacaatgcctctttagttgtaattgtgatac

SEQ ID NO: 61003 - DNA, 439 bp, Triticum aestivum
  Clone ID: PAT_TA_61003
cttgaacacttctgttcatgctcattgaaacaatgtacaatttttcatgaagattctcaaaaaagtaattatccccttgtacaaatccattgtattataaaactaatgtcccaagatttgcctttaggatgattagattgcttgttggtatgtgcggtgcaggaacataaactttggctgtagtgcacgatttacattttttactggaaagtcaaaagcttctgaaacttttcgcacaatattggtataaaaattgtttattttgtcctaattttcagaatttttggagtaccggaagcatggtagatgttcagattactacagactgtcatgtttaagacatattctgcttttgatgcattgttttgcttgttttgatgaaactatcgattctataggtggtataagccatggaaaagttataatacagtagctacaa

SEQ ID NO: 61004 - DNA, 323 bp, Triticum aestivum
  Clone ID: PAT_TA_61004
tgatctgaccgtcgccgtcctgccctggtttttacttccttactgcacatggacctgcgcgatgatgatgatgataataagtttcaaacgtcgccgaacagccttgcctttgccttgttagctgcctgcttcgacagaatctgagacttgagatgatgatgatgatctgtagcgctaggtgctttgctacctgtggttggtctggtatcgtatggtggtggttaacgagtgaggcgtcttggatgatgcggtttggtccttttgaaaaatatgcaatgcatggttttttctggcgaacaaaatagatgtgcagattacaacaa

SEQ ID NO: 61005 - DNA, 325 bp, Triticum aestivum
  Clone ID: PAT_TA_61005
cgggtcgacgcggatataaagatgaatcatttgtttcaaaacaaattttcaggcaccgggtttttatttgatgggtagcataagcacctaccgttcgaattcctagttctccaatttttttacatctttgaagtacgcacgagatccatctggtttcataggctgataattggacgcaacacgtcggaactgggctgtggcatgccaagtcgaactgcatattgttaaaagagaggagagatgtatttgggccttccagaatagttagtgtcgcgacctcggtcgtgaagcgcctccctaaaataaatgagtgatggtcaaagag

SEQ ID NO: 61006 - DNA, 340 bp, Triticum aestivum
  Clone ID: PAT_TA_61006
gggccaaaacaatggcccgaaaaatcccaaactcccctggaaaactccaaatccgggttaataagaaaaaactcctcctcaaataattgctttgcctaatgaaaggcctacctggcggaaatttccttaactcctggattttctggaaggcaccctgggcttccatccgggcatcatgcgcgctctgagcgagccttggcgagttcggtctctcgatccgcaatatcacgctcaaaggactcgcatttcttaacagcatcctgtagctcttgatggacctcattaaccctagcctcgtgtttttcacaagcgccaaaataaaactgaaaagaaagataaa

SEQ ID NO: 61007 - DNA, 225 bp, Triticum aestivum
  Clone ID: PAT_TA_61007
cgacatcagcaacaactgatgggtgtacactcatcaagcagagctatgattatgcttgctggatatcgatatagattattctgtgaggttactctatagataagaagtaaatccatcggctctaactaagttgggtatactatagatcatgtgtactgaatgtcccgagctatgtatgtacgtattgtgtaatgaaattaatgtgagaatatattaatctcctat

SEQ ID NO: 61008 - DNA, 422 bp, Triticum aestivum
  Clone ID: PAT_TA_61008
gcgatggggttgccgttccaagacggccatctgcatctgaacacccaggctcaggtccagctgggacatatgctggctcagtcctatttaacttatggtacattcaaacactagttctccctgtacctccaaagagatccattatttttttgttctctactttagttaatttcctctctgaactcttggttgagcacattggattgggtataaacatgccaatgtaattcagtacaagttctccatgatcaatgagtacggagaacctccggaatcttgcagcttcataatggaagctgctccctttttgcctattacgtttgagaatcatagcaattctagtgattgtgcattgtaagcataataagaaaagtcatctagcacacagagtggtactgaatttgagataatgcatcgataaa

SEQ ID NO: 61009 - DNA, 430 bp, Triticum aestivum
  Clone ID: PAT_TA_61009
ctagttggagagtgcggctgaggcccaatactgcctgtgtgacagagcaattttttttcttggaccaactgcgtgagggctactatatgacgctagttgcgtaaaatagtgcatgggacgcacaacagttcgtgtatggaccaacacactggtagactacaagacgacatgtgtttgtaaagcccaaaaaaattctaaaaaaaatgatgagttgaaggatcaaaattatgccctcaaagacctgactacgtgttgctagccacttgatgaaaagaatcctaccaaccaatggccagcttaaacctttaagatcataccccaatgtcagattggaaacaatatttttttcttttttaaaaaaattactgaatatacttgatttttttttaaatcccaaacatgtttgtgaaattctttacattttcacaaa

SEQ ID NO: 61010 - DNA, 209 bp, Triticum aestivum
  Clone ID: PAT_TA_61010
gatccgtcaccctccgccttgccatgagcagcagcagcatcaaatcggggtgggaaatagagagagaagttcggtcatggggtttcttcttcattttacctatgaactaaagcaggggtaaaaaaagacttgttggattgcacctgattgtgttagtggccaaaagtgatgaaaatgtcattaaggaaacaaaataaagtttaggtgcc

SEQ ID NO: 61011 - DNA, 441 bp, Triticum aestivum
  Clone ID: PAT_TA_61011
ggtgacgaccggtcttgtatctcacaagtacggagagaaagctgctgcggccaccaacgaagggctcgacgctgcaggccacgccatcggaacggcgtgggccgtgttcaagctccggcaggcattgaacccgaagagcgtcctgaaacccacgtcgctcgccaagtccagcatcaaggccggggccgcggaacttaggtcgaagagcagcaagagcgagtagggtctgaagcagtcttcgccgcagccggtcgtatcggggctgatgagatcagaaacttgcatatgtgtagcttgtagatatgtgtgctggaaacagagagcaacctgcctgtcatgtctttccctctgctgatgtgcttcctagttgagtatctgttgcttggttttgttctgtgctctgtaagtcgatgaaatggagttaggtaatcgctgaatttt

SEQ ID NO: 61012 - DNA, 311 bp, Triticum aestivum
  Clone ID: PAT_TA_61012
tccacggagggcgtccttgaatatggcgtaccggtgctcctcgtggtcgatggagctgtagatcttgtcgttggtggccttccactccacgaagatctgccgggtctcctcctcgctcctctccctgtaccaggaaccgctcgctcgcccccctcgcttatgtcttagtcggcgttgcacatgtccgcagattcatgttgtttttttcccctcgaaacatatatgttcgcagattgatcggcgtatatttcgcaccatggctgatggttcctgctcgttttccccaaaaagcacaggaaacaggaaaagta

SEQ ID NO: 61013 - DNA, 422 bp, Triticum aestivum
  Clone ID: PAT_TA_61013
gaccgccaagttctcctccagcctctcttccttggaggtcttggggatgaccaccgtgttcctctggaggccccaccggaggaccagctgcgccggcgacttgccgtatttctcggccagggactgcaaacgtggatacggcatgcagaggttgagaaactatcacaaaaccaggcttgcggaagtgctttttttctagatgctgaaatggaatgtgaatctacgatttgttacacagaccttgatgacagggtcgtcgaggcatgagacggagccgaacaactcggtgttggcagtggaaccgccaagaggagtatgtgcggtgacgcatattccatgcttctggcagaacttcacaagagggtcgcgctggaagtaagggtgtgtcccgatttggttcaccgcgggctttatcttggcgt

SEQ ID NO: 61014 - DNA, 394 bp, Triticum aestivum
  Clone ID: PAT_TA_61014
gctgcgaaaagacgacagaagggaagagcatggcttcatgagagagagttacctgaacgacggtatgagtacaaatatgtattggatggcaactgggtgtgcactgagcatgatatgatcaccaaacccaatgcggactgccatgtgaataactacatccaagttgccaaggatggtacgagcgatgaatagactgcgatgcaggagcggttgactgggccataccccgatccagcacaagacgacacgctgatcactaaagattacctggaacagtacaccgagcaataagagaacttcccttttggtgcgaccggctcgagatgcagccgggaacacctattgatgaaatgaaatgaaactagactacgcatctctgaaacgctgctgtgct

SEQ ID NO: 61015 - DNA, 277 bp, Triticum aestivum
  Clone ID: PAT_TA_61015
ctcgcgggtcgacagaacgccctatagtgagtcgtactattggcggagacagcggcttcttccccttgtctgcttgtttcggcaccatggcgatgaagcaggcggagtgcaggtcagattggagaggaggggcagagtctcgatgaagcacaacgagtgtggaagcaaggcatgggcaatgggagaataactgtgtacattgtgagggccgcatagccaggcggattcaaaggcagcgtggggaagcgggcaagacatcaagtgtctggtaacgtaa

SEQ ID NO: 61016 - DNA, 439 bp, Triticum aestivum
  Clone ID: PAT_TA_61016
caaagtgagctttggacgtgccaacaccgtcttctaccccatctcggtcttcacaaacttgagggaaccctctggcatccttcccttcccctggaaaatacttaagaaaccaagtcagactactcattgttatcaacataaacataaattgcacaataatttttgttattgtactaaactttaactagtgatatagcaataagtaacagtaatagtagcagtcactagtcagttcgtcaatgctagaagcaaaaccttccgcaacgataccccaatgatggatcgcgtgacagtcactagtcagttcatcaatgccagaagcaaaaccttccgcaacgataccacaatgacagattacggaatgcacgcttatataaacatagacaatcgggcatgtaaaggagaagtacacgccgtgtgtgtgtgggttgtgcgcgtc

SEQ ID NO: 61017 - DNA, 432 bp, Triticum aestivum
  unsure (1)..(432): unsure at all n locations
  Clone ID: PAT_TA_61017
gaggttgatggtagaggcagcgctttggtgggttggcatgcttggaaaaggtgtgtgtgctacaggctgcgcttgttgcctctgtgcgtcgtgccgcgcctaggtttatgcgcaatatcgctgggtggcgggaaacaggtgaggaaatggcgggaaacagtggtgtgttcataaaacgccatcaattaatggaaacttagcgtataaggaacatcgagctagcacaagaagtagatgatgatgagatgaacacagaccacactaggggacccgtcagagatgaattcatcaatcgcaaatggttgtacactagcaagcgtttgcccacaacacacacggcttattccatcacaaacaggttggatggatcaactgtatgccatgtatttacacattgtcangaagtcatgtggtagaccttctttaacatgt

SEQ ID NO: 61018 - DNA, 381 bp, Triticum aestivum
  Clone ID: PAT_TA_61018
cacgtcctcaccaaagccataatgtcccactgcgtggatgctctcaagaaacgttgagtgtcatcggtgtcctggacgttgtggcaagatcaattcaagcactccacttggcctattcggttgggctcaattgtgtaattcgcccagtgcagttaccgcatgcagatcctgaggatggcacgaaggtgtcacatgccattaatgggacaatgtctcctggagcacagcatgacactgatgagcgtgagctgtctgcactgcaagctgtgatgaagtgcctctaggaccacagactggaggaggactatccggtggacccacctcagacgagggtgattcaactggagaacgccaatgcatacaaaacgaaggctgtcgaat

SEQ ID NO: 61019 - DNA, 420 bp, Triticum aestivum
  Clone ID: PAT_TA_61019
ggtccggtggcatgtatggggtcattcagtctgtgccctagatgatccgacaattttcctcaggctctatggctacaaatattagcgcctgacggtccggccaagggcctgtgatgcgtctagggttgctctggccaggcaggggatattccatttgtccttttccttgctccgagtccgtgtcttggctatctatccttgcttgttcatgttccttgccttcaaccctaagcatacacaacgttcatgtgttaggcagcccaccattacccctaggcatatcaagtgggtagtcattgaggaaaagattcacctcatgttgtattgccttggctcacgccctcgtcattgcattgtccaatttgcgctttctaacttggcgtagtgatgttcatggtgcctagtttatcataccatcat

SEQ ID NO: 61020 - DNA, 429 bp, Triticum aestivum
  Clone ID: PAT_TA_61020
attcccgggccagaagacgacagaaaggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggggaagagggattggaagaggagcacgaggaggatatggaagcgtcggaggaggaaggggaggatgtggtggtggggcagatgccaacgttcatggtcccaaagcacatcaataagcgcgccctgaagaacaaggccctctccgtctccctcgacaagaaagccctcaaggatttcgtgactgggtttcacaagagaaagaagaagaggagaaaggaggcgcagaagattacgcaggag

SEQ ID NO: 61021 - DNA, 155 bp, Triticum aestivum
  Clone ID: PAT_TA_61021
gatatccgaatactcctccacgcacgactcgcttacaagtttgcactagagcattggtggatatatgatggtgcaattcgttcatgatcccattgtaataccctgttggaagaaaatggttccatgagatgttaatctggtgatgaattggtagg

SEQ ID NO: 61022 - DNA, 347 bp, Triticum aestivum
  Clone ID: PAT_TA_61022
cgtccaaggggcataaatttactgcagaatataatatattatcgtgtatagagaccgtattgaagcatttctggagttgcaggaccagatcgctagagatttggaggatcaaacgtgtatttttttctcgacattgagcctacactagggatatgcgcaccggaaaaatatcaggtgcttccgtccttgggaattggggggcggctcctataccgtggggtcctcctatacagcactgcaggcgcccgatcaacggttcggcccaacgcggtgctcgctcacggttaaccggtcaatggttaacttttgtggggaaatccacaggacgggggaagccgcgggcgaag

SEQ ID NO: 61023 - DNA, 327 bp, Triticum aestivum
  Clone ID: PAT_TA_61023
tccccggtccacgcagctgctcggaaagcgacatttcatttgtgtacttagctatatgtgtgtacccacttagatagccgttatccgtcaactgatatgttaccaccacatgcatggttccggtgatgctcaagcagtgcgggagatggagacatcaacgtctcgatatacacacaccgacctactctgaagggagaaaccactttgtaatttgtaacttgctaaccgtgcatgaatggaaaatcatctatttccatgaacttgagcatctgtaccggatcggcacttctactatataagaacagggactgccttgggtaagaaact

SEQ ID NO: 61024 - DNA, 425 bp, Triticum aestivum
  Clone ID: PAT_TA_61024
gcgtatcggcaacaggttgtccctcgtcggcctgcccagcgcagcagcgcggttagctcctcccccatcccccaacagatccaaggttcctcggagagagagagagagagagagagagagagagagagtatgtacatgcggaacttcacagtggaggatcgcggggcgccgaggctcaccgtcttcatcgccgtccgggcagtccgttcgtcgccgccgtgcggttggggatttcgagggcggatgtcctctttttgcctgctccgccgcggacggggctaatacggacttcagagcccatatctttttttttttgagaaatttcagagcccatatctaatgtggactcaatgtgcacattcttttagccaactcattgtgggttcatagtgggccggtcaccgtggtctagccagcccaagaaa

SEQ ID NO: 61025 - DNA, 427 bp, Triticum aestivum
  Clone ID: PAT_TA_61025
catgtaatataaaaatgatgaaacaaattttctcacttacagaaaaatgttaatcaagcatttgaaattttttgttgaataagtatttgaaaaattgtaaaggtgtatagaaaaattgttgactatgtaataaaaaaatgatgattttctttgatcatatatattgaaatgtaaccaagtatttaaaaaatgttaaatatgtatagaaaaatattgaccacgtaacaaaaaatgatgactttctcatctctctctctctctctctctctctctctctctgtctctgtgtgtgtgtgtgtgtgtgtgtgttaacaaaacatatgagaaatgtgacatatgtttagaaaaatgttgaccatgtgttcaaaaatgtgaataatgcagttataaaaaggggatcacgcacctgaaaaaatgttaaaaagtg

SEQ ID NO: 61026 - DNA, 326 bp, Triticum aestivum
  Clone ID: PAT_TA_61026
ttctttcctctttgttgattcttatgctgctggtgctttgggctggtaaggcccaggtgacttatcaacgagcccgttgccaaggcaaagcaacatctatatacatacttagcttattaaataccactcaaaaagtaaacttaacttattaaatttgtctcaaaaactaaacttaacttactaaattctgcttaaaaacctatcttattaaattctcaacaggataccaacttagcttattaaagagttttcttaactgaacttaataaagagcgaacgtaggataaaacagatgattccaaaacagagtgaatgtcggaataaaa

SEQ ID NO: 61027 - DNA, 459 bp, Triticum aestivum
  Clone ID: PAT_TA_61027
cgcctgtcggtaccgctcctacattcccaggtcgactgcgagaagacgacagaaggggaagatcctgagcaagcggcgaagggactacttcaagaagcttctcaaaggggcagtgctgacaacatcactgtcgtcattgttcgcttcttggacggaacgacgacgtctgctggagatggaccgggcgaggaggttgccaaggaccaaagtgaggaggtcgccaaggaccaatcttcatagttcttgttcctccacggcgttgtatccgctgttgtatctgatgctcaaagtagatgtcatgtggcggcgccctcccgtgctgcgaaaccgaaactgacttggcctgagtttcgtcgttgttccatgctctcggctatcctagatggtaggtaatgtcggaacacagggggatggtggggcagtgttgttaccatatgattcaacgtgtaacttttcttt

SEQ ID NO: 61028 - DNA, 398 bp, Triticum aestivum
  Clone ID: PAT_TA_61028
gaatcctagctcgagaaggggagaggaggcgacagaaagcgagggagagtgacggacagagacatgaactgattgaccgcacgcgaccagcgagtggataatacagcgcgatgcgggctgggctcaccagataacaggtccaagagcttaacgggcaccacatcgagcccaggagcgaatcggctgaccctaaattggggccagtcaaccaaacccagcccaacagagccacgttcacacccatagaaaagaaagaaacacatgaatctcaaagcatgatccaacggccaaaaagttcgactaaccacaattctaaactcaggcgactgtcatatagctaaagtgaacgtgtgtacaatgtaaaaaaatgtttgtgtgttgtaaaaaaatgtgtcata

SEQ ID NO: 61029 - DNA, 380 bp, Triticum aestivum
  Clone ID: PAT_TA_61029
ccgcgtccccgtaagatgcatgcctaattgtgccatgcggcgtggagaagccccggggccttgctcgtgggtgggtggcgcgccactcccaggagaggagggggcatcagaattcagaagccgagctttggcgaacctggggcactgcggacgtgacgagagaatattagcagcatcctggtggatggcgtttagcgtgcgtggttcggggaagatggagccttcctctggctggctggctggaatttcctttcatttcagttaaaggcaaaacaaatgaatggaatattcgtattctgctgctcctttgcagctattctccgcgaatcctttcttcttctttttttcctttttgccgtggcagcgtaagtgggactggg

SEQ ID NO: 61030 - DNA, 391 bp, Triticum aestivum
  Clone ID: PAT_TA_61030
ctgcgagaagacgacagaaggggttcacacgagttgtgaatgcaaaaaggcaagtggttgctgggaccttgcacgacctgatggtggaggtagtggattctggaaagaaaagtatgtacaaggcaaaggtatgggtgaagccgtggcaaaatttcaaggcagttgtcgagttccgtcatgccggtgacttccagtctgagtcttccgttgcttctgatgctagcactgggcaagctatcctcaagctgtctcttcaaaccgacatggcaccgaagatgcacagcaacgagaatactggactttctgttgactcatcctcttctcaggcacacacggtgtgaaggtttcttccatggagtatggaactggaaggcgtgaaggtcggaacatg

SEQ ID NO: 61031 - DNA, 402 bp, Triticum aestivum
  Clone ID: PAT_TA_61031
gaagacgacagaagggagaagatgaagaggaagaggtgatcactgaagagggtttacaaaccatattggataagctgcgtgttcaacaccactattgcctttactgtggatgcaagaaatgtagggaaaggctgcgtactatagacccaaagtggtcggacccttccctggaccctgcgcaagcgggagctacatgcaccagtttgaatcagcaggagcactggcaaatgaatgccctgggcctaatgaagatgatcactgatccactctgtcaatggtgacaagggcactgtccttcccactgcagattatggtaaatgtgacatttgggatattcttgattagttgactgtgtacggttaaccttagtccttaacacaatcactggttcatagccaactg

SEQ ID NO: 61032 - DNA, 213 bp, Triticum aestivum
  Clone ID: PAT_TA_61032
cccgaggtcgacggagacctaatggacctggtgtgggggctgcagtattccatctgcctgcggcgctgtcgaagaggaggactccgaggtccgcctcgcagagcacggcgagctcatgcgccttcttgagcagccgggcgctgcgcttgccgaaggtggactgcgtggagacgtcgttcgacggtaccaacatctaagtgggtcgcgtctctg

SEQ ID NO: 61033 - DNA, 273 bp, Triticum aestivum
  Clone ID: PAT_TA_61033
atccacacggctgccagaagacgacagaaggggtggtcagagtttcagcaggctgtacaggcaggccacaaaggtacatacgggcatatccggctgatgaagccgaagcaatctatctatacttatcctgccccagattgtatgtgccaagggtagattgccgagttttctgctgagttactcgttgttgctaattatgataaactcatgtggatatacatatattacttctgaattttgttgaatcaaatatcaagattcatagaccatcaa

SEQ ID NO: 61034 - DNA, 351 bp, Triticum aestivum
  Clone ID: PAT_TA_61034
gtcgaccgagcccactacagaagggaacggctgcgagaagacgacagaagggtacggctgcgagaagacgacagaagggtacggctgcgatatgaccacagaagggtacggctgctagaagacgacagaagggtacggctgcgataagaccacataatggtacggctccgagaagacgacagacgggtacggctcccacaagacgacagaagggtacggctgcgacaagacgacataagggtacggctgcgacaatactacatacagggcattcatttttaaagcattcacaaacttgacaaactatagggtgaatattcaaaatagtcatgaatttgaaaaatacattaa

SEQ ID NO: 61035 - DNA, 403 bp, Triticum aestivum
  Clone ID: PAT_TA_61035
gtccagcaagaagctcaaggagttttaatgggccacattaaaatctgtgagctcgcaggaacagggcagtaaccttttcatccccttgcatactgtttgaggaaagagttcttagtaaacagttgagaacttctgtatatctccatatggcattgtagaacttaaaaggtgatttacaaagaagtgatttacaccctctctctgctatctataaaaattgtgacaatggaagcttgcatttctccatatcaagaacgggagtatagattctaatcgcagagatttctctcttttacagcgaggtcatgttccatctgagccttgctacatactgcgattctaatagcatcttcttccttaaatctaacagctcgattcctcgctcgtacataagaaggcaatg

SEQ ID NO: 61036 - DNA, 441 bp, Triticum aestivum
  Clone ID: PAT_TA_61036
ctgcgagaagacgacagaaggggggcccaatgttgtttgatatcgacttgaagatccaagccagctaccatggagagcatgttcctcttgtttccttgatgagcagactggatggcaaagcaattgttggacaccctatccaaattgaaatacttgtagatggttccactgaccacctggtttctggtggtgatattagtatggaagagagcacaggagctccaactgcttggcgtacaggcaggaggacagccatgcaaagaattccccgttctaatcctttaggagcatcaatggactgtggcaatgaaggcaggcttgcatatccagactgggaaatgaaaccagtcttcagtaaatactcaacttctgcaaatcaccaggttaagaaaagcatgtcaaatagcaagcagaggtcatcggcatccaaatctcaaaaga

SEQ ID NO: 61037 - DNA, 459 bp, Triticum aestivum
  Clone ID: PAT_TA_61037
cccaaagaaccaggctttgacgcgagatccattatcgtgcaaggtctggtcgaccggaacagagctcaccaagaaggccatgacagagatgtgcccaccagcagccgagttcatgtctcaggaccagagtgttttagcagagccatccaagctgcagtgattcctcccaactttaggttggcgactggggtgagtaagttcactggtgagtccaagcctgatacttggcttgaggactaccgagtggctgttcatattggcagtgggaacgatgaggtgtccatgaacacctaccgcttatgttggagggctcggctagagccaggctgaatcagttggcgcctagcagcatttacacttgggaagatctcgcccgagtgtttgtcaggacatttgaaggaactttcaagcgaccaaacaggttgacagacctgcaggtttgcatgcaaaagtccaatg

SEQ ID NO: 61038 - DNA, 357 bp, Triticum aestivum
  Clone ID: PAT_TA_61038
gagcttgatggcagaggtggcgctttggtgcgttggcatgcttggaaaaggtgaatgtgctacatgttgcgcttctcgcctccgtgcgtcgcgccgcgcctagttttatgtgcaatatcgttgggtggcaggaaacaggtgagggaatggcgggaaatggtggcgtgttcatagaacgccatcaattaatggaaacttacaatataaaggaacatcgagctagcacaagaagtagataatgatgagatgagcacgaaccacactagggaactcgtcggtgatgaattcatcaatcgcaaacggttgtacactagaaatcgtttgcccacaacacacacggcttattccatcacaaac

SEQ ID NO: 61039 - DNA, 431 bp, Triticum aestivum
  Clone ID: PAT_TA_61039
gccctgcggcttacaaagtcccggccggttcataaacaatgtctggctcgatgactagttaagtctaccttatgatacaagtaatattattacaacgggttactacaatgggccttaagtcgcctgcagtccttaagctctctatgaaccgccatcttcatactttgtcttgggattctctctggtgagtcctctttgggtaacccggcccctcctgggcggcttacacaaatagttatatccccaacagttggggtggttctacatcaccgagccacgcgatcccaaatgggcggcggcccccgaattccgatctggctttcccacacggctcacctcctggaaagagacaggcctaacatggggggattcagaagagctgaccggacttcaaacctgcgtccaaaagctggtgaacaagaacctcaagc

SEQ ID NO: 61040 - DNA, 448 bp, Triticum aestivum
  Clone ID: PAT_TA_61040
gctggggaagtaatcgtcggagtccgtgatggaaaagtcagtagtcgcgcggagccctccccaaaaaccttatcaccctcctcctgtacagcagcaactcagagattggaaccggtggcgagaggaagaagaagttctggtgcacctctctgagaggagaggcctcccttttataggcgcaagagcagcgacggagataaaaatttagacattagctcggctcattccctcccttttataggcgcgggcggcgaaggaggagcgcgcgtggatgtccctcttgttctcatgctcatacaagtgaggaaagaacctcccttataaagaggtcaaactccctctaaactagcaatgtgggactaaactttagttccagctctttccttgcacgaatggcctgcgtgggcctccaagatttattacgaaatttccgaaactgcttattggg

SEQ ID NO: 61041 - DNA, 299 bp, Triticum aestivum
  Clone ID: PAT_TA_61041
cgggacacgttctgcagtgcgacgtagctgccactctgttggctaacgcccgtagttactgcagtctccatcctctatcgatggacatgatcgtcgatccaccacgaagcaattggaaatcgatgtgtggtctaagtgtattaacagtagagtatccacctcggtcctgtggtagatccctgtcgcagatttagcgaataacgacatactgagcaaaatgagtgaatctacactccgggcgtatcgtctacgatacatccgtacgtagtcgtccatttgacatctctacactgcttaaa

SEQ ID NO: 61042 - DNA, 421 bp, Triticum aestivum
  Clone ID: PAT_TA_61042
cgccgctggttgttgtcgctgcgcgcgctgctcagccatccggcatccggcaagacggcaatacagtatgtagccatccatgtatcatattcctgttccatccccgattccatccaaagctaaacttcagcagtttctttgattctttagtacgtattcaactattcatccctgatccatcctaattttctgtcatgttgtgtacttcctctatttcaaatttagactagaaccatgacgagtaatttggaacggagggagtacatatctaggtttcaatcatctgatgtatagatttctaattctttgtattcgaatttcttcattagtttaggacattagcctgtcagtttatccaagacaaagcatttaccaggtgcataaaagctcgggacggagaaaaaaagggggggcgctcgag

SEQ ID NO: 61043 - DNA, 166 bp, Triticum aestivum
  Clone ID: PAT_TA_61043
ctacaaagacaccaacaaaactgaccgtaaatatgtgcaaccgctaaataatttcttctgtgctctctcaaaacatgatttttaccccgctttatatataaagtaagacacaatgatacaaggtgacgaggaaccctaaaccctaagactatgtcgatatcatgcc

SEQ ID NO: 61044 - DNA, 438 bp, Triticum aestivum
  Clone ID: PAT_TA_61044
gggaacatctcctcccacaaaaaacgcatcgccaaaaattctaaaataaatcgaaaagcaacgcgagcacccggacttaaaaccctcatgggctgggatattattgtctttctaatcatccaatcagaaggttggttcgctgggctggcctattttgatatacatgccatggagtggtgtggcgccaagtaacaagcttgcgtgtgtactatggtaaaaagaagtaacaagaatgccaatcagtggcgtataaggcgccaaataggatttgaggccgcagcgttcgttacatgtgacacaaatcacctcttctattcagcgtcatacgcgctggataagatgcaaacgtgcacagccaacttccttcagcacgtgctttgggccggcccatgtgctgggccgtctgggcctgtttttctcctttttgtttttgaactg

SEQ ID NO: 61045 - DNA, 301 bp, Triticum aestivum
  unsure (1)..(301): unsure at all n locations
  Clone ID: PAT_TA_61045
ggtacgccttgcgngtagcgtccgagattctagggtcgaccatcattgatttcgagagattaatcgagtctgctactgctcctgatgctgtaaatggtccagagtcttcttgaggaataaatggtcagaaattcaggatcctatctgtttcatgtaccataggttctcatcatgtaaatagttcatctaagctgcagaatgccggtttgtttgtagtctctgcacaaaatctcaatagtcagaattaaggtgagcagcctgtgttttcagaatcaaaaaaaaaaaagaaaaaagaaagaaa

SEQ ID NO: 61046 - DNA, 231 bp, Triticum aestivum
  Clone ID: PAT_TA_61046
gacttcgcgcgtgcagtgcgggttctctggttctgcagttgggtggtgcccttctggacaactcctttcaacctggctaggagcagcgccatgtggtttctgcagttctcttgcgcaagctggcaagcagcagcaaccgacgacatcggccaaagaatattttgtccagtgatgatgttttttgctgtgtatgttggagacgtttgctcctccgtgcgggccctttttctc

SEQ ID NO: 61047 - DNA, 407 bp, Triticum aestivum
  Clone ID: PAT_TA_61047
gctgcgagaagacgacagaagggggtccatctgatcaagagaaactacatggtgtttgatgaacaaccggctctcctgatccaaccgatgcttggcatacctccgagcttgatctgctttccatctctcgcttgatttcctgcaggaagtgcacacgacctcttgggcctaatctatccatgctactctagctatgatgtaccagactaccaggtcgatggatgtctcctagatcaaccataagcctggtagctatgttgctgcagcgccgccagagccgctgctgccatcagcggagactcccctgcatggcggatctcctatctgcaccaaccacctctcccgtggactcctctcaagtctcaacatggaagtggatggtggaacgtgacgtcctcctcactggc

SEQ ID NO: 61048 - DNA, 433 bp, Triticum aestivum
  Clone ID: PAT_TA_61048
cgaaagaccaagggggtcttggtattgagaatcttgaggtcaagaatagatgtcttctcaacaagtggttgtgaaagttatcggtagagactgatgccacttgggcgcagatccttcgtagcaagtatcttcattccaaaactttgtcccaggtgagagcaaggtcgtctgactcgcccttttggaaagggcttatgaaagtcaaagtaaccttgtttaataggacaaggtttcttattggcaacggagctagcacgcgattttgggaggatacttggctcggagagaccccccttgcgattcaatacccgtcgctatatcgtattgttcaacggcgtgaggttttcgttgcaacggtacttcaatccactccacttaatatgcagtttagaacggcgctaattggcaaccgttgggaagcatggctccatct

SEQ ID NO: 61049 - DNA, 148 bp, Triticum aestivum
  Clone ID: PAT_TA_61049
gaagacgacagaagggagggttgggggctcggtgatgcatgtaagaaggattcctcgtgttttgtggttctctcgtgccatcctgcgagggcacacccacatgcacatgcatgttgacgtggttcggtgtttttagtctgttaattcc

SEQ ID NO: 61050 - DNA, 438 bp, Triticum aestivum
  Clone ID: PAT_TA_61050
caccgaaacggtgtgagtggccttggtgttattaaggtcagaatacaaaataccgcgctcctcctaaaatacttgttcaaattctacaatcgtgaagatgtaccctgggttcagctgatctgggaaacgcactacccgaacaaggtgccgcacaccgccgagccagtgggttccttctggtggaaagatgtaatgcagctcagtggaatcttctgtgggatcaccagggtggtccccggagatggttgcacctcacttttctggaaggatgtctggtttggagacccagcctccacattaatggatacgcatccgcgggcattctcatatgctctgaatgaggatgattcggttgccaagatcctcaaatccactgatcctgcctcgatcttcagtctgcctctttcgatccaggccagggaagacatcagcgagata

SEQ ID NO: 61051 - DNA, 180 bp, Triticum aestivum
  Clone ID: PAT_TA_61051
actcaacgccgtgctgggatttgctggaatcactgacgtgtgggccgctaaccagctggcccgcatgtcagttacacttggtcacctcggccaatctgaccgtcatactcggccaatcttttcctgtaataaagtttgaccgacaactgtatcgaaaaaaaaacaaaacaataaaacaaa

SEQ ID NO: 61052 - DNA, 431 bp, Triticum aestivum
  Clone ID: PAT_TA_61052
cacctagaaatgactacatgttagtcgcctgagaaatagtcatgccgaattaaaaaatgttccaaaacaaataatggatatcattatacatgaacggtataaaagggaactggtgccctttggtgcaaatgcacaccatgcaagattggctacattatttttcaatatttccctaaccgaatttccaatagtttatgcatgaagttttcatgtaccgtggtgcttgggaatacatcattctaagcacatgatgttcatgcgcacatatatgtatgtcaaaatccatttaaatttcacagctgtattgttctatgatctgtccaaatggatttaaaagataaggaatattacaagtagatatatatgcataacttcagaaactgaagacatctttattgccttaattagcttactggccgatggaaaattgt

SEQ ID NO: 61053 - DNA, 413 bp, Triticum aestivum
  Clone ID: PAT_TA_61053
ggtggacttgtaattaggacaaaaataatcgggttgcatttgcgagttgagggtggacttgcaattgagactaaaaaaagatcagttgcgagtcgaggatgaacttgcaaccggaacaaaaaaatgttgggcatgaacttaaaattgggacaaaaaagtttcgagccccaattacatggacttgcaactgagacaaaaaatgtcaaagtccagttgcgggtcgaggttggggttgcaactatgacaaaagaaaatcgacccccgttgcaagttgaggttagagttgcaacttggacaaaaaattacagaccttttcatgaaaattttaaaaagaaaaggtgaaaaggtgaaaaaaatataaaaatcatgaatttaaaaaaaagaatttgaacaaaaaagaacgagagaagcag

SEQ ID NO: 61054 - DNA, 421 bp, Triticum aestivum
  Clone ID: PAT_TA_61054
cacgatgaggatgcaggatgggcatcgtcgatgtcgagaacaaaatgcttaattatgaaacaaaattaataaacacttagcaaaatttggcatgacctttgctaaaaacaggacatatagagcgcctgaaattttccagaacgtaaacgaattgacatttctggcaaaacatacgccactcggaaaaatatgacatgtccaaaatgtgacatgttcaaaatatgcatgacatgtacacttcaaatttgcgtattaacaggaaaaatttctttaactaaaaaaataacaacaattgctttaactaaaaaaacacctagaattttgttaactacacctaaaacaactaaaacacctaaaattctgttaactacacctaaaacacagcaatggacacacgaaaagaaacgggcgctctagagga

SEQ ID NO: 61055 - DNA, 364 bp, Triticum aestivum
  Clone ID: PAT_TA_61055
gtgaataggtgctgtgaccgacacccactgatgttgaagacgacgcgccaccgaattcctcatgctgcaagtggcacctgctagtgctaatgatccagatttcctcaccactttgtattggttcggccgtttgttttttttatgaaggggggggggggggggggcgaaatcctattttgtgtgcgagataggcggtcaccatgaggcttcagccccgtgcgacgccgacactagagacgaggcatcacccggaagccccgcgctgcaacttgcacatgccagtgctagaggcacggctatcggagagctacacctgaccgacgccggtgctgcgaccggcactatcccggctgcaagccgcgtt

SEQ ID NO: 61056 - DNA, 418 bp, Triticum aestivum
  Clone ID: PAT_TA_61056
ctcgacttggagagagagcttgtttttctctctgaccagaaggcaaagaagctactttcatacaatatcagcacggggaaactcaacgagatacaagatgtccttatgtggcatcagtactacgtctatgtaccatgctactcagagcttccagcccaagaaccttctgttgactgaatgtcaacttctgttcaatgtgcatctgtggcagttctgctgcgatttgctgaaccaccttgtatatcacgctggtcgttgttatctgtgtgacagtccaggaaccctgcttttttcactttgttgaggcagagtcgatatgttatgttcctgtactaactgaaaactcttcaccatgttcctagttgaacaacttgtttgagtttgttccatgcaaaaaagagcaaagcagaggaaagaa

SEQ ID NO: 61057 - DNA, 247 bp, Triticum aestivum
  Clone ID: PAT_TA_61057
ggaagatgggaatggcaggtcccacgcattcattccttctgacgatgtgatgggggaagatggtaacgatagatactagaccgtgcgcaggcactacacattccggcatgcctacacccaatggccgttatgccactaccttacatcgtgtctgttacgccgcatacggtaagtctatatacttacacgtctattgcatttgttcgcccagaaaggcacttcaggttgatcggcatactcaggtttg

SEQ ID NO: 61058 - DNA, 374 bp, Triticum aestivum
  Clone ID: PAT_TA_61058
ccatcttctctgatgccaaaggataagcttttcctggaaaacaaaacaagatgcagaggataatgagatgagggtcgctctcatttgcttacctcatgcgaatttcagcctcttgtcttggcaaattcaaccatctacagactatacaggtactatttccatcatggaatacagttgttgatcgaggccggtcacattacttattgtacatgatacttgcggtgtgagagtgagacaggctgatccgtttaatttgtccgcgaaaccgacgtatgtacgtcgtccgagcggtcgatcgacagctacatccatcggtaggatgggtcagagatcagctctaagcatacagagcttcaaatgattagacatttgat

SEQ ID NO: 61059 - DNA, 379 bp, Triticum aestivum
  Clone ID: PAT_TA_61059
gtcgaccggctgcgagaagacgacagaaggggttcttatttctggacgccgcccactccaagtgacggcctcgcccatgtctgagtttgagaaggcgagtctgatttcatgggcgaggcatctcgcccatgttggccgcttgcttgatcttgtggactctgcactcctggatgttaaccgtgaccaggcgctgctatgcatcactgtcgcactcctgtgtatccagaggtcgccaacccgtcgcccatcaagcgaggaggcgcttgaaatgctctctggtgagggtgaaccaccacatctccctgtagaattctcaccgtcgcctcctggtgggttccctttgagatcccccaggaaaggccggtgagtttagtttgtt

SEQ ID NO: 61060 - DNA, 339 bp, Triticum aestivum
  Clone ID: PAT_TA_61060
agccccctcgctccctctccacacccctgagctccgtcccgaccccatggagctgcacaccgacgcatgcgaccagaggaggccccagtcgacggaagaaatgtttccacccacgagaaggcagatgtgggcgcgacgtattgccctgtcacagacggcttcatttgctgtcagttcccacggaatacggcctatatttatggctaaacagcagcactacgccgtctcacgcagacgcagggcgaagcacatcggcgcacaggactagcatgcagtgtaccgtgcaggttaaacaaaggaccctctcccccacaaaaaagcaaagggcagggaggaaaa

SEQ ID NO: 61061 - DNA, 400 bp, Triticum aestivum
  Clone ID: PAT_TA_61061
cccgggtcgacagaagtatattggatattcattatatgaatgtgtactttactagtactcctagcagcaccagggtattagataccggttcggttgctaagtgttagtaactcgaaataaaagctgcggaataaacggagactagctaaaggtgagatgacgatgtgtgttggaagtgtttccaaggttgatgtgatcaagcatcgcatgctccctctaccatcgagatttgtgtttgcgttgagcatgattggattatgtttatcgcaatacggttattcatttaaggagaataatgggtactctgtttatttgaataataccttcaatggtcttgcacctaaaatgaatctcgatcgcagtgatacacatgttcgtaccaaaaaaaaagggaagagag

SEQ ID NO: 61062 - DNA, 205 bp, Triticum aestivum
  Clone ID: PAT_TA_61062
tgcgggaaacctcgaagacacgcaaaccggactccatctcgcaaagacaagcactccatcatcaaggggtctgaaacccccacatatggtttgcaccaagatcccaagagggccgtagtggaacgagccacaccgcccgcaccacctcgccctgcatcaaaattcagggctccgtcggttgtgatcttgactatacccatgtcag

SEQ ID NO: 61063 - DNA, 163 bp, Triticum aestivum
  Clone ID: PAT_TA_61063
gccgacacccaataccgggcactatgtcatgctccagacatggacatgtgccacaagaacttcaaacgacattcccaggttgacatcgagattgacatcaagcgtatcccaaatacggtaactttgattcaggacatggatgaaccacatgtgaaccccaaat

SEQ ID NO: 61064 - DNA, 236 bp, Triticum aestivum
  Clone ID: PAT_TA_61064
cgaccgagtcattctggaggcacctacatggacgacaaggtctacacccaaaccctcccattcttgtgctgtaaattttcaactgtgactgtcttcatctcctctgtgcatcattttgtcagaaaactggtttgctttagcatcaatccttaatacttttttgtcatatctaaatggccctatctatatattaagccgtggcattgcagcccttgcttaaacgtgccctcttttaa

SEQ ID NO: 61065 - DNA, 324 bp, Triticum aestivum
  Clone ID: PAT_TA_61065
gaacaccagcagcaactgataggtgtaagccatgacgtctacacgcacatatttggagcagagctcgcaacatatatacaacatataagtagagagattatggttgctgcgtatcagtatatatagattattaccccggaaaagaatatagattattctataaggttactctatagatgaagaagtaattcatcagctctagctaagctgggtatagaacagcaggtgttactgaatatccgatctatgtacatgttgtgtaatcgagattattgtgggaatatgctaatctcctgaaaaaaaaaaaagaatggtagggaaaag

SEQ ID NO: 61066 - DNA, 341 bp, Triticum aestivum
  Clone ID: PAT_TA_61066
gaaacttcttcttttttagcagagcttccaggcaagcaaaccccccttgagcattctgatatcgcccatttctttccctctcatgcttgcattagaactgctactgctttatgtatgatcctactctgatgcatagcctgttttgttacctgctttcataccttacctgcttatcctaaactgcttagtataggttggatactgatccatcagtgacccccaccttgtccaagttgcctcgctttatgttagatgactcgatcaacgtgatcgatgtccaggccccgacaccgcacatcaccccccccccttagttgtaggactctgtacagttaccatcg

SEQ ID NO: 61067 - DNA, 397 bp, Triticum aestivum
  Clone ID: PAT_TA_61067
gaaggagacggacgccgctagctcgtagatggatgtttatgtgcggcaaatcgcaaggtgcatgcatgcgcgtgttttacttatgggtatgtgtccctattttcaagagtcatgtacagatagagattgtatgcatcagatcagatcgtaattcttatctcaacttttaaacatgtacgtaaaactcaaaatatagttacgacccaaccaaagttattccttttaccggatctatctattgaacaattaaacctgcacattttgtgaaactagcaacaagcccggatcttgtggttcaacataaatcttgtcggagtaacatttaattttgatttgagcatgggtactggaagacaagtaaagtttcatttagttgagattaccgtatgaaatattg

SEQ ID NO: 61068 - DNA, 421 bp, Triticum aestivum
  Clone ID: PAT_TA_61068
gttgataagggtggtcgttacgccggatcaaacacgtgcaaatactgtataccgcaacacacagacacacaccgtacaccatgactgtgccacacgtacatacatgcaagcatacctgttcgaccagcggtacatggtcgtccgcatgtggagagtaccgacgaggataagcgcgttccagacggtcatcgatgtcgatgtccgccgtacgctgaccggcaggccttaagtctccgtgcgtactgtacctaagctggctcgtcgtcgtacacgacacgtcgatcatttcatacgtgcgttagaaacaacgcatactgttcaaccgtggagacaatgtcgatcgggatctggatggatgtgcactgtggcgaacaaccaaccagactgcatctttctgatggccgtatgcatctttctgatg

SEQ ID NO: 61069 - DNA, 287 bp, Triticum aestivum
  Clone ID: PAT_TA_61069
cgaaccggtgcacgaggtgatgcacgtcatccacgtcgcattgctgtgcacggtcgagcacagcatgcagcgctcgacgatgcgggaggtcgtgcagatcctcagtgagctcccagggccagctggtaatcaacgtgacgaagatgagcttcacctcgccggctaacgccctgagtccaaccctcctgcctcagatatttctacagaaacaccaactggcaatccgatagatcagcaaccgcagcagcagcacactagctcggagtcgtcgcttcatcctgatctca

SEQ ID NO: 61070 - DNA, 418 bp, Triticum aestivum
  unsure (1)..(418): unsure at all n locations
  Clone ID: PAT_TA_61070
ggaattaaccctatcaccatcgcataggaaggttttgttctgctccttcaataagaatttggacaaacagatcaaggtcagtatgtcacagtagtttttaaatcagtgccaatgtgtccatgaatctgtgtcttaaattcgtcacctcgtattaattgcaagtggtaaattttaggatttatatgtcaatgcactcggcatacacccatagcgaacagagtctcggatgcttgatcagataagtagctcaatgatttatgatggcactaataacatcaatcattagaagccccgcaggtagtatggtaccaaacattgctgaaaaaaggtttcncctcgcacttgtatacaagtcatgcagacgaaccatccaactataagtgctgaggcagaaacaacacaatcacgcgcagaaaaa

SEQ ID NO: 61071 - DNA, 400 bp, Triticum aestivum
  Clone ID: PAT_TA_61071
gttcacataacgccactagaggaagaacaacacaacatattatcaaaacattgaacgatgataaacttcacatgattattaataacaagacttctcccatgtcctcaagaacaaacagagctactcaaagctcataatattgatcatgtcagtaggtataaatatgcaatcaataatctgagcataaagatcttccaccaaataaatcaactagcatcaactacaacatgtaatcaacactactgcaccccgaggtaccaatctgatatttgatacaaagattgagcacaagagatgaactagagtttggacgtgagatggtgttataaagatgttgatgaagatggaccctctcacggttagaggaatattgggaataacgacgcttcaattcccccct

SEQ ID NO: 61072 - DNA, 394 bp, Triticum aestivum
  Clone ID: PAT_TA_61072
ccgggccgctgcgacaagacgacagaatggtacggctgcgacaagacgacagaatggataggtatgtatggtggctgtttttagaaggatatgtggcgggtttatggtaccggcggaagttgcctaggactacagaggctaacaatggcgaaaaggtgagagtgcgtgtaatccatggactcaacattagtcataaagcactcatatacttattgcaccaatctattaatcatcaagacatagtactacacgcatgctcctatggggatactttgctacgacaatatcatcgctcgtccccgaccgccactcataatgaatacaagcaccatacatctcatgctccaacatcgttacataaggcttcaccatacgtgcatgctacggcactcac

SEQ ID NO: 61073 - DNA, 154 bp, Triticum aestivum
  Clone ID: PAT_TA_61073
ctgctgtagctgcagtctgtgaagctgagagctgattaggatatggaaccatgatgataatgagactgaattgtattggatgctgagacatggccatcatcatcattatgatgatgatgtactacaatgaataaggctcatattttggaggtgc

SEQ ID NO: 61074 - DNA, 630 bp, Triticum aestivum
  Clone ID: PAT_TA_61074
caaaagcccctctccctttccgccattaaaatactcgggccggaagaaactccccgaagcaccagtgaccgtgctaggctgctagcgttgcgtattggtgctggtggtatcgagtttcgtgcggcggccaccggtgtaacctttgggaggtgttgggtgggggatgtacggcgcgccgctgtccaaggacctcaacctgccagtccagcaccagccggcggcgaacggcgtgcgcacgccgccgcagatgagctcccccggcctgctgcggtaccggtcggccccgagcgccatgttcggcgacgtgtgcggggacttcctcccggcctccgcgggcgctggcgtggggcaccgccagggcagcccggaccacgccgccgacaccggcttcgcccgcctcctctccggccaccacacccagcaccagcccgagatgagggacaagcctccccgccccgccgccagccacttcgccgaggacgccgccgcctccatggcctcgcagcagcagcagctcatgtaccagtcgcagcagcagatggccgccatggaggggctattccgcacggcaagctccggcgccacggaccccgtcgccaccggcgggggcaacgacagcctgctccggca

SEQ ID NO: 61075 - DNA, 575 bp, Triticum aestivum
  Clone ID: PAT_TA_61075
caacaaccaagcagctgccgctatcgaggcggagaagtgtggactgaagaggaaggtggagctagagcgcaatgaggagggggcagcgttactggcgtggatcgcgtccaccaaggcaccgaccgtccagcggagactcggatgtgatgtgtctgacggctaccactcacaagacaacgccatagggagccacagagcgtgcagcgccaagcgctgagcgccgagtccaggccaacaactctcgctgaactttcttggggggggcctaattccatgcacgacgaccactctagctcttgacgtctgacaagctgaccatgagcttctgcaatcctatcccatctagcaccaaccactggattatcgatatctatctatatatttgtaagctgatcctgaaacacatatttatatgctgggatccgttacgcctaccgtgatgctatagtggctcaccgttaaaccaatgacatgcctggcagactgataatctagtcggacctacgatcaccatatattatgccaaagtctactgatgagatgccctctgcatgtgcatagaatcctatgcatat

SEQ ID NO: 61076 - DNA, 794 bp, Triticum aestivum
  unsure (1)..(794): unsure at all n locations
  Clone ID: PAT_TA_61076
cggacgcgtgggcgcgaacctgcagcgatcgacaacaagagccagagccgcagcaataataaagaaagaagaagaagcgagaagattcgatcggccatggcgggatcgcggcgaggtggcgacgaggaggcgtgccgggtcggcctcctggacgggcacggcggcgccaagaaggatgactggcaggtggtcgccggtggcgaggaatccagcaagctcgggaggcgggtgttggaggagtcgaagaagctgtgggtgatcgtggcgccggccatgttcagccgcatcgtcaccttcagcatgaacgtcatcacgcaggccttcgccggccacctcggcgacctcgagctcgccgccatctccatcgccaacaccgtcgtcgtcggcttcagcttcggcctcatgcttggcatggcgagcgcgctggagacgctgtgcgggcaggcgttcggcgccaagaagtttcacatgatgggcgtctacatgcagcgctcctggatcgtgctgctcggctgcgcggtgctgctcctccccatgtacttcttcgccgaggacgtgctgctgctcacggggcagtcgccggagctgtcggccatggccggcagggtctccgtctggttcatcccgctccacttctccttcgccctcctcttcccgctgcagcgcttcctgcagtgccagatgaagaacttcgtcagcgccgccgcctncggggtggcgctctgcgtccacctcctcgtcagctggctcttcatcaccaggtttcagttcgggctcgtcggcatcgcgctgac

SEQ ID NO: 61077 - DNA, 134 bp, Triticum aestivum
  Clone ID: PAT_TA_61077
atcagttgatgcagctgttgcaaaagcccatattaggcgccaagctcattcagatgtttgttcccaggataagaatacattctgttcatcaactttttggtaccataaacatggggaccaagttccattcccct

SEQ ID NO: 61078 - DNA, 637 bp, Triticum aestivum
  unsure (1)..(637): unsure at all n locations
  Clone ID: PAT_TA_61078
ccgacgtggccgccgatgtcccggcccctgaggtggaggtgaccgccgaccccgtcgtggagaccacggccgaggccgccgccggcgacgcgaagccggccaaggagaccaaggccaaggcggccaaggccaagaagccctccgccccgaggaagccccgcgctacccccgcccacccgacctacgccgagatggtttcggaggccatcaccgccctgaaggagcggacggggtcgagccagtacgccatcgccaagttcgtcgaggacaagcacaaggcgcacctccccggcaacttccgcaagatcctgtcggtgcagctcaagaagctggtcgcctccggcaagctgaccaaggtcaaggcctcctacaagctgtcggccgccgcggccaagcccaagccggcggcaaagaagaagcccgcggcgaagaagaaggcgccagccaagaagaccgccaccaagaccaaggccaaggcgcccgccaagaaggccgccgccaagcccaaggccaaggccccagcgaaaaccaaggccgccgcgaagcccaaggctgccgccaagcccaaggccaaggcccccgccaagaccaaggccgncgcgaagcccaaggctgccgccaagcccaaggcccgccc

SEQ ID NO: 61079 - DNA, 749 bp, Triticum aestivum
  Clone ID: PAT_TA_61079
tcagtcgtacgtagctaagctagctagctaggtgcaagaagctagaagctcagcctcagcgatggcgtccagagcagcagcggccgtcgccgtcctggccttgctctgcgccgccgtccactcctcggagggccagctgtcgccgaccttccacgccgcgacgtgcccggacctggagcacatcgtggagttccacgtcgccgagaccttccgccgcgacgtcggcgtggcgccggcgctcatccgcatcctcttccacgactgcttcccgcagggctgcgacgcgcccttcttcaatgtgtcgaccctcgtctcctccttcggcgaccgcggcctcgacgtggccgacctggtgtccctctccggcgcgcacaccttcggcgtcgcccactgcccggccttcgaggaccggttcaagccggtgttcgacaccaacccggccatcgacggcaagttcgcgacctctctccggaacaagtgcgccggggacaaccccgccggcaccctcacgcagaacctcgacgtgcgcacgccggacgccttcgacaacaagtactacttcgacctgatcgcgaggcaggggctgttcaagtcggaccagggcctcatcgaccaccccaccaccaagcgcatggccacccgcttctccctcaacgagggcgccttcttcgagcagttcgccaggtccatgaccaagatgagcaacatggacctccttaccggcaccaagggcgagatccggaacaact

SEQ ID NO: 61080 - DNA, 155 bp, Triticum aestivum
  Clone ID: PAT_TA_61080
gcacctccaaaatatgagcccttattcattggagtacatcatcatcataatgatgatgatggccatgtctcagcatccaatacaattcagtctcattatcatcatggttccatatcctaatcagctctcagcttcacagactgcagctacagcag

SEQ ID NO: 61081 - DNA, 554 bp, Triticum aestivum
  Clone ID: PAT_TA_61081
cctccccccccccccccccccccccccctccccccctttacagccgggtaagggaaattttattccggggcacgcacgtatgtacacttcacagatgaacgacctaagctagactacaaaactaaggcaaatgcggttgacatggggggcccggggcctgggggggctttttaatgaccttcatgtagaactacaactagctcgacctcctgtttacggtttgatcatgggatggttgatttgattgatgacagcatgccattggtcttaagctccgggacggccgttcccacgatcgtgcaatgaagggaagggacgccggcgagcttggtccgtcagttggcaaagctcctcgggggcctgcccgccgggcaggtgcagttcgcccggccgtccttaataaccttgacctgcatttggagctccttgatgtagtcgacagccaaatccaacatgtcggaggtgttggtttgcttctccatgtgggggacaagctcctgcagtttccgtatacgctcgctgatcttcgtcctcctcacccgttcggaaatgct

SEQ ID NO: 61082 - DNA, 513 bp, Triticum aestivum
  Clone ID: PAT_TA_61082
gcccaacaggccacaaagaaggaccatgccagttgctaaaactctgggcacatcaaacatgttgtcaacaattaatatggttaggagggagccaaacctgtcaaaaggggtaccgaccgagttaccaattcctgtttttattccggtcgaaacactaaaaaacaggctagggtttattctggcaactgtgtataccacctatgcaactcccaaaagaatattttttaatttaaacaacttggatcacccctactgcatttcggcaagaaatcgctgtggctatgttttgctgggagggcgggccaaccgggagctccaaatccttgttgtttgctgcatgatcggggttagcacccgtcgcaggaggcaatggaaaaggaccgctttgcggcatcaggaatgccctattacatgaagtcaggttacctttaaaagtccgggcacttgtgttgaaatcctccgtagctgatggaggtgtccctttagggactatgggaactggtgtgaaaggga

SEQ ID NO: 61083 - DNA, 612 bp, Triticum aestivum
  Clone ID: PAT_TA_61083
ctcccctccttttttccccttttcctctctttttttttttttttttttttttttttttggggaaaaacttttttctttaaccactttttttgtttgatttttacaataagcgcagtttttacttcataccgggtttggtactaatacaccccaccccacatgattccttgtagctcccgtcataaatccttcgttgttaacagtttttggccagcagggccggaaataacaaaagcaccctttttaaacccaaaaaaagtacccttgtagggcaaaaaaccagcagtaggggtccccttgggggcagagttaactgacccaccaaaatcaacttggtcaacaacggcttaaccggtctctttggagtcagaaaaaaaaatggctcgctcgacaaagttggcaaaagcaaatttttgaaccaggacttgaccccccttgcgagtgttgaccccggaaaaaaggatcttgccccattatttgttgacaaggggaacaggggcaaaccggataaaaggctgacggttgttaactttcttccagtatttgttggcgtaggtgatgtaaaccttgcccttgtcctgaaaagcattgttatcggaggggccgatgagc

SEQ ID NO: 61084 - DNA, 463 bp, Triticum aestivum
  Clone ID: PAT_TA_61084
gaaggagccaagggatgtttattgctggaaagttatagagaccattacatgctcacagaagagcaggtaagtatgagtacaacatcattccctctggattatttttatttttatttttacttccgatgaacaagcctgggcatcctttttcagcgtgccgacggcggtggagcgggcgggcagcagttgtcgccgcagcaggcgtggccgcaggtcctcgtcggatgctccacgatccagcagcactggcacgcaaggtcgaaaagaaaaaggagggaagagctgaaccctgaactcatgacttacgcagtgaagcagtggtggttgtgatgaagagcgcaagcagaagcagcatgagccaggacgccagggcaaggagagtgttcctcctcatgcctcctgttttgtttgctgtgttcccctcttgatatgcttcacgcggacgcgtgggcggacgcgtggg

SEQ ID NO: 61085 - DNA, 557 bp, Triticum aestivum
  Clone ID: PAT_TA_61085
ttttcttttttttttttttttttttttttttttttttttttttttttttttttttttttttttttttttttttggaaccaaaaattcctccaattttggggatcacttggccctttggttgttttttgcccccccccccccccggggggggggtttaccttttaaagggggaaggggggccagcttaaaatccaggggcaatttgggggggaaaaacccttgctttgttggggacggggtcgtcgggggggtcaaacaggttttccaaggggcctttgcgggggacaattgtttggacaaaaaacccaaacttgggaaactgggggggagggccttttttgatttctttcaccttgggctcaaaaaaggggacggggtcttcggaagggccgaggggttaaaatttctggccgccggggtaaaggtctttcccctcgccgaccccgggggggcctttgtgggggaaccttttaaccaggcccttgaaaaggacctggaaccccacccggggagggttgctttgcgcggggacgagggttggggttcccaaggtagtc

SEQ ID NO: 61086 - DNA, 673 bp, Triticum aestivum
  unsure (1)..(673): unsure at all n locations
  Clone ID: PAT_TA_61086
cgataatcgaggattaccatttcctgcggtgagagctaaattatgttggccacgtagacacagcagtggacgtgcacttgtaacatgtgccagcggggaagctgaatttgttgtaaatgactgctttgccctaggaattggtggaaggtacattaagtgcagggttagtactaagtatgagaattgtgtttttgctgaaggaattccaatgcatgtcacagagccagaactgtatgatgcttttcatagcacaacagcaaggagaatccttaatatccgtttgctcagggtcaagggaaatgccatagctagcccctctgtttctacatgtgaagaagaactggttagagaaatttctccattcatgccaaataagagttttcccggacagaatttccgtgttgaaggtgtttcctccggaggaaaatgattcactgacaagagcaactataacttttgatggaagccttcatcgagaggctgcaagagcactggaccatcttgaagggcactttcttcctttgttgtcaaccttggcagataatacagtgcaatcatgtgttccatagcactctgtcctgntccgtacgtgtttacaatgttatcacccanggaagttacttctctgcttgagagtttccaaagccaaaaaggtgtatcttacaattttgaa

SEQ ID NO: 61087 - DNA, 652 bp, Triticum aestivum
  unsure (1)..(652): unsure at all n locations
  Clone ID: PAT_TA_61087
cccacgcgtccgcccacgcgtccgatcggtacaaatacgagctcaagaacaaagtgtcaaacaactatgtggcagatttggcaacaaggagaaatcttgctaggttgccaggaataggcgttctgtactctgagcttgtgcaaggaatcccacccatactgccccatttggtagaaaaagtaccttccatccattcagttcttgtgaatcactgctagcccagtgaacgggttaatggatgagatagagtttattcagagagggatgngatgatggtgttgtccatctactgggagaaactaacgtggtggcggagcaaaatgccggtttggtgaagaaaataatagttgactatgcctacaatttcatgaggaagaacttcaggcaaccagagaagatcacatgtgttccacataacaggctgctgcgtgtgggaatgacatacgagatatagagagatgctcagtgtattgatgagattgacaatagcttcagttttctcagtaccaagtgcagaaaggatatgcagaggaaggcggcgaccgggtaaacagcctccttgactgaacagcagaggatggagagattttacgcgtacaaggtggtgaaactacagtacatgccatgggtatttaccataatagaatatttt

SEQ ID NO: 61088 - DNA, 225 bp, Triticum aestivum
  Clone ID: PAT_TA_61088
cttcttctcttccctctcccgtcgcctcccgagtctccggcgaccacgcggaaccgacgcggccatggagcaaggcgccgactccgcggcggccaggcggatggccagggtcgcctcccacctccgcccgcccacctcgcaggaggaggaggtggccatcttgaagggctctaattggcgggcggaaggtgcagcaccagggggcagggtgggaggccggggggc

SEQ ID NO: 61089 - DNA, 330 bp, Triticum aestivum
  unsure (1)..(330): unsure at all n locations
  Clone ID: PAT_TA_61089
cccaatttttgacccgtctcgccccttgggccccccccccccccggtctctccgccgcctgggggaggcgatcgccggcgcaggatggcggcggctggtgcagcgacgccggtgggcgcagcgcccagggtggggctgctgtacgacgataggatgtgcgcgcacgcgacgcctgacggggagagagggcccggagaaccccgagcgggtgcgcgccatccggcgcaagctcgacgccgagggcgtgccgtccaggtgtgtggacatgaaggcgaaggaggccaaagaaaaatatatagncctctngccatacccgaaatnatataaaac

SEQ ID NO: 61090 - DNA, 637 bp, Triticum aestivum
  Clone ID: PAT_TA_61090
cccacgccgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaaagatccaatttttcctccccgtgcttgcaaaattttatttttttttttggggccccaaaatttaatttcctggcccggtttttaaaaccgtgggattggaaaaaccctggggttccccaatttaatcccttttgaaaaaatcccctttttcccaattggggtaaaaaaaaaaaggcccccaccaaaccccttttcaaaaaatttcccccccttaatgggaaatgggcccccccctttaacggccctttaaacccggggggggggggggtttcccccaaggggaccctttatttttgcagggcccttaccccccctttttttggttttttcccttttttttcccccaattttcgcggttttccccggaaagtttttaatggggggccccctttaggggcccaattaaaggttttaggggccctttcccccaaaaaaattgttttggggg

SEQ ID NO: 61091 - DNA, 608 bp, Triticum aestivum
  Clone ID: PAT_TA_61091
gccgagccgcccgccgccgcctcgtggccgagccgagccacccgccgccaccgccacctgctcctggccgaaccacccgccaccgccgccgccggtcaagctcacccagcccatcaccgacccgaacctgctctagctcgcccagcccacctgctccgtccagccttccctgcctccgtcggagagcacagtcacagccatggctgctagcttgggaaggggagataggggagcacgggaaccgccatggctacgctcggccaatagggaagcggggggagcttggctcgccggcggggcgggcgacggtggctggcatagtggatcgaggcggcggctggcaaagtggatcgagaggaggaggataatgctatgttatttttattggagagagaatacactgacatgcgggccccacgtctattttgacggtctaccaaactgcagtcaaacgttgttagtttggttgccacatcagcgcttatggtgggacctatctgtcagttttaccatcagccagtgcttatctgagggatcaacgttttttgaaaactgtcaccacaatgttggtgtttaaaaaaaactaaatggtggtggttttttgaaaa

SEQ ID NO: 61092 - DNA, 398 bp, Triticum aestivum
  Clone ID: PAT_TA_61092
cccatctcgtccggcatcatctccggcctcccctcttttaccaaccaacccacccacaccgtgagtggccaccagtagtcaccatgggggaagcggtggccgcatctgaagacacccttaataaggggcggtgcttgtgccatctccttatcccagcttttggcttggcgtcctccgctgtggagggggtctagcccctctccttccgcctccggcacaatcttgcctggccgatccattggcttttcttcttttggaactctttgctgtcgatgtgctattctaatcctgactcctctttctccttcacttcttttgcctgttcaagtttattttctttatatgattcgccttcttaggatgccattggctcgggggtcttattattgttgtgctgt

SEQ ID NO: 61093 - DNA, 193 bp, Triticum aestivum
  unsure (1)..(193): unsure at all n locations
  Clone ID: PAT_TA_61093
ccccccccccccaannnnnnnaaaattgcgaactagcccggtccgctcctgagttccgagcccgcccgatctcccgccgcaagcttcccgccgacgccggtccgtcaggtcggacggggaacctcgccatggccgccgcgtcctccgccacctncttccacnatttcggcgcgaaggattcaagcgggaagga

SEQ ID NO: 61094 - DNA, 540 bp, Triticum aestivum
  Clone ID: PAT_TA_61094
ctcctcttccttttctttgtttttctcttttgattgctttgttccttttttgattcatcttttttccttttttttaatttttatctttttttttttttttttcggaggggggtttatttccttaacattaacataccccacggggaaccctgttttggaacccccaggctaccgaactatcccaaatatttggggcccccccccttccaagaacgcattaaatccttcttccccaaaaaaacccccgtggtttatccttgtcgcctaagggcccaactcctaatttccaaaaagaccatgatcacctgccttgagggcaccccccgacccccttttgcttgtgccactgaaaattaaaacaggcccgctccttttcacggtttcccgttgcaaataaggggggggccaagaacaaagacgacttctattctctctgcgaccccgggggcataccagggattccgaaaccgcatctcgggggcttcctttgttccctctaagggagacatgatggacgagccgtaaccagcgtcaaagctt

SEQ ID NO: 61095 - DNA, 259 bp, Triticum aestivum
  Clone ID: PAT_TA_61095
ctcccttcttttcctttttttttttttttttttttttttccctaacaaatataaaaccattttttttttttaaccacgtgacacatggggcaggcattttaaacaattaaaaaaacactttttttttactccctctgtacctaaatatatgacgttctagaaggctagttagcctcgtatttttaggttggagggagaaacatatggggggggcaaggggggctagtaaggcagttaaggttcatacagttttttaatt

SEQ ID NO: 61096 - DNA, 580 bp, Triticum aestivum
  Clone ID: PAT_TA_61096
aaaagggggattaaaaaaaacggaacaaacccgggggaagggaaaaacttaacaaacccccccccaaagaaaaaggtttgggaccccggccccccaaaaaaaaaaaaaccttttggaaaaacaccccccccccccccggggggaaaaaaaaaaaaaaggccccgggggggaataattaattttgggcagcccaacaacccaaaccggggaaagggcccccccccccggggaacaaaaaaaaaacaccatgggggggccccaaaccccccaaaaaaaaaccggggggccaaaaaaacgggcccccaaaaaacccaaaaagggccccccttcggggggaaaaaagggcccctttaaaaaaaaccccaaaaaaggccccctgggggggacaatatgaaaaaaaaaccccaaagcctttaaaacccgccccaaaaaaagtttaaaaaaccccaccaaaagggccgggggaaaaaataaaccccgcacccaagaaaaaacccccccccctacggaagggcttcccaggtttgggccccggaagccctttgagaaaaaccccaccccccccccaaggggggccccc

SEQ ID NO: 61097 - DNA, 633 bp, Triticum aestivum
  Clone ID: PAT_TA_61097
ccccccccccccccccccccccccccccccccccccccccccccccccccccccccccccccccccccccccccccccttttttttttttttttttttttttggaattttttttttaccccccattttccaaaaaccccgggggggggggggaaaaacataaaaaaggcccccttgaaaagggggggaccaatttttttttaaaccaaacttttttttggttttaaaaaaaaaaggggccattttttaaaaaccccccgccccgggggggtttaaaaaccccccaaaaagtttttggattccctttcaaaggcccaggggggaaaggggggggggtttaagggcccaaaaggggcccctttttggaaacaaaaaattgggaaaattcccctttgggggtggccccaaaaaggcccctttttttaaatttaagaaatttggttgggggaaaaaattgggggccggggacaccacccttggaaaaaggggggcccccccccttgaggggggggggggaaaacggaattttttttttttgggggccgggttccccccccccaaattggtggggggggaaagccaaaattcaaaaccctgggcccttgtttttggggaccagggggctcacctgggg

SEQ ID NO: 61098 - DNA, 512 bp, Triticum aestivum
  unsure (1)..(512): unsure at all n locations
  Clone ID: PAT_TA_61098
cttcgagcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggnattccaggtagccgggcgaacaactactaccgtgcagatggncagaacacgggcaatttncttacggaccgtncttcaaccaaggttaatgctgntnnnggnggtggntngtncttgggctacttgtttggngggaagtgatctttgttaatgatgntgngatgaattggnntgtatntntgttatncatgtggtgaaaantggaagtgtttggtttnagnagtttaaaanttgngtngatgtaatttgtntgtatggttgattgtgtgaagggtg

SEQ ID NO: 61099 - DNA, 490 bp, Triticum aestivum
  unsure (1)..(490): unsure at all n locations
  Clone ID: PAT_TA_61099
cccacgcgtccgcgcggcagtcgccacagcagcgccgacgccggacaccctccagaccccgcggccaagcgggtcacctccggcgctccgtccttgcgatcccgccgcgtagtgtccctgtgatccggccgcgacacccgcggcaccgcctacgacggcggcaccgattcccgtgcccggccccgggcgaccgggaccgccggtgcttctcccagcgccggcgccgcctgaacctttcccgccgctcgacgaccctccggcgctcctcccgccccctccgcctcctccccctcctcctctcccaccactggcagcgccgncgncttcttcaccaccttctcccctcccaccgnctccgncttcgncttcgncttcgncaccgncaccggcggngcaggaggcgccctggaagcgcgcgggcacacagagcaggaccagcaggagggctcccagtaggttgggtccgnctgggatgggcgttcccgtctga

SEQ ID NO: 61100 - DNA, 149 bp, Triticum aestivum
  Clone ID: PAT_TA_61100
gcacattccttcattgcactgtgaattccagataacaaaatgcgtctgggatgctacattatttgcagatgtatcatggatgtgctacatcttcatcgtgtcatgatcgcctaaaactgaaatgaaccgcacccctgtaactgtttcgt

SEQ ID NO: 61101 - DNA, 615 bp, Triticum aestivum
  unsure (1)..(615): unsure at all n locations
  Clone ID: PAT_TA_61101
cggacgcgtgggcgtcgaccatcaccatgcagtccagctccaaggccggcggcaatggcgacgaggagcacctggtttgcgtgacgggggcggggagcttcatcggctcgtgggtggtcaaggagctcctcctccgtggctaccatgtccggggaaccgccagagatcccgctggccgcaagaacgtgcacttgctggcgctggatggcgccggcgagaggctcacgctttgccgtgccgacgtcatgcacggcgacagcctccgcgctgcgttccggggctgccgcggcgtgttccacgtcgcctccccggtctccaacgaccccgagctcgtgccggaggccgtagaggggacgaggactgtggtcaacgcggnggcggacgctggtgtgcggcgcttggtgttcacttcctcctacggngccgtgcacatggaccccaatcggagccccgacatngtggtcgacgagtcgtgctggagcgactacgactactggaaacaaaccgggaatctgtactgctgcgctaagatgatggnggaggtcgtngngaaggagggggngaccaagaggggggctggagctggnggtggtggtgccggngacgaccattggt

SEQ ID NO: 61102 - DNA, 645 bp, Triticum aestivum
  unsure (1)..(645): unsure at all n locations
  Clone ID: PAT_TA_61102
gccattacccaatcatgaatctgtttctgaaaactaactctggcacgaggatccccctccccagacgcaaacaataatgcgggttttagttagaggcgtcggtattccttggctcctgctcccaaattggattttcccatggttgctatgacgcagtagacagatagcttgacaatccagacgcgggtgacacggcaaactgacgtcattagcaatcgtgatcgcgcagtgccccgcgatgctcctgcctcgcaagaggttcaacgaagcaattgcccggcacctacctagagtttgaatgcccgtgaatcactgccatgccgctttcctcacaaatcactacttaaaccccaatccctcccaccttcagacttgttcttttctcatcatcacacatnaatncaatcctcactcacaaacactttnaaacaaaccaacccccaaacaaccaaccactatcacaatggagtccctcaagcaaggtgtgaactacgtngttgagaccgtttaggaggccgnctttggtgcttncaaggagaccaacaagcaggtcgncaaggacagcaatgcccccatngggacccgtggcttcggtgccaaggacgccctggtcgacagggcggagagaagaccatgagggtaagg

SEQ ID NO: 61103 - DNA, 762 bp, Triticum aestivum
  unsure (1)..(762): unsure at all n locations
  Clone ID: PAT_TA_61103
cccacgcgtccggcgatggggtgcatctcctccaaggcactgagcaggtcagggagcctgcgggggaaggccaaccaggggctccagaggagcggcctggtcgaggagatcatcctctccaactccaagaggaacggcgaccagttcctcgccctcctctgcacctccagctccgccgccaggaagagcaaggtcgacgccgccgagcagatcgagacgatcaacgtgtctgaccttctcgccgggctggaggaagagaacacaccggaaggtgccgaggagcggggcgatgatcggaaaccagacggcggcaaaacttcgtcgcctcggtgtgcatacgatggcgcggccgggagggcggtcagcttccgcacgctggaggagttcgacgcgttggtttcgcggtgcggctcgccggagaaagcggagcctgcaccagcaccagcagctgaaccagacgcgtccgtggagccgccgccgcagagcagctcctccaaggagcaagccgcgacggccacagggagcagcgaatccgaaccagacgcgtcagcggtgccgccgcagagcagctccacggagcaaggcgagatggccaccgcgagcagcgctccggcactaggggaggcgcctggcggcgcgaagagcggncgagggcgaagcagctcggcgagctgagcgcgacgccgggcttcgacttcagcaagtcccgcagcctgagggactggctgctcggcggcgggcagatgttctcgccgggctcta

SEQ ID NO: 61104 - DNA, 274 bp, Triticum aestivum
  unsure (1)..(274): unsure at all n locations
  Clone ID: PAT_TA_61104
gccaattaggagaaggtccttgtggatgctgggtaccgngaccccaagcagcagccatagagttggaatcaatagtttggttaaaatggagtttggtttggatttnnnanttttagaagntgatacagtgtggncattgnagtagaggttggttgaagttattgttgtttgtntnagggtagaggtggggaggtttaaagtttgatnttataagagtgttgattaagttagtatgtgatgtgtttttgttatatgagtgaggtgggagttttat

SEQ ID NO: 61105 - DNA, 711 bp, Triticum aestivum
  Clone ID: PAT_TA_61105
agcaaatcggcagaggtggagactaactgcgaggtgtcaatcgggagcgacatctgcgagcaggagcaagatggccatgctgctccgtttcaagaactggtggcgctggaggagctgttttctccattggaatatgcagatgaccggacatcaccaccggagatcctccatgaaacagccccagccgagcaagaagcaagtgaagcagagcatgaggcgacggcgagccggagatttgagtaccaatcgaatggcgagaacgaggaggacgaagacagggcaccggagacgcccacctacagctttgctgcccagaactccggcaaaaggttcttgctcgagaggaagcggtcactgtccttgtccttggatggcagcgtgtcgagcgaggtcgagtgtgccgagccttccaccgtcgatcagctgagatccgcgctgcaggcggagcgaaagacgctcagcgccatgtacgccgagctggaggaagagaggaacgccgccgccatcgcgaccaaccagacgatggcgatgatcaaccggctgcaggaggagaaggccgccatgcagatggaggcgctgcagtaccagaggatgatggaggagcagtccgagtacgaccaggaggcgatgcagctgctgacggagctggtcaccagagggagaggggagagcaggagctggaagggagctggagctgtacaagcaaaagct

SEQ ID NO: 61106 - DNA, 697 bp, Triticum aestivum
  unsure (1)..(697): unsure at all n locations
  Clone ID: PAT_TA_61106
gttggatcaagtgaagaaagtaaagaacggggggagcatgtatgtggggaacataaactactaccacaggcctctgcgatctggaaagtgggctgtaacgtatgaggaatgggaagaggaagtatacccaccttacgcaaacggaccgggctatgtgatttcatcagacatcgctgagtacatcgtatccgagtttgacaaccagaaactgagactgttcaagatggaggacgtgagcatgggcatgtgggttcagaagttcagtaagactcgccagccggtggagtattcgcacgacgtcaagttcttccaggccggctgcttcgacggctactacacggcgcactaccagtcgccgcagcacatgatctgcctctggaggaagctgcagtccgggagcgctcaatgctgcaacgccagatgacaacgaggctgcctggtaattgaaaagcagcacccggctctctgcagaatcaaacagcaaggatgagttcgagtttgatctttgatttggaggctctctggagaattagcttgcgtaattcgctcattcttttggtcagtggctggttaattcagctactgattctgacactagctagatgctgacaccatgtacatgtgtcaaattgtttttgacctaagaactaacagcntctgctgatctcacctgtatccccggntgttctcatatata

SEQ ID NO: 61107 - DNA, 758 bp, Triticum aestivum
  Clone ID: PAT_TA_61107
ctcttacctacaagactcgacattgaatacttctgttttccagctgtggactccgcgacaataatgtaccatctcgccaaaggactctacctctatgcaacgagtaaagaagaatactcggtcattcttctaggtctcgacaatgctggcaaaacaacctttcacgaacaagtcaagtctatgtttttaccaaacagacccgatccgaaactcaaaacagtacctaccgtgggtcagaatgtttcaacaataccgctgcaggacatgtacctgaagttatgggacgtaggcggacagcactccctgcgcaagctttgggagagctactacacgagttgccatgctatagtctttataatcgacagcacagatatcggtgacgggaatatcgagcacgacgaaaacctgggcaggttggaggaatgccgtctcgtcctcgaagacgttctacaacacaccgagaccgaaggcgtaccacttctcatcttggcaaacaagcaagaccgtgaggactgtgtcgagacaatacgaatcaaggaaggtttagtcaagaaggtcatggagggagacaagggctccgccgttcgcgattcgcgtgtgctggctctgagcgctctgacaggcgacggagtccgagaagctatcgaatgggtgaggacacgagtgcaatggaacaaggagtctcggccgcccgttatgcggtagctaatcgacctttgagggtcttgtgtgcaattaatgtggcttatgagcgatga

SEQ ID NO: 61108 - DNA, 387 bp, Triticum aestivum
  unsure (1)..(387): unsure at all n locations
  Clone ID: PAT_TA_61108
ccccgcttccgcccacgcgtccgcccacgcgtccgcccacgcgtccgccggcagtgcgaagaggactgactagaagcggtgcctctgagggtctggtcttttgtctacggcggtgcatatctgagtatctgacgaccgcccgccgccggcgatgggctgttggtgggagcgcctngtgctggcggtgcgaagggcgtggttcggcgtngncttccgtttnggtgtgcgccagtccgggctgtggaggcttcggnaggaggtgagcacgtgcgagtacgaggacgtgcgcgtgatgtgggagatgttgagttgtaccgtgttggtgtcgtcggtggcggtgactaggtgttaaagtaggtttcggtagtcgtggtcgtgggtcgacag

SEQ ID NO: 61109 - DNA, 394 bp, Triticum aestivum
  Clone ID: PAT_TA_61109
ggaacagaggcgtgcagctacgagtggctgaaatggtgactgccgactcagtcaccaacttgtgccatgtcgtccactcatgccgaaaagcaagaacgttttccttgcgccgatttgaaacgggcgcgggtgttcccaagaaagagtgaattgcacataaccgtaagaattgagtcaccagtttcacattaccacaaattttgtactgtcagcttcaataaaattattacaacttttgtggcaaattcattaaccaggcagctaatttgacaaagctggcccacatgccaggttctagatggattggcactgatatgtggttcagcctcgtcagttccgctattaaccgtgcagttagtgacttgacttcagcacaaaagttgctgttttgtgc

SEQ ID NO: 61110 - DNA, 414 bp, Triticum aestivum
  unsure (1)..(414): unsure at all n locations
  Clone ID: PAT_TA_61110
ggcntttctccccactcagtcctcgggtcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcgtcggggccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggcttcggcggcggcggtggcaggatacgggggccagcgccgtgagggcg

SEQ ID NO: 61111 - DNA, 740 bp, Triticum aestivum
  Clone ID: PAT_TA_61111
aggaaatcgaagtactccagctcgaagtctaggcgaagaagcagagcaagcaatcatcaatggagaagggcacgcctgcgctcggttgggccgcgagagacgagtccggtctcctctccccttacagcttctcgcgaagggtccagaaggacgacgatgtgacgatcaaggtgctcttctgcgggatctgccacactgacctccacatcgccaagaacgagtggggcaacgccctctaccccatcgttccagggcatgagatcgttggcgtcgtcatcgacgtcggccctggcgtcgagagcttcaaggccggggacacggtgggcgtgggctacttcatcgactcctgccgctcgtgcgacacctgcagcaaggggtacgagaactactgctccaccctcgtgctcacctccaacggcgtggactacgacggcgctatcacccaggggggtttctccgacgtgctcgtcgtcaatcaggactacgtcctccgcgtcccggagagcctgtctctcgccggggcggcgccgctgctctgcgccggcgtcacggtgtacagcccgatgatgcagtacggcctcaacgcgccggggaagcacctcggcgtcgtcggcctcgggggcctcggccacatggccgtcaagttcggcaaggcgttcaggatgaccgtcaccgtaatcagctcgtcgccgaggaagcgcgaggaggcgctcgagcgcctcggcgccgacgcgttcttg

SEQ ID NO: 61112 - DNA, 294 bp, Triticum aestivum
  unsure (1)..(294): unsure at all n locations
  Clone ID: PAT_TA_61112
ctaatgtaggcatgggtcaccacggggaagatgtgcatcttctaaaagaagagcctngnccaagaggaggggttancaaggaggagggattncccaacaaggagggatttctttttcatgaaggagagactgaccatgaaagagagattgtttaccaaggaggagggatttcccaacatggtttttgtttctgtncangaaggagagattttnnaggaaagagagatttttgttgaaggaggagggaatgtttgtgatgattgagggagtttttgtggtggaggagtgattgat

SEQ ID NO: 61113 - DNA, 748 bp, Triticum aestivum
  unsure (1)..(748): unsure at all n locations
  Clone ID: PAT_TA_61113
gtgtgtgtgtgcagtggccggggtcgtactgcgacacgaagcagagctgctgctacccgcggtccggcaaaccggcggcggacttcgggatccacgggctgtggcccaaccgcgacgacgggtcctacccgcagaactgcaaccccgacagcgccttcgatccctccaaggtcaccccttcttttccatcgcatgcgttattcgtttcctggaatgaccttgcgtgcacgcaccgttgttccttctcgcacgagatgcaccacaaaagataaaaaagtgagagggacggtccaaaccaaaagtgacgagaaatactatgtgttgcgtgcaggtgagcgacatcctgagcagcctgcgcagcagctggccgacgctggcgtgcccgaccaacgacggcctccgcttctgggcgcacgagtgggagaagcacggcacctgcgcgcagaacctcttcaacgagcacggctacttccaggccgccctccgcctgcgcggccagctccgcgtcctcgacgccctcgccaccgcgggcatctcccccgacggcgggtactacacgatgggggccatcaagggcgccatccaggaggggaccgggttcgcgcctcacgtcgactgcaaccgcgacgagtccggcaacagccagctcttccagctctacttctgcgtccacgccgacgcctnccgcttcgtcgagtgccccgtccagcccggcggcaggccctgtggcaacaggatcgagttcccg

SEQ ID NO: 61114 - DNA, 542 bp, Triticum aestivum
  Clone ID: PAT_TA_61114
cgttcccgcaccgcgccaggaacctgtacagcatccagtacggcgtgatatgggaccggtcgcaggtggcccgcgcggaggagttcatcggatggctcaggtcgttctacaagttcatggccccctacgtgtccaaggatccccgcgctgcgtatgtgaactaccaggacctcgatctgggcgtgaacaactggacgcgcgctgccggttggtcgtccgcggaggcggtggctcgtgcgaggacgtcgtgggggaaggcctacttcggagagaacttcgaccggctggttcgtgctaagacggaggccgatcctggcaacgtgttcaacaacgcgcagagcatccctcccttgaatattggagccgaggagcatacatgatgcttgccaaatgacaaatctggccgtgaggagatatgtgtacttagtctatatctatacctctatatatacctactaataaaggtctcatgtgtgattcgaacacaggacctcccgttccataaaaaagaatgcaaccaactgaactttgtgctgcttttg

SEQ ID NO: 61115 - DNA, 687 bp, Triticum aestivum
  unsure (1)..(687): unsure at all n locations
  Clone ID: PAT_TA_61115
cggagctgtggcgaatcgcccgcgtgcccggcgagcgcacatattactacccggatgaggtgcagctggtgggcacgtgcaacggcctcctctgcatatgcgacaaccgcggcgagaggaccggcggcaccgtcaccctcgtcaacccggcaaccggggagaagctgtccatcccgccgctaccaggcgccgcccagttcgcgctaaactaccactgccagaagtgggacagggcgtacagcttcgcctaccacccgacgtccgggcagtacaaggtggtgcacgtcccgtgcagcttcgaccgggtctgcgactatgacgccgcacatgtgctcacgcttggggaggcggcctggcgggaggtgccggactccaatggcaagagatgcaacctccacgccggcatcgtcagtgtcgacggcgtgacatactgggtcacggacggcggcaccgcgaggattgtctcgctcgacctcgatgatgagcacgtcgcctcctccaccatggcgttgccttctctgccggacaagcctgacgactacaacttgaccgaggtggacgggaggctgggagtcgtcctccgcagcccctcggngacaagggaagcgtgggttcgggacagggggaagtggatctgcccgtacgtgctcaggtgcaaatggcagcagattccacgcccgtacttcg

SEQ ID NO: 61116 - DNA, 231 bp, Triticum aestivum
  Clone ID: PAT_TA_61116
cccactcgtccgcgacaagaagcccaagggaaccgatcatgcagagtacgactctgagaacaagaagctgacctttacggcggatgttcctttgacgaagaagtgttatgtagatctcttttgagagatacgtcgaggagattatgattctatcacattgatgtcggtatgactgtatttaaaattggtagtgtatatagcgaatccttaataaaggttgtggttctatgg

SEQ ID NO: 61117 - DNA, 262 bp, Triticum aestivum
  Clone ID: PAT_TA_61117
cggacgcgtgggtgtacacctaaaataaatggaggcatattgcactctgtgaatccgttgtgttttcatggattcgagtctcaagatgttccttagaatatgggcaatcaggagcatgcttgcaaatagaaagactcactacttagtctcgatgacatgctagtggacttaactttctagcgacatatagtgtatatatatttctacatgactttatatgtatactatactctagataacttctggaaatgatccaattgag

SEQ ID NO: 61118 - DNA, 443 bp, Triticum aestivum
  Clone ID: PAT_TA_61118
aggacatggtccggcggggcttccggttcgtcggccccaccgtgctccactccttcatgcaggccgtcgggctcaccaacgaccacctcgtctcctgcccgcgccaccgcgtctgctcctcttcttcctccacctcctccgtctaagccgacggccggccatgcaccggccgccgcacaaaaagagaagaaaaaaaaagaagatctcgaagagacagatgacacgagatagcctcacctcagccctcaactcatgggagtagtagtatacgaaatgggagtgtgtgtgtgtgtatgtgtgtgtgctcggtcggcacgcgtagattaactgcgtgccgcccctaattagcttgcttggtaatcgctgccagttcagtcggtacgtgcgtgcatgtaatcgggtgctgctgccgctgcttggtgtatagtcattttgtgtgattg

SEQ ID NO: 61119 - DNA, 421 bp, Triticum aestivum
  Clone ID: PAT_TA_61119
gacgcgtgggcaagaagagatcaaacatacatacagtgtagaaaagagataagtatcttggcatggcgtttaccaagaggaacacaggcgtggtgtgcttggccgccctcatggtggtgatggccactgtgatgctgttctgtgatgccgaatcagatatctgctttgatatccccggaccatgcgtgcagtcgttatgcaaggaagcatgtgccaaaaacagtaccccaaatagaccccgctgccagcccgtgactgatgaatgctgttgcgacatggccgcacggcccgaggtcgccgacgacgtcgtccgtcatgcttgatagcatagccttgattcattattggacacacattgtggggtgatcaggacatgtatgtatatgcatgcgtgcgtctcagcaattgcattttgaataac

SEQ ID NO: 61120 - DNA, 672 bp, Triticum aestivum
  unsure (1)..(672): unsure at all n locations
  Clone ID: PAT_TA_61120
gctggctcagcgcaagcaatcgacccaagcaggaactccaccggccgagcacagcgactgaaccctgcggccacctccgatccgggcgttgtcccatcgatctaggcatgcttcacacggacgccgcggtgcggtgcggtcacaccaccacaccacacgtagggcggtgagacgtgaacaggcggcatcatgggagcggcaaagctcacgggcggcctgtgcggcgcgcgcgcgcctggtccccggccacgctcgctctgccataaggatcccaccccgcgcacactggcatggcatactgcagcgctctgcatcccgatccagacacagacacacagacacagagcttttggctgctcctgctcggctgctcccatggggctctgcctgtccgtggccctgtggaaggacaaggcctacgcccgccgccgggccgtgcggcgaggccagcaggaggccgtcgacgtcgatgtgatggtgcgtggcggcggcggcagcagctctgtctacgggcttctggcaggtggagtgccggaggcggaggaacccgtggccgtggcggcgccgagggcttcgggcgcgctgggcacgcccgngcggccgatatggcagaggagggtgctgatgggcgtcaagtgccggctgccgaagttcagcggcatgatcctgtac

SEQ ID NO: 61121 - DNA, 333 bp, Triticum aestivum
  Clone ID: PAT_TA_61121
gaagccttaccctggtgtctttatccgtgcgcctgtcgtggaacaagtcattggagcatccgatggccgacaaccagtcgaggttctcgcaaaattgccaggccgtgttgacaagatgaagtctggagtctcgcaggccaacacaaaagacgactctggtgatatcgtcgctgtcagacagggaaatgtgctgggaactagtttccatccagagttgacaaaggatgagcggatacacgtctggtggctaaaggagattcttaaccagcaatagacttagatacaaatagacggcgtttttggaaaggaaaatcattaatattaggggtatct

SEQ ID NO: 61122 - DNA, 690 bp, Triticum aestivum
  unsure (1)..(690): unsure at all n locations
  Clone ID: PAT_TA_61122
cggacgcgtgggcggacgcgtgggcggacgcgtgggcggacgcgtgggcggtagccgagtgcggaggtagccatggacagcgccctcgcaagcgcggcggcgatcgccgaccagcgccagaagatcgagcagtaccgccacatcctcgcctccgtcatctcgtcttccccgccggacatcccccaggccaagcgcttcctcaaccacatggtgtcggatgaggtgccgctcgtggtgtcgcggcagctgctgcagacgttcgcgcaggagctggggaagctggagccggactctcagaaggaggtcgcccactacgcgctcacgcagatccagcctcgtgtggtctccttcgaggagcaggtggtggtgatcagagagaagcttgcagaactgtatgaatctgaacaacaatggtcgagagcagcgcaaatgcttagtggcattgacttggactcaggaatcaggatgcttgatgacacaaacaaattatccaagtgcgtccagattgcgcgactctatttggaggatgatgatgcagtgaatgctgaagcttttatcaacaaagcctcgtttttggtcacaaacagcaaccangnaagttctgaacttacagtacaaggtctgctatgcgagaattttagatctaaaacgtaaattcttggaagctgcacttcgatactatgggatctc

SEQ ID NO: 61123 - DNA, 671 bp, Triticum aestivum
  Clone ID: PAT_TA_61123
ggagagaacagccaataacatgttgcacatcaccaattactattaaaatacatagatcttgcatggcatgttataactcctatattgtttcgtcataggatcagctggttatgcatttgtattcttacttgttgcagatgatggaactagagctgaagaagctagaggataccatcaagtctattcatgaggaaatgttttatctacgtgaaaggtacaatgctgcctgttatttctagctctggtaaaactttgtttgatgataattagagaagctaactccagatcaagtttttggcctgtcattcgtgtacctagtatttttaaggcactggtaaaacttcattccatgataactaagacgccattctgaaaccaagttttttatatctgtcattcgtgcagggaggaggaaatgcagaacatcaacaggcagacgaactcgaggatggggtggctgagtttcctctcactcggcatctgcttatccgtggcagggctgcagctgtggcatctgaagacctttttcgagagaaagaagctgctgtagtttcccccatgatcacaaacaaatcgttgcgaattagggtatattgtttctgccagctgttgacctatgtttccaagcgaatacttgaaccatcagtaagaaagaaaccgttgatcatcat

SEQ ID NO: 61124 - DNA, 731 bp, Triticum aestivum
  unsure (1)..(731): unsure at all n locations
  Clone ID: PAT_TA_61124
cgaagtgagagcgcaaacccatgttgaagagttatatgccacctgctagcccgatgcacatttttgtgaggcagtatatgaggctccagtttgaccatgggaaggaggaaagttacgaaaggactatttgtcagaaaaactgatgtatctgtttgttattcaccgttgctgattaattttcaatttttcattctcagtaaaactgatgtgtgctgatggtggcagggaggtgtcgtgaggagagcaaatctggcaaatggcaatagagcagcatgcaagcaaagtgtacacttgtgctatgttttggagccccgtcgaaaggtttggaggcccaggaaggtagtgttggggcgtccgtcggcgtgaatgcgcttcaatgactagcaccaccggagtagcagagaggtgtagggaggccgtcgaacagccgggagaaagcaccacacgagggtctgagcaagcataccaggttttgcagcatctgcccccgtgaaggccacaagccgacgacatgccctgatcgtggagaagcacctaaacagccccgcaaacccggaaagtgcaagaactgttgaatggaaaggcgctgcaggaacacgtgcacacgcctactgngtggtgcacatatgtagtctagaagattaaaatttcgtgtgtaatgtgtgattcaaggattttntggtgtgtgttgtgagccatgctccacgattgttccttcagtgcttaatctt

SEQ ID NO: 61125 - DNA, 292 bp, Triticum aestivum
  Clone ID: PAT_TA_61125
cggacgcgtgggcggacgcgtgggcggacgcgtgggcgccgctctactgtcggtccgtccgccgtggaaactcgcggatatttttcgcaataaggcggacgcaggtgggtttgcgtccaactaggaataattgtatgacaggggagaaatcgttttgctatgttgtatcacattgctgagccaacagagagtgggcaataactaaggtcagaaaaccagggccaactaagcagaaactgtgtttgtattcagacctcgacatgaatcaaacttgtgaggccattctgacctt

SEQ ID NO: 61126 - DNA, 774 bp, Triticum aestivum
  unsure (1)..(774): unsure at all n locations
  Clone ID: PAT_TA_61126
atctacaatcaggtcggcacagtcgactaacaggaagaatcctgaagcacgcggctgactaaaagacatatgtgcgtggttgtgggtgatggtggtatatgcactgaaaaatagaaaatctgaagcgactccttacataattcgaggttgaggctcagtattgcaccacctgacagggcaccctgcgcaccgaggattgagttttgattcacttggtgaggcatacgacttttacaacttgtattgttgggagattggctttgggattaggtatggcaaaagcagatcgaacgctgagaggatgaagttgatgcaggaaattatttgtggctgctcgctgaatgtgtgtgttgcaggggaagccggaagcgaagaatagcagttcgtgcggtacatacagaagaatgcgaaggagagcctgggccctctgtacacgaagtgaaagtgcaaaccacatgttgaagggttatatgccacctgctagcccgatgcacttttttgtgaggcagtatatgaggctccagattgaacgtgagagggaggaaagctacgaagagtagatgactaattgtcagaaaaactgatgtgtctgttcgttgttcaccgttgctgattaattttcaatttttcattgtcagtaaaactgatatgtgttggtggtgggcaggaggtgtcgtgaggagaacanatctagncatagagcagcatgcaagcaaagtgtgcactcatgctatgttttggagccccgtccaaggtagccctagtttggagccc

SEQ ID NO: 61127 - DNA, 286 bp, Triticum aestivum
  unsure (1)..(286): unsure at all n locations
  Clone ID: PAT_TA_61127
cgaatcgcgatctgtttcatacccatctcgtgccaattatgtgttaaattcaggtggattggaaatagctgtctgtttgggcgtatacctctctgctcctgctctcgcggtgttaggctaggctggggaggtcctccgacaatattctcgcgagcaatttggtatcaccggttggatcaacagagaggagcgcgtgtttttgttagtcgggaatccactggcagtagcattatttctntttgatcaggttgctaggtggctgggagtgggactggnncttgttttt

SEQ ID NO: 61128 - DNA, 707 bp, Triticum aestivum
  Clone ID: PAT_TA_61128
ccaaggatggccagacacgtgagcacgctctccttgctttcactcttggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctg

SEQ ID NO: 61129 - DNA, 654 bp, Triticum aestivum
  unsure (1)..(654): unsure at all n locations
  Clone ID: PAT_TA_61129
gcatccccacccacctaccgttctccttcctcacctttgacctctctcagctgctcccagttccgctcctgtacagtccgatgcttataggcgtcagaaacagagctactttaaaaaaaacagagcctgctaaattaccccgaagagagagagagagagagagagagagagagatgggcggtgccgtgaaggtgtacggggtgggggcgtctccgttcgtggcgacggtgctgttgtgcctggaggagacgggcgcagactacgagctcgtccccctcgacatggcggcgcgtgagcagaggaccgagccccacctctcccgaaaccctttcgggaagatcccagtgttagaggacggagagctgactctcttcgaatcgcgcgcgatttctcggtacgtgctccgcgagtacggaggcaccagcgcgaccgatcttccaagggaatccagcctcgaagaatcagccatggtggacgtgtggacggaggtggaggcccaccagtaccagccggccatngaacacatngtccagcagtgcgtnatcctgccgttcatcggnggngcgcgcgaccaggccgtcgttgacgagaacgtnnggcagctggagaaggtncttgacgtgtatgaggcgcggntgtngacgcacgcgtacc

SEQ ID NO: 61130 - DNA, 656 bp, Triticum aestivum
  unsure (1)..(656): unsure at all n locations
  Clone ID: PAT_TA_61130
cccacgcgtccgacccaatgcatgatcctttcctgtagcgctaaaacctcatccactggctgaggaaaaaacacccttagggcccccacgttgctcccgcaggggcgactcgggcggcgataacctagaccgccgccagccacccctccccccttctcctcgccctcgccaccatcggagggagtcgccggatcgtcgcgcgtccgtcggggagggtggtggcgaggatctgtccgccctgtctcgttcagggggctatggagccgaggcggcggcctctggtggtggagcgacggcgacctcagcaagtggccgtcactagtgctggccgtccccttggccacgcgggtggcaaggcggcggcgggtggtggctgtggggcgcggtggccatgggggcgcctgccccggatatgacgcctccccctccaaccctttcggcccctgtcagatctgatctccggccgccccaggctgccggcgtcgcgtttgtgctaggggtggggaagacgtggggcccgaagaaatccaaggctggctctgncggccacgacgacggcgacgcctgagggcgccgtctcctaccagtaggcgtcgtcaaggttatccctttcccctttgnctcgttcccctgctcgtataccggggtgaaaaccc

SEQ ID NO: 61131 - DNA, 311 bp, Triticum aestivum
  unsure (1)..(311): unsure at all n locations
  Clone ID: PAT_TA_61131
gtagagacataggagagaaagaacccagagcgggaagagagtcgncgccggnggaagggaatcaagcaagaagatgacttggggcagccagagggagcgcgaacgngagcgcgcggtggtgcggaagcccaacttcaagaacggnggggatgggctnaccctggagcagtgtcgtgagagggacaaggagggggtggaggagaagaangnnaagaaggtggtgtaggtttttgggagtagaaattttatggacgccaagggtaagganggtaagaagtagttggagaggtgttgatggatactgtttttgt

SEQ ID NO: 61132 - DNA, 754 bp, Triticum aestivum
  Clone ID: PAT_TA_61132
gcagactgtttgcaatcattcaagcctcctcctctgaggggaggagatgcatctgtcaactctgtccatttgtttccaaagaatagtgatcacattgttgtctgcaataagacttcgtcaatatacatcatgactttacaaggacaggttgtaaagagtttctcatctggtaaacgggaaggaggagattttgttgcagcttcagtttcaccaaaaggagaatggatatattgtgttggtgaagacatgaatatgtattgctttagtcatcagtccggtaaacttgagcatctaatgaaggtccatgacaaggatgtgattggcattactcaccaccctcacaggaacttggttgccacctatgccgaagattgtatgatgaagatatggaagccttaaggatgtgattggcattactcaccaccctcacaggaacttggttgccacctatgccgaagattgtatgatgaagatatggaagccttaattacattcattcatttccagttttattaatctgagtagtattttagaggatgcatttggttcttgtaatagtcgtactgtagcatatataaaaccagttggagtgattgatcatcaaacacattaagctaggagaatgggcggccaatcagcatggccatgtggcgcatgctggttggccgtggcaaaaaacattttgatttcttttggaagaccattaagctacgggagaatggcggccaaccagcatggccatgtggcgcatgct

SEQ ID NO: 61133 - DNA, 296 bp, Triticum aestivum
  Clone ID: PAT_TA_61133
gtccacatgaccgaggccatgtacaaggtcgtcgccggcatgttcttccgcgacgcctcgggcgccttcatccgcccatccttcgcctccctgctcgccgccgccaggaaaggccacggcatgtgaggatcatcttcaccctttagcagcagtcttgtggtggatgttgtaattcagttgaactgtgaccaccaccttgttctgaatccattgtgatttgtgagacagattgtactagttgacgctacggcgacgaacagagaattttaataaagagtatcctagagttccaggtt

SEQ ID NO: 61134 - DNA, 211 bp, Triticum aestivum
  unsure (1)..(211): unsure at all n locations
  Clone ID: PAT_TA_61134
cggacgcgtggngaaagaaagggatcacatgtattttctccggcgttggatggtttctgattttccaaagtgctttgcttgatttggttttccccccactggctctatatccccaatcctgcgatgttcgtgtggagtttgtatttacaaacatgaggattcaacaaagacaagagagaggacaaaaagaacgggcaaccttttttacttt

SEQ ID NO: 61135 - DNA, 281 bp, Triticum aestivum
  Clone ID: PAT_TA_61135
gttggcgaggactccgatgcggcgggcaggcgagccagaggaggtggctgcagtggtctcgttcctctgcatgccggcggcatctttcgtcaccggccaagtcatcgctgtcgatggtggtcgaacaattagtgcgtagttaattattaagagggcctcatcgattaaactcttctgcatgcagattcagtgataaagtagcacctgagtgttgtcccctagtacaattattttgctacattgttgttagtttttaatgtatttctaaagtagatttgtct

SEQ ID NO: 61136 - DNA, 751 bp, Triticum aestivum
  unsure (1)..(751): unsure at all n locations
  Clone ID: PAT_TA_61136
ccctcccccccccccactgctcgggacgccatcaaggtccaattccatctcttgttctcccctcgatccggatgctctgctctccgaccccgttcggtaaccgttaatggttcagataccctgagggagaaggaggtgccgaaaggggatgggagcaacaagtttgaatcgaaagagtttattgtaccatcagtggccgtgctggacaggaggggccagcgaagtacttttagttatgagtttgttaaaccggcggaatctaatattcctgagattgaaggatgtaacatcgcacatgttgtactacagctgaaaactcttggcattgatgtgtaaccatcaagttagtttaatgtgccctcaatggccatgttggacaggaggggccagggaagtgttttcggttgtttcaagactgtgagtttgataaaatggcagaatccactattcctgagattaaaccatgtaaccttgcaaatattgtactacaactcaaggctcttgggactggtgacatcataggtttccattttatgaagaaaccatcaaggttgacaaatgagcatgcatctacggagtggagcagaggcgtcttctagcctaacgaagtcttggcggcagctgcgtgtaaaacccttaccaacttcagatcagagaagagcatgcacctgtgccggcgaagagctcgtcgtcgccgctgtggggagggcgcctgggcggctgcacctgtgntgggggaagagctcgtcgt

SEQ ID NO: 61137 - DNA, 731 bp, Triticum aestivum
  unsure (1)..(731): unsure at all n locations
  Clone ID: PAT_TA_61137
atcatcgaccgtcttcttgcttgccatggaggctgccatatccgtagtcacgggtgaactagtgagtcgtttcatctccttcctcaaaaacaagtacaactcctccttgagccatgcacaatcagagaagatggaggagagactgcagcacctcttgatgagagtcagcatcgtcgtcgaggaggcggatgtgcggtacataaccaactctgggatgttattgcagctcaaaatgctgtcaggggccatgtacaaaggataccacatgctggacaccatgaggttccaaaaccaccaagagagtgcatgctttgacaaggttagaatcaacgactcatctagcaacaacttgtatttatccattcctttcaagcgttctcggacaaaaactgagatggatgacaaggccatgcgcctcgagtcagatggtgccttggaaagcttagaaattgttgttgctaacatgacagaatttgttgtgtttctgggtggatgtgagcgcatgtctcgtaggccatatgatgttcatctttacaccaacaacttcatgttcagccgacatgctgaaaagcaaaagctcttgagcttcttgttggagcacaatgattttcatgcacctgcagttcttccaatcataggtggtgttggagttgggaagaaaacattgnttgctcatgtgtgtgcagacgaaagggttcgctcacaatctncactactttgcacttgaatgg

SEQ ID NO: 61138 - DNA, 206 bp, Triticum aestivum
  Clone ID: PAT_TA_61138
gtaggccttgcccctgtatccaccccctgttgtccttctatatctcgatcggagaataaaaaccctggtatgcaaggccgttgtcacgctggttagatctgttgcaccttgcataacagtgagaataaaatagagatgtgatttgcgatgagttatggtggtacgttttgtacttagatgttgtgtgaaatgcagaggagatattg

SEQ ID NO: 61139 - DNA, 758 bp, Triticum aestivum
  unsure (1)..(758): unsure at all n locations
  Clone ID: PAT_TA_61139
atccattcaagctaagctgaggtcatcatggaaccaacgatgagcaacattcccacgacagcacgcctcgacgtattgatgcctttaatctattgatattttatatgctttactacactcaatcataatcgaataataattcatataacaacaatatgacgctcctgtcaccattcctgccattcatttcattaatcagatatcgtcaatcttacacacatcatgttctatgcagatttgcgcacgcgtaatgttgcgttaggttgcaatgaatttgagcgggtcaaatttatctccaggtttggaggaatgagattgaccaagtggtcgatccgcgatgagtgacatgggggcgttcatggcagaatttctcaggggagtccttctgtgttacagctttgagcttcgcgacaactcccgcgatgtgtttctagtgggacaccagcccttggcctagatgacggacaccatttcgcattttgagacaatcattgggtgtggtgggaaattgcactattcaaggtcgcatacaaggcggtgaaaaacatcacctcttcccgtttatgtttgtaccagaacagaaaatattcttgccatccaaactatggcatggaatatacggcggccaaaaagagtttcaagatgcgacaaactacggacagggttactggagggaccttgctttaagggttggcgaggaagttcgttcaggttgtttgtcgaaccttngacatcactcaccaactcatcgacattgc

SEQ ID NO: 61140 - DNA, 702 bp, Triticum aestivum
  unsure (1)..(702): unsure at all n locations
  Clone ID: PAT_TA_61140
ctggacggaattttaaccaattaggtttctactaactaaaactaggaagtcagagtttttccatccaaaaaagcctttctagtttaagatctacatttctagatattatggtagttcgaccgcggaatttttttgtttcggtatctctggaatatgagtaaagtatatgattggtttgaggaacgtcttgagattcaggcaattgcagatgatataactagtaaatatgttcctccccatgtcaacatattttattgtttagggggaattacacttacttgttttctagtacaagtcgctaccggttttgctatgactttttactaccgaccaaccgttacagaggctttttcctcggttcaatacataatgaccgaggccaactttggttggttaatccgatcagttcatcgatggtcagcaagtatgatggttttaatgatgatcctgcatgtatttcgtgtgtatctcacagggggatttaaaaaaccccgtgaattaacttgggtcacaggtgtggttttggctgttttgactgcatcatttggtgtaactggttattctttgccttgngatcaaattggctattgggcagtcaaaattgtgacaggtgtacctgacgccattccggtaataggatcgcctttagtggagttattacgcggaagtgctagtgtgggccaatccactttgactcgtttt

SEQ ID NO: 61141 - DNA, 610 bp, Triticum aestivum
  unsure (1)..(610): unsure at all n locations
  Clone ID: PAT_TA_61141
ggaccaaggggaaattttctgttagattgttgtcagtagagtcaagaggtccatgcacacatatgcgctgcataacctcgacgacatgcatttatacattgtaatttggagagcaccgtctctttagaagtcagataaattcagtccacatcaacaccaatgttgctaactttaaccgtttgcagttgcaaagtttgctgcattaggaatgtgcagtcgtagtagaagaatgttcttaagcctgaaattcaaatctgttagtttaaattcggtgaactcccggtttatcttttgagaactactctatctacttaacatcttaacctgtgttgattttctgcagtaattgctgtcacaaggatttgcaacacccagtaagggcgttgatcttcttcagacctggagatgtgacggagggaggaaggcattcttttctgcaaaatatagtaatgacataaatcattttttcggcaggagccagcccctgtaatttcttttttgcctttgtgctgttgagatcttgtaaaataatatgctccaaaatactcaaccatagcagagtttgctcctcaaaaaaaaaaaaaaaaaaaaaaaaaannnaannnnnnaa

SEQ ID NO: 61142 - DNA, 539 bp, Triticum aestivum
  Clone ID: PAT_TA_61142
agcctacgccgcgtacatggtgtacaagttggccgacgattcctctggactggactcgccagcccaggcatcggtcagcattggaggcatcaaccgatcaacccgcaaggtcagcctgcagctccatgctggcagtgggcagcaaagaagcacgagaagaaaccgccgccgtgcagttgaggacgcagtgctcccttgcaaaagagccgacggttgggtggagctggagctgggtgagttcttctgtgaggggggtgaagacggcgacgtgtccttcggcctcgcggagacgcaagaactgggctggaagagtggtctcatcgtgcagggcatcgagatcaggcgtaagaaattgggctagttaatcaaggagcttctacgcgtgcaggtttactttaatccagtaagtaataatgtactgtattgtataggggaaaggaaccatatctgtttgtaatgcatgtttctgaactgatacctttgttttcatgttaaaagaaggaacagttaaacaagacggaaatgtttgagatttttat

SEQ ID NO: 61143 - DNA, 676 bp, Triticum aestivum
  Clone ID: PAT_TA_61143
caccctccaaccggccggaccgatcccctgctccaattcctagataaatcggcttccgcttccgcagtccccttcctcgccccactaggcctcgactgacgcagcgagggagagcggatcggccggggacggcggcgatggggaacgcgtcgtcgatgctgacgcagtacgacatcgaggaggtgcaggagcactgcagctacctattctcgcagcaggagatcgtgtcgctgtacgagcgcttctgccagctcgaccgcagcgccaaggggttcgtctccgaggacgagttcctctccatcccggagttctccaccaacccgctctccaagaggttgttacgtatggttgatggattgaacttcaaggaatttgtttcttttctctctaccttcagcgcaagggccagccttcagcaaaagattgagttgatatttaaggtgtatgacattgatggcaaggggaaagtatccttcaaggacctggtagaggttttacgggacctaacgggctcatccatgtcagagcaacaaagagagcaagtactaacaaaggtgttggaagaagccgggtacacacaggattccacgctagcattagaagatttcgtgacgatcatcgaccaccctggcctgaagatggaggtggaagtgcccatcgactaagtgaacggcga

SEQ ID NO: 61144 - DNA, 503 bp, Triticum aestivum
  unsure (1)..(503): unsure at all n locations
  Clone ID: PAT_TA_61144
cccacgcgtccggtccagtgcgccgccacccagcagctggccaccggcgcgctcccacgtcgccaccggtgggcttccgcaacatcgtcgccggccgcgtccatcccctcatccatctccatagccccgtctccctccccttcactccccgaccacacccatctctgttcgccgccggccgtcgcaggagctcgaccacgaggacgggccgccacaggaactcaaccacggcggcgggccgccacaggagctctaccccaacaccacctcccgtggtgccgctgctaatcagcggcagggaacaccagttagccaccaccgccggccagcctctcacccgagctgcagcaccaccgncggccttcctatcacccaatctgcagcaccagcgtcggccttactcaagatggaaaaggaaaaggcaaattgggatgcacatcacataaccgtgttttgtgaggtatgcaaagatgaagtggataaaggaataggccaaaggttgt

SEQ ID NO: 61145 - DNA, 630 bp, Triticum aestivum
  Clone ID: PAT_TA_61145
cccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaaccaaattttactaccccgggcttgaaaagtattattttttttttggggcccccaaaattaatttcctgggccgggttttaaaaaggtgggaatgggaaaaacctgggggtacccaaattaaatcgctttgaaaaaaatccctttttccccagtgggggaaaaaaaaaaaaggcccgccccaatcccctttccaaaaatttgcccaccttaaagggaaaagggacccccccttttaggggccatttaaccgggggggggggggggtttaccccaaggggaaccgttaattttgcaagggccttaggcccggtttttttggtttttttcctttctttttcgcccagtttggcgggttttccccgaaaagttttaaatggggggctcctttaggggtcccaattaagggttttagggaccctcaaccccaaaaaatttgtttaggg

SEQ ID NO: 61146 - DNA, 431 bp, Triticum aestivum
  Clone ID: PAT_TA_61146
agcggatgcatttgttgtttaccagggccaccatggtgacaaggccgtgtacagggccaatgttattctgccatcttcagcatttagtgagaaagaaggcacttacgagaacactgagggttgcacccagtggaccatcccagctgtgcctacagttggtgatgctagggatgactggaagatcgtccgtgctctttccgaggttgccggggcgccactgccctacgacagcgtcgcagctgtgaggagccggattagtatggtggccccaaatcttgtgcgcgttgacgagagggagccttcggtgatctctgccgaggtgaagcctccggtgaagcagcaagtgagcccggctccattcaaagctgccgtggagaacttctacatgaccgacgcgatcacacgggcttccaagatcatggctcagtgca

SEQ ID NO: 61147 - DNA, 271 bp, Triticum aestivum
  Clone ID: PAT_TA_61147
ctgttgcatgaggctggactacccgaaggtgtcctcaacatcgtatctggtttcggtcctactgctggggctgctcttgctagccacatggatgttgacaagattgcattcactggatcaacagatactgcgaaagttattcttgagttatctgcacggagcaatcttaagccagtgacactggggcgaggaggcaagtctccttttatcgccgtggatgatgccgatatcgaccaagccgttgagcttgcccactgtgcgctggttttta

SEQ ID NO: 61148 - DNA, 672 bp, Triticum aestivum
  unsure (1)..(672): unsure at all n locations
  Clone ID: PAT_TA_61148
ctcacctgcacccgtgcctagctatagcgagctagctacgtctctcaccggaagctagctaggtagccgcgggcgccatggagctggtggggcggctggcgtggttggtggcggcggcggcgctggcgctggcggcgacggtggcgaggtgcgacccgcaggtgccgtgctacttcatcttcggcgactcgctggtggacaacggcaacaacaactacatcgtgtccctggcgcgcgccaactacccgccctacggcatcgacttcgccggcggcccgtcggggcgcttcaccaacggcctcaccaccgtggacgtcatcgctcaacttctgggcttcgacaatttcatccctccctacgccgcgacgggcggcgaccagctcctcaacggcgtcaacttcgcctccgccgccgccgggatccgtgccgagaccggccagcagctgggcgggcggatcccgttcgcggngcaggtgcagaactaccagacggcggtgcagacgctggtgaacatcctgngcgaccgggacacggcgtcggagcggctgagccagtgcatcttcacggtgggcatgggcagcaacgactacctcaaacactacttccagccggccttctacagcaccgggagccgctacacgcccggacagttcggcgactcgctcatcgccg

SEQ ID NO: 61149 - DNA, 279 bp, Triticum aestivum
  Clone ID: PAT_TA_61149
gggagaagttctctggtcaggtcgaactgacgcttctggccagaacagatcacagtatgatgctgcgccgcgactggcggagatgcgcgagcgtatggtggctcggggtgtgagtgcttcgccggttcagatgccattctgtacacagggcaatgccactgagtgtgcgcaagtcgatggatgataattttgacgtgtggtatatccgtacttattacgaattactttgtacatagtttgttctcagccttttgaacagagaatctttttccatctttc

SEQ ID NO: 61150 - DNA, 363 bp, Triticum aestivum
  Clone ID: PAT_TA_61150
cttcttcacgggcttctggtccagcgccgtctttctcttgatcggtggacgcccgaggtcaggctggctgctgctttggaagtagacctcttcaagcttcttcaccgacctgtatgtacgacattttatataaacaaaacggagggagtatgaatgtattgcctcctccttaagttacttgtctctaaatttgtctagatacctatgtacttgacacaaaaacatgtctaggtacatttgtatctaacaaatgtaagacaagtaattcgggacggagttaatgtcatgtactaagagctacttcagcagagtcgacatatcagactgaacttcataataacagtctgcggggcattttctttt

SEQ ID NO: 61151 - DNA, 672 bp, Triticum aestivum
  Clone ID: PAT_TA_61151
gacctggtggtggtgaacccggtgctggtgcagggcccggcgctgcagccggcggtgaacgccagcctgacgcacgtgctcaagtacctggacggctccgccaagacgtacgccaacgccgtgcaggcgtacgtgcacgtccgtgacactgccgccgcgcacgtcctcgtcttcgagtcccccgccgccgccgggcgctacctctgcgtggccgacggcgctgtgctccaccgggaggacgtcgtcaccatcctccgcaagttcttccccgagtaccccatccccagcaggtgctctgacgaggtgaacccgaggaagcagccgtacaagatgtcgaaccagcggctccgtgagctgggcctcgagttcacgccggtggcgcagtgcctctacgacaccgtcgtcagcttccaggagaagggcgtcctcccggcccctcctgccccggcacagccggcgatgaaagagatcaactgagacagtagtagtagtccttttagtaactcagaagcatccatgcatgcagtactgtatatccatggatgggtgaaaatctgcagctatgtatcggcatgccattctgggtgtcagctagctgttgctcaaacagtttgaacttttactagcatgcagttcggaaaggttgtgcttactctccaaattaaaggaaaa

SEQ ID NO: 61152 - DNA, 224 bp, Triticum aestivum
  Clone ID: PAT_TA_61152
aattctaccatgagggatgcaaaactcagaaatgctagtgcctactttagtcaatatttctatgagaagttttggctgatcttgattcctgatcttgtggtttctctttttgagatgcacatttgtatagcaaagtagttgtacatgcagcatgcactttttaagtagcagctttgaactcttgatttttagctcatgagaagaaaaaggtcagtctttcatct

SEQ ID NO: 61153 - DNA, 562 bp, Triticum aestivum
  Clone ID: PAT_TA_61153
cgcctgcgtcgctagcggcggcgagtgccggtacagcagctccaccgcagaattcgcatgcctctgccggtctgccccggccggtggcatgctgcatgggccaacatgtgccggtggcgagaagagagggaagaagattatgctaataggtatgacatcagcagctgcaacctttctctttgcaagtctttatgtgctaataatgcatagaaagggaaagagactatggtttctcctttgcaagaagactagcagcaacattgaaaaaaattacgaggccatgatagtatcatatggatccctagctccaaaaagattcatgtattcagaggtaatgaagataacgtcttcacgcaataatcagcttggaaaaggtggttatggtgtgggttttcaaaggaagactacacgatggtcgtctggttgctgtaaaattcttgcatgactgcaaaggaaatggggacgagtttgtgaatgaggttatgagtattggcaggacctctcatgttaacgtagttagcttatttgggtttttgtttgaagggatcaaaacgagctctta

SEQ ID NO: 61154 - DNA, 545 bp, Triticum aestivum
  Clone ID: PAT_TA_61154
cccacgcgtccgcccacgcgtccgcccacgcgtccgcccacgcgtccgctcaaaacacgttatcagcgcacgcctctaccgggagcacgggccacctagtgaagaagaagagaagaataacggcgcatcctggacctcctacggcggcgccctccggcgcgacgtggcaaacggcgaagccatcgggcgcgaggcgtcaaggagcggccatggcctcctctcgaagcgcagcgcatggcccggcatcacagtcagcgaatggcgactacgccctctctctcaggtgcggcgcggaagtcggcggtctgcagcgcccttcggcgcgcgacgcaatctggcggctacatcaagcgcggatggatgggacgcggccaacggcccatgcgtgcagcggtgcccgacccggccttgcacccccacgcgcgtgcaagccctctggtcggtgcacggccctgaccttcagcagcggcggcggctggaaaagaaaaattccaccgacgaatctctgcacgaacggcgacgaggcacggttcctaaacgagcgc

SEQ ID NO: 61155 - DNA, 600 bp, Triticum aestivum
  Clone ID: PAT_TA_61155
attcttgagccatgctaccacggcagaagcatcaaagaagcgaacccacagaatagcaaattgcctacaagtttcaaagatcttggtacaactaacaagccctttccggtaagaacgagaatgctcgggcgtgcttggcctctgagagctcctgtaaaagccggacgcgttccattatggcaggaagttgcaagtggtgttccatgcatgagcgatgaagtggcaacggcatggctggacaatgatggcgtcagatctgcaatccatgcgcaatcagtaagctcaattgggccatggctcttatgcacggataaaattgatttcaaccatgatgctggcagtatgatcagttatcacaagaacctcacaagccagggttatcgtgccatcatattcagtggtgaccatgatatgtgtgtgccctacaccgggagtgaagcatggacaaaatctatggggtatggagttgttgactcatggcgaccatggttcacaaacgaccaagttttcgggtacaccgaaagctatgagcatggactcacttttgctactattaagggcgctggacacaccgttactgattacaaccacaggaagcat

SEQ ID NO: 61156 - DNA, 162 bp, Triticum aestivum
  Clone ID: PAT_TA_61156
agcatatatacatgtacaaactgtacaattgtacccctgcaagaggagtacgtacgcacatacaaacccagcacgaagactatacaaaaaaagggatatagttaggctaggatgcacacacaagaggagatgcttacaataacttttccatacacgttgtac

SEQ ID NO: 61157 - DNA, 273 bp, Triticum aestivum
  Clone ID: PAT_TA_61157
acccaccggccatggcgattcttgaagccacgctcgttctcctcctcctccttgtagcaccggcggccggctccgacgacgcgctcgccgcgtcctgctccggcgcgcgcagcttcgccgccgacagccccttcgccagcagcctgcgccagctgttctcgctcctcgagaccaaggcccgggccatcgggttcgacatcggcagctccggcggcgtgcacggcctggcgctctgccgcggggacgtcgccagggcgacgtgcgccgagtgca

SEQ ID NO: 61158 - DNA, 387 bp, Triticum aestivum
  Clone ID: PAT_TA_61158
cggacgcgtgggtaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaggggcgccctttttaaaggatccaattttacttacccttgcttgcaaagtaatagtttttttatagggccacctaaattaaattaattggccgtttttttaaaacgtcttgattggaaaaaccctggggttaccaaatttaatcgctttgaaaaaaatcccctttttcccagttgggttaaaaccaaaaaggcccccaccaatcgcctttccaaaaaattgcccacccttaatgtgaaagggaaccccc

SEQ ID NO: 61159 - DNA, 660 bp, Triticum aestivum
  Clone ID: PAT_TA_61159
ctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttccctttgtccccatctctgggttcgagggtgacaacatgattga

SEQ ID NO: 61160 - DNA, 622 bp, Triticum aestivum
  unsure (1)..(622): unsure at all n locations
  Clone ID: PAT_TA_61160
aaagctagctagacgcttagacaacatccatttctccgatagaaaaaaatggcctctttgtctaccccctgcttccttctcttcactgctattcttgcattagtctcatggcaggctttagcttctgatcctggtcctctccaagacttttgtgtcgcggacaatagctcgcgtgtacttgttaacggatttgtctgtaaggacccaaaagctgtgacggcggaggacttcttcctggcggccaaactcgacatgccgagagacacaaagatgagcaaggttgggtccaacgtgaccttgattaacgtcatgaagattgctggcctcaacacgcttggcatctccctcgcacgcatcgactacgcacccctaggcgagaaccctccgcacacacaccctcgtgccactgagatcctcaccgtgcttgagggtacgctctacgttggctttgtcacgtncaacccagaaaacaagctcttctccaaggagctcaggaagggtgatgtggttgttttcccacaaggactcatccactttcagttttatcccaacccctacaagccggggggtcgcaattgccgcacttagcagccagaacccggggcaattaccattgccaacg

SEQ ID NO: 61161 - DNA, 626 bp, Triticum aestivum
  Clone ID: PAT_TA_61161
gcgccatggaaaggggaatatttgtgtcctgctcggccgggaatgccgggccgggcgcggcgtcgctgacgaacggcgcgccatggatcaccaccgtgggcgcggggacgctcgaccgcgacttccccgcctacgtcaccctcggcaacggtaacaagtacaacggcgtctccctgtacaacggcaagcaattgcccaccacgccggtgccgttcatctacgcagggaacgcgtcgaacagcagcatgggcgcgctctgcatgacgggcaccctcatccctgccaaggtcgccggcaagatcgtcctctgcgaccgcggcaccaacgccagggtccagaagggattcgtcgtcagagatgccggtggtgccggcatggtgctcgccaacaccgccgccaacggcgaggagctggtcgccgacgcgcacattctcccgggcgccggcgtcggagagagggccggcaacgccatgagaacctacgcgtcgtccgatccaaagccgacggccaacatagtgttcgctggcacgaaggtttggatccagccgtcgcccgtcgtggccgccttctcgtcgagggggccgaacaccgtgacgccgggcatcctcaagccggacctgatcgcg

SEQ ID NO: 61162 - DNA, 190 bp, Triticum aestivum
  Clone ID: PAT_TA_61162
ggagagccttgccagttcccataatgcggcacagagtgcacaggcaagaacaaagctcatggcaaggcgcatggtggaggcaagcgctgcactttcttgggctgtaccaacaggagctgaaggcactaccccttactgcatgggccacggaggaggtaaaccctgcttatttgaggaccaatggagtgtg

SEQ ID NO: 61163 - DNA, 458 bp, Triticum aestivum
  Clone ID: PAT_TA_61163
gtagttacattcgacacaacctaccgtaccaacctgtacgacattccctttggtttatttgttggggttaacaaccatttctagagcatcattctagcaggtgtgcttgttaggcaagagacagatagaaacatttgaatgggttttctcggagtttgttagataatgggtggtagggcgccagaaacaattctgactgaccaaaacagagcaatggagattgcaataaggaatgtgatgccagacacagctcaccgctggtgcaaatggcatgttcttaagaaggcaaaggagtcgcttgggccattgtactaaaaaaaacagtgatttccgaccagagttccacaagggtgtcaaccacatgctaaccatagatgagtttgaagaagggtggaagtaccttgttgataagtacaacttgaaaagtcacgattacatgactaatttgtacgagatac

SEQ ID NO: 61164 - DNA, 718 bp, Triticum aestivum
  unsure (1)..(718): unsure at all n locations
  Clone ID: PAT_TA_61164
gcccactttttccgtcttaataagcagttgatatgaggaagctgcatccttgtactgcaccaaatctaggggacatgtgctgagtggacgaagaatatgtgattcctatgaagatgaatctgatttactgccggcatagctaatgtcggcgctgaacaacttgggggaggattatagttcactggcacgggcccgcgcgggggcagggctaggtgcttatcagcgtgaatggagtgcatgatccacatatatgggtagttccctcagtcgagatactacatctgcggagatatatattgttcaaggtacacaagctgaactggatccggatgatgctggccaatattgtgcactggaaaatgcgcagactgaagcacactcagatgataatgatgccatgacctgtcgatgtaacaattgttgacattaggaccagtcttgtttggtactatctacagagtctaatactgtacgtgattctgagactgctcttgatgatgttcgcaataaaagatgctgcggatacctataatctgatcctgctgattatgtagatggtgccatgcttaacctggacatcaatggngagggtgatactgaactctgatactcatgactgcactcgcgaatttgccctacattctggatacatatggaagcggagatggagccgatgactgactccacagttctgaaatctgaacctgaccctgatgac

SEQ ID NO: 61165 - DNA, 412 bp, Triticum aestivum
  unsure (1)..(412): unsure at all n locations
  Clone ID: PAT_TA_61165
ccgcgacggcggcggtcgctcgctcggaaacatgatccggtcccgctccgagaagttcctctacaacctcgggctcatcaggtcatgctcttagagcggcatggacctacctaccacctagctccggtcgatcagctcatcaggtcgtgctcttagaggagcatggatggacctacctagctcaggtttgcagcgctgtagtacgtagtagctacttgctagctaagctaagtacgtagctaggctagggcgcggcgcctttgtcaacgatccttgtcaagttcttgggtgaaaaggaacgtgcatgtttcgtcctcaatctgtagcagtgtaaatattctcaatcttgtcggtggtcttcaaaaaaaaaanaaaanaaaaaanaaaaaaaaaaaaaaaaaaaaaaanaaaa

SEQ ID NO: 61166 - DNA, 99 bp, Triticum aestivum
  Clone ID: PAT_TA_61166
cttccttgtttgtcctcgtagatgcatgcttaggtcaaaccgtgtgtttctcttctgtatgtgcttcaagaatcttgcattaattaagatggtaccatc

SEQ ID NO: 61167 - DNA, 486 bp, Triticum aestivum
  Clone ID: PAT_TA_61167
ccccgcgtccgaatgaagatgtggtgtcgttaatcttgtgaacatatatggcctggttgggcagactcagtttgatgagcaggtgaggaagagaatagtatacatatatggtggcttttactgttctgaaatggaacttaataggccaagcagctgtatacagtgtgagcacatagtgtcgtagatattcagagggtcactgaggatcatatgacaccatggtctcttgagacatggaattcttggcgtagcggggcatctcgccgtatcccaatttgctctctgggttcaccaaatgaagttggtctctggattattgattggaaggaaacaggaagctagtaattcaggttgttggaaggttctgaaactgcaactgaatacgctgtgctctgcttcacttcagttttccttttttctgacaggagcttcagttcagttcatcaagtctgagacgagtctgtcacttacggatctgttttggag

SEQ ID NO: 61168 - DNA, 386 bp, Triticum aestivum
  Clone ID: PAT_TA_61168
cggtgaggaagtgtaaaaaaggatcttttgttaccctcaactgtatcatactgcggtaggtgtagtctacgctgtgtagcaacagggtttggtagtctgtactgtgcgcgtgtagcgtgttatgtagcggcaatggcgaacaggaagtgtagtgatagtcgtgcaggcgcgacagtgcaggcacaatgtcgtgcctgcgatgaaagtgtcatggaggtccctgagaggatatcatgacaataacatgttgtcatgagggtctgcggcgcctagctgccaatgttaaaactcctggctttgttatgcatgccggaggaaacaaatgcttttgaacttcccgtggttccaaattctctgtttgtttaaacatgtgaattttccagttc

SEQ ID NO: 61169 - DNA, 633 bp, Triticum aestivum
  unsure (1)..(633): unsure at all n locations
  Clone ID: PAT_TA_61169
gggggaatggggctgggtgtggcagcctgctcagggcagtggttctggccgacggttccaggtgatacccagtggcgaatgaccaagtggccaaatgctgcaccagtgctgcctctactaccattatctgcccaggaccagaaaatggataatccagagaatgtgggccatatggtagggaaggagtttgggatgttctttgctcatgccacggcctttgtcctcctattcttacagtgtggaactccagagtatattgatcagcctcattagagatacgaagaggcaatggatagttaactgtagagtcatgctattttctcccattgccgaggcacaactgagaggagtttcgatgttccaatgctggcaagatttaagttgaaggctgcggctacgagcttgtgggctgattcgcaatgcgttccagtttgatcaaattctccaaaagttgcactgatgagccaatgcattgctgagtgaatctttttgtaattttctgttgcttaggtctacttactgaatcagtgaatcttattgattcatgttgctcatgacttnncttgtaaaaaattaacatactatagcatcttacccggatcttttttttatcaaaaaaaaaaaaaagggcgg

SEQ ID NO: 61170 - DNA, 655 bp, Triticum aestivum
  Clone ID: PAT_TA_61170
cccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggaccaaattttactaccgggggctgggaaggtaaaattttttttttggggcccccaaaattaatttaaggggccgggttttaaaaagggggggatgggaaaaacctgggggtaaccaaattaaatggcttggaaaaaaatccccttttccccagtgggggaaaaaaaaaaaaggcccgcacggatcgcctttccaaaaatttgcccaccttaaagggaaaagggaaccccccttttaggggcccttaaagcggggggggggggggggttaccccaagggggaccgttacttttgcaagggccttagggcccgctcttttggtttttttccttttttttttggcaaggttggggggttttccccgaaaagttttaaatggggggtcccttttagggtcccaatttagggttttacggcccctccccccaaaaaaatttgattagggggagggttcacgaagggggccttccccttgaaaaagggtttttc

SEQ ID NO: 61171 - DNA, 577 bp, Triticum aestivum
  unsure (1)..(577): unsure at all n locations
  Clone ID: PAT_TA_61171
tggtgcgcttccatccagtaatttgctctcgccatcattgtcgtttttgtggtgggatattctgtggcggctgttcaaagggtagaagcttgatgcctccaaaattcggaacttcagatcctcaaagggtctgtgatgtttgtggagtacgtcttgagtgtattcagccttacttgatgaaccagataagtcgtgcttgtcaacttccgactaaagatttgacagacctgagcaccttgaggtcatggttaaacctcccatgggcaccaacgatggagtatgagatatacaaggctgcgaattccatacatgggtattgtaaggttggaaagctgaatccacagaagtccattcctgattcaattcttatacaagcaaagggacttgctataattactgtggtaaaggttggaatgatggtcacgtacaaaattggtactgggctggttattgctcgcagagctgatgggtcttggtctcctccttcggccatatctacttgtgggggtggatatggagctcangctggcgctgagttagctgacttcatcattggtctgaggaacactgatgcaat

SEQ ID NO: 61172 - DNA, 676 bp, Triticum aestivum
  unsure (1)..(676): unsure at all n locations
  Clone ID: PAT_TA_61172
tgctaatttatgtgcctattatcttaagctgaagcaatcactcaatttctttgtcgaaattctaggtggtctttctattgctcttctcgctagtatagtcaagctttggctagagtgtcagcagtcagtcagtgattgatgtttagtggattgttcaagacaccgactttaacttaacatctacctttactgagagttgtgtaattagtatttcactcatgctaactaggtgtgataaaaaattgaattaactgcatgtccttgttgtaagctgcggaaatatcaattggaagccctcaattcaatgccaattttgtgcactttgcataataggtctcaataatcctcccaaaaataccaacgtgtagatgagaaaaggatttataattttacactgaaaagtttcatccaagttgcttggtatcgcagcatgagctgcatctttgcaccacccatctttatatctctgattcacacatttagacgagagnggggggttgcactagatgcattcctttctgagatgattgtattcgagcagttaaaaaacatgtccacgttgtaagagggaaaatttaagtgcaaactcccgtatgatgtataattgtactctcagcatgtaagcatctcaataatcctcctaaaaagtaggtaaggtatagatgaaagggggatt

SEQ ID NO: 61173 - DNA, 526 bp, Triticum aestivum
  Clone ID: PAT_TA_61173
acactccacgctcgcccaggaaaaccagcggcaagaagcaagttcagttgaggttggaggtcgagtgggatcggatggcgtcggcgccggtggagttcctgggcgcgcgggagggcggggtcggcggggacgcgctctactgcgccatcatcctgtggctgtccgtcatgtcgtggatcatcttcacctgcgtcggcggcgacgacggcggcaggcgccggaggggccgccgggacaccaaggtcttcgtcggcgccgagcgcctctgcgacggcaccgggccccactgcagcggcgggtacggcctctgcggctcctgcgtcgactagcctggccctccaaatcgttcgtttgattggtttgtaatcgagagccgaaagtactagtagtatcatctatctatggtgtgatgcgatgaagaactcctctcctcttcttctccggggagctccgttcttgtagcctgtacatagtttcagcgatcgatgatgatcgacaagatgagcaagtatgatctggtagtagc

SEQ ID NO: 61174 - DNA, 256 bp, Triticum aestivum
  Clone ID: PAT_TA_61174
ccctctcggcgcgtttttgccaaagccttgctcgaattcctctcctgccctctcatcttgttgctcttcccgcccaccctactctgctcccctgtttctcgttcgttctctctgtcaagtactgcgagtcctgtcccgacttccaaccgctgcccccctcgccttccctccttcccgcacagccgcctctcctgcgggccgtggactcctcctcccgcggcgccacttatgaccgtgcctccttcctccgccccac

SEQ ID NO: 61175 - DNA, 631 bp, Triticum aestivum
  Clone ID: PAT_TA_61175
cccacgcgtccgcatcatgttcggacgccacaccgagaagcaaaagctcctgaacttcatgttgcagcacagttcaagctcgcctggtggaacgccggctgttctcccgatcatcggtgctcccgcggtcgggaagaggactctggtggcccatgtatgcaaggacgagagggtcagctcacatttctcctcgattctgcacctgaatggagactccttccgcagaatcgcagaccatgaccggagcttcttgcgagggaagatagtggtcgttcttgagcttgtcgcagacgtcgacgagaaggattgggccgagttctgctcaaccttggcaagcatggatagtggaagcaaggtgatcatcatcagccggcttagaagtacagagcgattcgggacagtgcggccgatcttccttaacaccctgtcatacgaggagttcagctacctcttcaagacactcgcattcgggagcgcgaacccggcgcatcacccgcagctggcacggattgcagatgaattggccgaggagttccgcacggaatgtacgctcgtcggcacaaacatattcgcggatgtgatgaggaggaatctgaacgtccatttctggctcggcatgatgagcaggctg

SEQ ID NO: 61176 - DNA, 612 bp, Triticum aestivum
  Clone ID: PAT_TA_61176
cccgtcacctctgtcctcccctccacatctctcccggcgcgtggtcggtcgggggctgccattggcctccgccgccaccgcccggaccacgtacgtcggccgatcgcccgatcaactaaccagcctgcagacccctacgcgcgcacggtgtacgtgtccccatctccgaaaatgcaccggtggctcatcgggggctgcggcgacatgcgcccgccccgccgccgcatccaagaaccgcaagtccaagaggagcctcggccgcgtcggcgcacgtcgtccccgccgaagctgaggaagacgagctcggagccgattatgctctccctgcccaaggacctggcggagtttcgagcgatgtctgtgtacgggaacctcaagctcttcacgtacgaccagctccggcaggccaccggcgacttcagccccacccagatcatcggggagggcggcttcggcgtggtctacaagggtgtcgttggcgctatggtggtcgccgtcaagcggctcaacccggagggcattcagggcgaccgggagtggctgacagaggtgagttgcctaaggcagtacagccacccgaacctggtggagctcatcggctactgctacgac

SEQ ID NO: 61177 - DNA, 687 bp, Triticum aestivum
  Clone ID: PAT_TA_61177
caactctgcagtctgtaactatagtcaagatgacggaagtcagcaacatttctgatctacctaccaaggtgccaacagagacgccgtcacctccaaacgagttggatgctggtggccactcagatgccgaggacgctgattcatcctttcagtcggatgcgtcaagttcgacagcatcagtctctgagagcattcttgaatatcgccgaattcatggacgaacatatcacagcgaaaaatacagaagtgaacaggtgttccccaacgacgaacagcagatggaatgtgttgatctatctcaccactaccttttgcttctactggacagcaaactatttctggctccaattaaagacaacgttcagaacgttcttgacgttggaacaggaagtggcatctgggcgatggactttggcgatcaattcccaagtgccgaggtgattggcaccgatctttcaccctgccagccccaatgggttcctcccaacgtccgcttcgaaatagaagacgccagccaaacttggacctgggaagacaaccacttcgactttattcacattcgctatctatttcgcgcactcacggactggaaccatgtatttgaacagcctaccgttgttgcgcacctggaggctgggtcgagtctgtcgaggccgacgtacggctttgcagtgatgatggcacttt

SEQ ID NO: 61178 - DNA, 244 bp, Triticum aestivum
  Clone ID: PAT_TA_61178
taagacgtcgtttgcctgcaagggcgaagcgcttgcttactgctgtcgcgtggccgtggaagtttgctatttgtcgatggacgagtgcatgaaggagtgcgtcaagaaaatggggccgccgccggcggccgggggcggtggtggcaacgcctctccgatagcttagctaccttgttcttcaagaaaaaatgtataatccaccgaggatggatgtttttgaaataagatacgagtatcgaccccc

SEQ ID NO: 61179 - DNA, 267 bp, Triticum aestivum
  unsure (1)..(267): unsure at all n locations
  Clone ID: PAT_TA_61179
cccacgtgtccggcgcgcgagcgagagggacgacgccatcaacagcaaccccaaccccaagcggcgcgagaacccacccccatcctccccccgatccccaattcgcctcaccatggaccaccaccaccagcaggggcagccgccgtcgccggcggacgccaactcgaagccgccgacgcggtttgcacgcccgcctcgcgccacggntctggctcggcgccctcctggccgccctcctccaccgagggcgccccggcgcgcgggccg

SEQ ID NO: 61180 - DNA, 709 bp, Triticum aestivum
  unsure (1)..(709): unsure at all n locations
  Clone ID: PAT_TA_61180
cgccagacagggggagcgacgaacgaggaggagcggcgcctttggcggtgtcccggcgaacggtcctacctgccgtccttccttgctccgagcgtgacttcacatccccttgccgaggtcacaccagcctccgggcggcgccagaccaggcgttggtgcgccgccgccggatctgacctcgctagggaaggcattccaaggtacaaggttcgctcgctggtggaggtacgccgggtcgccgtggccgtgagcgcgtcctcacgggtggcggagggcgttcggggagcggaccgcagatgagatcaaagaggcctccttgctgtcgtttgatttgagcaggttattccggggagttaaattccactgctgatttttcgtaataaaagagctctttcacgagctagcgtttcagaaggatgcttcaagcttcccctcagtccccaataatgatgagcggcgtctcgtttgttgtctcgcggggtgtctgtcgcagccgcctaagtcattcctatgaaatggaggtgcagccagaagccgtcagggactggtccgatctgcctcttgatgtgcttgctttggtctttgccaaactcggcgcagttgatattctcatgngtgcaggcctttgtgtgccactcatggctcgaggcggcaaaagtacctagnttatggcgatatgtcgacatggagccccatgatgtcttgcgag

SEQ ID NO: 61181 - DNA, 766 bp, Triticum aestivum
  unsure (1)..(766): unsure at all n locations
  Clone ID: PAT_TA_61181
ggcaaatcttgctgcggccttctcctccaacctctccggcgcatcacctccgccttctcctcgttctactgttcccaaagggatggatccacctgcccgcgaaatgactgacagtatgccagtggtgaagatggcggcgccggcggcagggacggagcaggtgaaaggcgaggcgcacggtgacaagcttcctatgtccggaaagaagaggacacgggaggaggtgactggaacagacgggcttggctgcgctgccccggtgtctgacccgcatgccccgccgtcgccgccgacctttgacccgcggtcaccgccctcgcccgtatccgagacacacgacggagacagcgccgactggaaggccgcgcggaaggtcctagagagcatcatcacgccgtcgcgggagcgccaattagccgcgtcgaagccctccgacgtcgtggcgtcgagctacatagcaatgctgcaggcggcgaactacgcgaccttctccatgacctgcgcgctggagctggatgagaagctggtggcgctagagcgcgacaacctggcgctgtgggagcagctggagaaggagaaagcggcgaggcaggtcgccgaggcggagctggagagggcaaagcgggcagctgaggcggagcgagagcgcgccaaggcgacggcggtggngtacacgccggcgggtggcggaggagtacacgcgggcgggtggcggagcaagcgctgnncgncgtacttgcgcggcgcccgagaaatgaagcgactc

SEQ ID NO: 61182 - DNA, 530 bp, Triticum aestivum
  Clone ID: PAT_TA_61182
gcagcagggcaacgccatttgtacatgtgcacccaccaaattgtgaatagacatgaataacacatgtgtactttcaaactatccaacaatatgtcaatatccaaaaaaaaaaaaaaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaaaaagggcggccgtttaaaaaaatcaaagttaacaaacccgggcatgcaaagtaaaaattttttaaaagggccaccaaaattaaattaacgggccggggtttaaaaacgcggaaactggaaaaaccctggggtaaccaaattaaaacgctttgaaaaaaatccccttttccccagttggggaaaaagaaaaaaggccccaaccaaacccccttccaaaaatttgccaaccctaaatggaaaatgaaaccccccctttaccggcccataaaccccggggggggggggggttacccccaggggaaccgttaaatttgc

SEQ ID NO: 61183 - DNA, 539 bp, Triticum aestivum
  Clone ID: PAT_TA_61183
cggacgcgtgggccggtggtttccggcgagctcctcgcgacagggacggcggctgctgtgccgcgactgctgcagcacggcggcgaagcttcacgggcccacgcagggcctggccggacagggggtctggtgtgcctctgctgctatgcccggtctgctaccgcctaagccggtggaggttgtgccctccctcatggctgcggtgctgccggtccttgtcttcgggtgtctcgtttggatccggccggcctcgcttcgttggccgtggtgagacgacggcggtgtcctcgtgactgttggcgcatgttggtgggcggcgggtgtggtggagcccaaggttggtcctgggtggtgggcgcgagaggtcgggagaaatccatgtcgggtcttgccggcaccaacgcggtgacgcctgcgggcgccaccatccttcttgaagggcgtcgggtgaccctctcccccctctaccctccgtgtaccaggagaaatcctaggtctcgtccgggcagcagcgtcgtcatcgtcgcattccttcttga

SEQ ID NO: 61184 - DNA, 384 bp, Triticum aestivum
  Clone ID: PAT_TA_61184
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaaaaaaccaagtttacaaacccgggcatgcaaaaaaaaaattttttaaaagggcccccaaaaataaattcacgggccggggttttaaaacgggggaaatggaaaaaaccgggggttaccaaattaaaacgctttgaaaaaaatcccccttttgcaagggggggaaaaaaaaaaaaggcccccaccgatcccccttcccaaaaattgcccaccctaaaaggaaaaaggaaccccccct

SEQ ID NO: 61185 - DNA, 233 bp, Triticum aestivum
  Clone ID: PAT_TA_61185
ctcgcaaccaggcgcctgcagccctgttcgcccccgtccttcgcgtctctccaagtcggctgcaagggccgtcgccgccgcgcccgccggtggtctccgcttcggccagacggcttgactgcactccggccatttctggccaaaccgtgctgcgatcgaaggtgctgctgccgatgcccgtggggcagacgaggctctcggcgctgagtaagcagcgcggatgactccaaagc

SEQ ID NO: 61186 - DNA, 587 bp, Triticum aestivum
  unsure (1)..(587): unsure at all n locations
  Clone ID: PAT_TA_61186
cctcacactcgagcaacccaaaagcatcctcagcaacaagaacctcctagccggccaagaaacagagcttccgttggacagcaagatgtgtccgatcaagagggagatgagcggggagtcgggctcgccgtcgccgtgcagcggggagaacttctgctcgccctcggcgtcgccggagcgccagcaggcgaggcaggcggggtggacgtcggcgccggcgaagcggccggcggggcggaccaagttcagggagacgcggcacccggtgtaccgcggcgtgcggcgcaggggcaatgccgggcggtgggtgtgcgaggtgcgcgtgcccggcaggcgcgggagcaggctctggctcggcaccttcgacaccgccgaggccgccgcgcgcgccaacgacgccgtnatgctcatgctcgccgccggaggcgccgcctgcctcaacttcgccgactcggncgagctgctctccgtgccggtggcctcctcctaccgcagcctggacgaagtccgccacgccgtcgtggaggccgtggaggacttgctgcggcgcgaggcgctcgccgaggaggacgcgctctcgggcacct

SEQ ID NO: 61187 - DNA, 677 bp, Triticum aestivum
  unsure (1)..(677): unsure at all n locations
  Clone ID: PAT_TA_61187
gcaagaccttgggaaagtcgacccgagaggtccctgcctgtacgtagaaggctaagaagggggaccccgctggcaacgtagccgagaacagtaggctcgcacggtctgtccgatcctggactcctcgctccaccctacagcccggtactggagctcatcctcctcgctggccgctgccgcggcaagcgtgtcatcctcctgaggtccgtcgaccagggcgtcctcttggtcaccggccccttcaagatcaacgggggccctgtgggacgagtcagctgcggatacgtcgtcgcnacctcattacgaggatcgacatgcttcggcctcgacgagagagagattgaggagaactgctcatccaaggacttgacggacggaaaggcctaggagaaggctggtgaggaggctttcttcaggagggagagaagccccagaagaaggagggcagcggcggccgtgccgccgaccaaaaggctatcgagaaggctcggattggcaacatcaagaagggcgatatgcttggcctcttacatctgcagcttttttaagattggaggaaggggggcaagccccacgagggggcccaggaaaatgagcaatccttgggggccgagggtgaagggagtcgcgggggtggcacacagagggtgaaaaaaggcaagggtctccgaaagggc

SEQ ID NO: 61188 - DNA, 478 bp, Triticum aestivum
  unsure (1)..(478): unsure at all n locations
  Clone ID: PAT_TA_61188
cggacgcgtgggctccaatcgcaccgcaaacccaacacttgcctccctcctcgacccacgcgcagcgcaggcagatctcatccaaggtacaagatggctctcaccagaatcggtcttgccggcctcgccgtcatggggcagaacctcgccctcaacattgcggagaaaggcttccccatctctgtgtacaaccggaccacctccaaagtcgatgagaccgtccagcgcgccaagctagaaggaaaccttcccctctacggtttccatgaccctgcgtccttcgtcaactccattcagaagccacgtgtcgtcatcatgcttgtcaaggccggcgctccggttgaccagaccatcgcgacgctcgcggcgcacctggagcagggcgactgcatcgttgacggaggaaacgagtggtatgagaacacggaaaggagggagaaggccatggaggagcgtgngctcctctacctcgggatgg

SEQ ID NO: 61189 - DNA, 487 bp, Triticum aestivum
  Clone ID: PAT_TA_61189
ggctccgagatggacgcgctgctcaggcggcagcaggagctcgtgattcagcttcgagcgctcatccttccggcacttcgcgacgctgacagcaggtcagccgacctcgccgtcgacctattcgatggcgtgatcgactgcatcaccggcgtcatatccaagctccagagtatcaccacggcaggcgtggaaccagcgacggccttcatcctcggcaacggtatctccaacggcgcgggcgagggacaagaggagaagcctgtgatcagcaacgctggtcagaagagaaggaggaacaacgaaaagcgatcaagatcacttgtgacaattggtccacattatgatggccatcattggagaaaatatgggcagaagaacatcaacgggaggcaacatgctaggagctactacagatgcgcctacagagaacggaactggtcagcaaccaagacaatccaacaacaggatcataatggaactattaact

SEQ ID NO: 61190 - DNA, 574 bp, Triticum aestivum
  Clone ID: PAT_TA_61190
gagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggat

SEQ ID NO: 61191 - DNA, 571 bp, Triticum aestivum
  unsure (1)..(571): unsure at all n locations
  Clone ID: PAT_TA_61191
agcctcctagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtanttctgtatgcccctgtcgcgtgtgttcgaccagtactgtccttcctcgtgcctccacttctaatgaatatatgggcgcctcaac

SEQ ID NO: 61192 - DNA, 635 bp, Triticum aestivum
  unsure (1)..(635): unsure at all n locations
  Clone ID: PAT_TA_61192
acaagcattctatcctcgctcctgcatcgagcgaagcgagagctttggacgaacaggtatcaaggagcatgaaggacgacaagatgagagagatcctcatgctcgcgcacaggatggtcgtggcagtgatctcacacatgaacgccgactattttcacaggtgctaaactgctgcacgtccttctgcgcagaagaagattagggatgatgacgaccccaagtgacgcaaggtgctgatagcagcgtcctgtagcagctacgagtcccagagatgcggcgctgcatgcatacgataggcatcgatgacggaactggagaggacaccagcattaagtacagcgcgggtgatgccagcgtgaatgacaagatctagccgatgtggaggctctaattacataacacccgtcgtctgattttatgtcgtgtgacagcaatgacaaaagcgtgtaccagagggacgagatgacnttcatcggatgctgtatgaggataagctgcgtgatgctgtgctgctgatgtatgccaactagcatgatcttactaatgccgtgaacgctgctgaaatcactgacaagcttggcctgcattctctgcgccagcgacactggtacatacagagcacatgtgctacctct

SEQ ID NO: 61193 - DNA, 126 bp, Triticum aestivum
  Clone ID: PAT_TA_61193
cccacgcgtccgatggttagactttaaacatcagtaagatttttgatctcataaagattttctgttcaaaacttctcagcttatgtgatagatgtgcaatggatgaattgctctttggtttgattc

SEQ ID NO: 61194 - DNA, 621 bp, Triticum aestivum
  unsure (1)..(621): unsure at all n locations
  Clone ID: PAT_TA_61194
taaatagccctcaaagaattcttgatcttggctgtggcacaggtatctggtccatcgagatggctgaggagtttccatctgctgaggtcattggcactgatgttgcaccaacacaacctggatgggttcccccaaactgtcacttcgaggtcgatgatatcgagagaatatggacatggcgagaagagagctttgactttatcttctcccgagatctcctgctcgcaattcgagattggccagcattgatcgaccaaacttacacacacctccaacccggaggctgggtggagtttcaggccatcgttggcgttcttgggtgcgatgacgactcaatccctgaagacagctacctacgcaaattctccaccatgatnggagcagggttcttccaagttcggcgcctgtcttacagaccccatgaagtggnaaaggggtgtttcgaggagcgcggctacaccaatgttacagaacgagttntttaagcttcccttcaacccatggcccaaagatccacgcatgaagctactaggagcatgggagatgggagaatctcctgcagggacttgaggcgatggtactanngatgttccaaaagggacttggctggacggatgctga

SEQ ID NO: 61195 - DNA, 752 bp, Triticum aestivum
  unsure (1)..(752): unsure at all n locations
  Clone ID: PAT_TA_61195
gggctctacgtcgacagcgacctctacgacctcccgtcggcgcccctgcggcgcctcgcggatggggagccggcccggccgggcgtggccctcgccggcgcgaagancgatgactctctccacctctcaatatccaattgaggataaaatatgagatcgttcattgcttagtacttttagaggggggtgggcctttttctttacttattagatgatatccattctactctgcattggtctgcagaatatcctgcttctttttgtacacaatattcttgttctttatgtgcttaatgatctctattatgagtagtgctagactatactctgagaggcctcaggttattctttttttcccttctctgatttctcttacccttcaactgtgnataattattattgttaatttttgatgctttattattttgtagctgttcatccctttacttatatattattaatgtcttgaatggtttttaggtgtcttttttgggtaatttcttttttgattttgttatattatttttgtaagtttagaagttaaataatctaaatttttaaaaggtaagaatgttaattatttttgtttttaagtgagggaattttccttagttttgtgttttttttttttgaattcttttgtttttttttcgttncttttcattttcttgtttcgttttcggttttgttttttttttttttttttgtttttagttgatttttttttggttgtttatttttttttttttttt

SEQ ID NO: 61196 - DNA, 697 bp, Triticum aestivum
  unsure (1)..(697): unsure at all n locations
  Clone ID: PAT_TA_61196
ggttcatctcgaccttaagcctgaaaatatattgatggacgctactatgatcccaaaattcgctgattttggtttatcgaggatctttggtgagcagcaaacacgaattgtcactgataatcgtgcgggaacatgtggatatatggcaccagaatacttaatccgaggtgtagtctcaaacaaggcagatatatttagtctgggtgtcatactcatagagataataacaggtgacagggactatccatatttccaccatgacagttcccagcgtgatgccacaactttccagcagtttacagagaaagttcttgaaaattggaggaatagattcacatccacaccgaagtatacaaaggaaaaatatgcgcaccaagtaaagcagtgtgtcaccatagccctaaaatgtgtggatcctagtatggagaaaagacctactgcaaagcatataatccaggtgtttaatgtagcagaccagatggaaactcacgaagagttgccgtcagtcgtgcagtgcgtagacaagttactcgcactaaacactactggaagcaaggatctcacgcccatgagtgccactgaagaaatgggtgatcatcaaagcagctactggaaaaagagttggatgaggccaagtctgaggggtttggttaccgatgcctnacatagagccgagcaccatcagacagagttatca

SEQ ID NO: 61197 - DNA, 664 bp, Triticum aestivum
  unsure (1)..(664): unsure at all n locations
  Clone ID: PAT_TA_61197
attcttgggattgcaagggaattttgtatcttcacgaggattcaagcatgaggatcatccaccgggacctgaaacctaacaacattctcgttgacgacggcatgaatccgaaaatcgcagactttggacttgcaaggctgctaggagaaggtcatactcatactaagacagctagagctgttggaacactaggttacatggcacccgagtatgcaatacacggacgcgtgtcgcccaagatcgatattttcagcttcggtgtcttggtcctcgaaattgttactgggagacggaacagcagttctgatgatcgcgatgaagtgaatcttattagtgatgtgtggaactgctggaccaaagggacgatatcgcagatgatagaaccgatcgctggatgaacacgctcgaagccaggctttacgatgtatccacatcgggttgatgtgcgtccagtcggaccctatcgacaggccttacatatcatccgtcattttcatgttaaccagggacaacacggagattcaagcacccgcgcaacctgcattcttctttgggagagaagcggctntagcttctccggctatgaccgatctgatttcatcctggacaggatgtctctgtgaatgcggttacaatactggagccgtatcctaggtaggaatga

SEQ ID NO: 61198 - DNA, 118 bp, Triticum aestivum
  Clone ID: PAT_TA_61198
gtacggtataggatccccgaagagaaaacgaaggggtagaatgtgtacataggtacaaattcgcgtcaaatggcgaaggatgtaaacatcaaattgaaaccagttctgtgatggtccc

SEQ ID NO: 61199 - DNA, 670 bp, Triticum aestivum
  unsure (1)..(670): unsure at all n locations
  Clone ID: PAT_TA_61199
ccccgcgtccgcccacgcgtccgtgccaccttgaagacaggacaggacacggcatggtgaaagccatggagatggaggccgggcggcagagcgaggtgaggtgcgtcgacttgtgggccaacgagttcggcatgcgggtgcggatcgcgctgcgtgagctaggcgtgccgttcgagtacgcggaggaggacctccgcgtccgcgagaggagcgagctggtgcggcgcatgaaccctgctctccacatggtacccatcctgatccaccacggccgtccagtctgcggctccgtcaacatcgtcgactacatcgacgaggtctggggcgaggaaacccgtctgctccccggcgacccagccgacagggctgacgctaggttctgggccgnacttcgttgaccacaaggtgnttcggcgcccaagntaagggtttcttggagagcaaggggcgaggagaaangatgagtttgggtgggagcaanctcaaacgcctagnnaggagnngtgctcggggacaanngtgcttcttttctggcgacgaatttcggggttcttagacatcgttactatcccattttcaagcatgtttcatggggtacgagcagcttggcaggttcgaccttgacgttggtgtgccccaagctgacgcagtgggcaaaagaggtgcaagc

SEQ ID NO: 61200 - DNA, 667 bp, Triticum aestivum
  unsure (1)..(667): unsure at all n locations
  Clone ID: PAT_TA_61200
cccacgcgtccggcaaaccgcacgatcgatctctcgagtctgtcatccatcgtcggcgtcgcacgcacgcaagagaaacccacaaaattcaccagccaactgtggcagtgcggtcaagctaggtagcaggtagccatggcggctcggcgtagtggtgcggtggtggcggcgttgatggccgtgctggtcgggctcgcgggcgcggacttcgcggcggaccgggcggagtgcgcggacaagctgatggggctggcgacgtgcctcacgtacgtgcagctggcggcacggnncgcggtcgcccacgccggactgctgctccgggttccggcaggtgctgggcgccagcaagaagtgcctgtgcgtgctggtcaaggaccgcgacgagcccaccctcgggatcaagttcaacgtcacccgcgccatgaacctcccctccgcctgcaacatcccggccaccttctccgactgcccaaagatcctcaacatgtcgccggactccaaggaggccgagatcttcaagcagtacgggatcgagcacgagggcaagaacgccaccgccgccggcgcctccaccaccggtacctccggcgggaagagcgccgacgcggcggccggcgcagggaggcacgcgggggccttcgccggcgncggntcggcgctgctcgcc

SEQ ID NO: 61201 - DNA, 764 bp, Triticum aestivum
  unsure (1)..(764): unsure at all n locations
  Clone ID: PAT_TA_61201
gcatggtccagctggattgacattttgagggtgattcaaaacacatctgcagtttggtcatgcatcttgtgggcacatgttcatacaacaaattcagttatagacaaaaatagtctctccctactggattacttgctgcaatattgtgatgctagacaggtgcatctgctctgaagaatgctagatgttcaaacgctcctggaacttgctagacgcaacaaacaagcgggatcaaaaggaaggaggaatgttgcagctccaccctactgctgcgaccaggacctcgaccaggcttactatttcaaccaagtctatgttaaccaacactactacctcgacgcttcctgcgaccaagtgaaaaccagcaacgactacttccttgagcaagtcggcttcatctgctaccccaacctcgccaggcttcgcctcaactacggcacccaccgcaacctcggcgaagtcatgaagcatcaagtaccatgggatccaggaggttcgccatggcatcagcttgaggtcaagctgaattttaaggagtggggaatgttagtgaaccctactagtgtgctgggctgggccatatgctgctcggcttgagctccacggagacctggcaagaaagcaactacataacgaggccatcggcaacagacaagtcggctcggatcaggacggcttcggcctcctctgcttctgtcttcctcttctccttcctctgggtgatctcctnctcccttgtaatggcaatagcttgatgaatccat

SEQ ID NO: 61202 - DNA, 408 bp, Triticum aestivum
  Clone ID: PAT_TA_61202
cccacgcgtccgaatggcgaccacctcgcgtctcctgctcctcctcgctgccgtctgcctcctcgccggcgcggcggacgcgctccggctgcccccggacgccagcttcccgggcgcgcaggcggagcgcctcatccgcgcgctcaacctgctccccggggcgtcctccggccgcggcggcaaggtcggtgcggtggcagaggacgtcccgcccggtcagctgctggagcggctggtccgctacccggactactggaggcaggatgaacctgatgcaccacgacggatactacggtgttgccgcactgaacacgccaatagtggcatatctctgttaaatgctgaaccggtgaaggagagctcgctcgaagatttggctatccaaacttgcaggctggtgaaggaagc

SEQ ID NO: 61203 - DNA, 704 bp, Triticum aestivum
  unsure (1)..(704): unsure at all n locations
  Clone ID: PAT_TA_61203
cccacgcgtccgactctacttaccgaagctactccgcctgcccccaccaccttgtcgatcggcgagcgagcgccatgggcaactgcctgaacaaggcgtctacgcagcagcggcggcgcggccacggcgagagggtggcgccggaggtgagggaggaggaggaggagctcaggagcatcggccaggtgctgctgcaggaggaagaggaggaggaggaggtaccggcgtccgcgtcgcaggcggccgggatgaaggtgaaggtggtcctgacgagggcggagctggagtggctcatggcgcagctcaagagcggcgagcagcgcctcgaggacgtcctccgccagatgggcaacgcccgcgccgacgacgacaagccgccgcgcgccgacgcctggcgcccgcgcctcgagtgcatcctcgagtgccccgagcctgccgacgccacctagcgcaacctacacacggcgcccagccggccgttctctcttctatccggcgatcagagcttgatctcctccatggtgtactagctttcttgctcagatccgcccgtgtgcatgcctgtgatccatgngagaggcttcttggttttttgtgtttctctccaaagnatggatccatggattcggagtgggcttgatcttaggatgaacaccaactgtactatgtagcccgttaggacagtagcagtaggcttgatctct

SEQ ID NO: 61204 - DNA, 620 bp, Triticum aestivum
  unsure (1)..(620): unsure at all n locations
  Clone ID: PAT_TA_61204
ggcctcgctggttgtttgtccttttcttttcggcagttagctgcatgctctggttgacctcatgcagtctcctccagttcatgggccctctcttgctctgcttcaacggtacttcatgccagcttcagatcacctaatttgaagcacgcctgaatacgttcagagagtgattccgagcagtttggcggaattatagtgagctctaagagctccctcagtttcaaggtgataagatgtgcttagtgctgaagcttccctgctgtctgtgcattgtgtctctgggagatgaacnaaggtgatatgcagttgtgatcactggcttcatttggaggtggaccaggactgactgtaggtgatgctacgtctcgttccgcagtccaccgaatcacagtagttgttcctttggacctctccctataaccaaagctttggaggaagaacagcatgtaaaggatgtaaacaaagtattctaatctaaacaaaagcatatgttgtttgttgatacgcctgcttatgctctgtctatactttgaaaaaccgttctggatatattatcagctaanaaacanannanaaaaaaaaaaaaaaaaaaaaaaaaaanaaaaaaaaagggcggccgc

SEQ ID NO: 61205 - DNA, 661 bp, Triticum aestivum
  unsure (1)..(661): unsure at all n locations
  Clone ID: PAT_TA_61205
tgggagtcttgagccatgtttgtgttgttaggagcatgaattttttttctcccgttgcaacgcatgggcatatattaggtggcatcgctggtccgtgtaaaacgggtttaaacttggcgaagctattgaacaacactcttgctttcttctgttaggaccctttatcaatcattgagccacgccaagtttttgagatggtaatgaagcctgccacattaaatttgtccctccccttggttctttgttatttattcttttgaattcctgaattttctctgcaaaataagtcttgctttgccagaagattgaactgtttcttttcagctacgatcatctaatctcatatatgtgttcatttgaacttatttactcttttgactgttgatttggtttgctttgcctgaagattgaactgtttctttttactgttgatttatgaactccaagtactgatgtgcataattaagcatctgttcatcaggtgtcattgtatatggacaagtctgcaggggtttgccagtcggacttccatgattgcaaatttgtcgntcctgcaaattatatggtgatcatgatcctttttgntgagatgactgagacttttggtcgtcctccacagcgggatgcgacctccctggagcagcggggtcaggcgcatcat

SEQ ID NO: 61206 - DNA, 718 bp, Triticum aestivum
  unsure (1)..(718): unsure at all n locations
  Clone ID: PAT_TA_61206
cccacgcgtccgcccacgcgtccggaagcacccagcagcaagagccggctaggccaccgtacggaccccggagcagcacacatggcatccacgatcatggccgccgcctcccgcgccgttgtggccaagaccccgttcctcagcggccagggccgcgccgccagcgccacccccctccgcgacatcgccgccgcggccaacggcagaatcaccatgggcaacgacttgtggtacggcccggaccgcgtcaagtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgcttggcgctcttgggtgcgtcttccccgaggtgctccagaagtgggtgggcgtcgagttcaaggagcccgtctggttcaaggccggctcgcagatcttctccgagggtggcctcgattaccttgggaaccccaacctcgtccacgcgcagagcatccttgccgtgctcggcttccaggtccttctcatgggtctcgttgaagggttccgcatcaacggtctcgatggcgtcggcgagggcaacgacctctaccccggcggncagtacttcgacccgctcggccttgccgacgaccctgtcactttcgctgagctta

SEQ ID NO: 61207 - DNA, 762 bp, Triticum aestivum
  Clone ID: PAT_TA_61207
ggctagggtttatcttcggattattacgagcaaaatcctcgggcaatggcgtcggtgcagctctgcggcggcccggcggggggcgctccgcgggctcgtcgccagggccgccaccgtcgtcgcccccaagtacacgacggtcaagcccttggccgacagagtgcttctgaagaccaagactgccgagcagaagacgaccggtgggattctgctcccttcaaccgcgcagtctaaacctcagagtggtgaggtggttgctgttggagagggaagaaccattggggatagcaaagtggaagtcggcattaaggttggggctcaggtcgtatattcgaagtatgctggaatggaggtggagttgaatgattccaaccatctgatcctaaaagaggacgatatcataggtattctggagacggaggatgtgaaagacatgaagcctcttagcgaccgtgttcttatcaaggtagctgtagctgaagataaaactgcgggggggctgctgctgactaacagtgtccaggagaagccatctgttggaacggtggtcgctgtcggcccgggccatctggacgaggaaggcaagaggatcccgttgccggtatccacaggcaattccgttctgtactccaagtatgctggcgccgagttcaagggtgccgatggcacaaactacatcgtgctgagggtatctgacctgatggctatcctctcttgagctggattgtagcgcagggcgcggttttcctgatcctaaatgtt

SEQ ID NO: 61208 - DNA, 600 bp, Triticum aestivum
  unsure (1)..(600): unsure at all n locations
  Clone ID: PAT_TA_61208
ccgtccgcgtctcccgnctacgcctgcagcaggccgcgctcctgcttcctgcctgtctgatgacagaacgcaccaagaaggccggtactgccggcaaggatgtgaccacgcgacggcgccagcttgcgcatgcagatcacgaagatggaagcgtctcacgcactccaaggacttctgtgaatcctgcgtgaagctcgctgtcaagagcaaagctgttgcaattcggggatgcaaggactgcgggctggccaaggcaggctgcgcctattccatgaacactgatagcgcagtcatggacaggagcacgatccgtcgctagagggagcagaccgtgccatgactgcactactgacatcttgagtaatccaggggtatctgtagtgaactgaagacttaacagtctctgtattttggctatcgagcgatggatatctgctagcacagtgcatctgattgtacgatcttaggaacgtgaacgtctgtccctacatgtgcctgtgctgcgctatgcctgcctatccctacctctgcgacaagagatacaacgctgccaagatctttagcaaccctgatgttgccaaggaggagccatggtatggt

SEQ ID NO: 61209 - DNA, 718 bp, Triticum aestivum
  Clone ID: PAT_TA_61209
tttcgcgtgggggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacgggggagaacttccgtgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcatcgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggt

SEQ ID NO: 61210 - DNA, 563 bp, Triticum aestivum
  unsure (1)..(563): unsure at all n locations
  Clone ID: PAT_TA_61210
ccagcgaaacacccccgctccctctcccacctccgaagcagcagcagccatggcccccaaggcagacaagaagccggccgccgagagcaaggtcgagaaggcggcggagaagaccccggcaggcaagaagcccaaggccgagaagcgggtgccggcgggcaagacggcggccaaggagggcgccggcggcgagggcaagactcggggccggaagaagggcagcaaggccaagaagggcgtggagacgtacaagatctacatcttcaaggtgctgaagcaggtgcacccggacgtgggcatctcctccaaggccatgtccatcatgaactccttcatcaacgacatcggcgagctcgccaagcacgccgtctccgagggcaccaaggccgtcaccaagttcacctcctctnaggctgaatctgaatgcgtgccttgnntgtagttggctggctgttgactctgcttatcttctcagtagtgtagtannnannnttgngcactagatgattgccaacgctttgttggatcttggggttgttgcttttgcaagctgatatctatgt

SEQ ID NO: 61211 - DNA, 174 bp, Triticum aestivum
  Clone ID: PAT_TA_61211
gttttctggcctcatgacaggaggggggggaggcgcaaaagcggggccataacacgaggcagcgcatgccgaagggcaaagagaccagggcccgacgaacgagggcggagcgagccggcaccaaccaagaggcgcctatggggagaccgcggtccagtcatctgatgagcttca

SEQ ID NO: 61212 - DNA, 640 bp, Triticum aestivum
  unsure (1)..(640): unsure at all n locations
  Clone ID: PAT_TA_61212
aatttgtgcagcctggcatggttacgactgatcttcttatgtctggtgctaccgcaaagcaagcaaagtttttcactcaatatattagctgaaactcctgatgtggtgagagctacgccattgttccttcttttacagggccattggtccttttcctccagaacaatgttgactcttcttctaaactctaaagcttatgtttggcagcagtagtaataatttttagctgctttaggcctgtgtccatttggcgtgtagaaccgtccgaccacttagcttgaacgtggtctccagacttgtttatacgttcctaaaatttgtgatttggtcattgtcgaagggctgttaaccttttgtgcttgctttaacaaagttaaaaaaatggcaatnttgaagttcttcatatgatgtcgcaaggcagacatgtgttatcaaagtnggtcagtctcgaaagttctgaacaaaaaataataaggttgatctaatataaactgacaaagttagcttttcgaagcttataactttgcttaaaaactttacagtctatccatgaaggcaacgttttnnctttgtacagcgaatgaccggtaccttctaggttcatttgcgatggatatctgttaatgattcagcatacctg

SEQ ID NO: 61213 - DNA, 232 bp, Triticum aestivum
  Clone ID: PAT_TA_61213
cgccctgcaggtactacacggctgccacggcaaacacgccgccggtgcctgacccgcagaatcccggtgttcgtctccagaggggtggtgcagtacagcaacatccccaaggacgcaaaaaactgtacagagaaatcgcctctcctgcctgtgatgcctgaccagcacgacacgatcacgacctttctcttccatggcaacctcaccggcctgcaacctggtggcaacccgc

SEQ ID NO: 61214 - DNA, 564 bp, Triticum aestivum
  unsure (1)..(564): unsure at all n locations
  Clone ID: PAT_TA_61214
cggacgcgtgggagagcatggggacgagacacggattctctgcctggcggtggctttttcctcattgaaggtgctatatcgcttgtacttggagcggcttgctggttgagtctgcccgcttctccagagacggcctggtttctcaatgctgaagagaaagataccatgaacatttcttaaagagcgcaacaaacccgttcaaggaaactgaaagagttttcctggaagcaggtggcaatggcagttactgaaccctctgatctggctttgcgtcggttgcattgttttgctctttccattgcacttatttggtttcggaacaatttttgccttcttctcttgaggggtctcaattactcctcttcttcaagccaactacctttaataatcccgtctaacgttttagcatcaatcttcacttggagtcaccacatacgntttccgatcgtctcaaccgccgagccatatngtcttatccattctccattnngttagttgctgccggctacgcaatagtggtttggggaactggacattaagggcttgggcttctttttgccatgt

SEQ ID NO: 61215 - DNA, 517 bp, Triticum aestivum
  Clone ID: PAT_TA_61215
cccacgcgtccggggaggcgctcgaatctaagttcggggccgccgatgcagggagatagatgtatattatagagcagttccacgactacaagatggttgagaaccgtcctgtactagagcaggctcatgagataatatgcattgttaaggagcttgagcttctgaagtgcgagttacggggggaggttgtcctgttttttttaatcgctaagctccccgattcctggatgaactttgcctccgctctgaaccatctcaagcgtgtgttctttgtcgtggaggaccttaagatgaccatcgtgggcaccgtcgaccccgtcgccgtcgtcggcaggctgcgcaagctcttccccgccgtgcagatcctctccggcggcccgggcaaggaggagaagaaggactacaagaatggacggcgtcttttacaagaaggagggcgacaagaaagacggggacattaatgacggcggcgacaagaatcaacatgaggcgaatccggccatgtccgtgtaccccc

SEQ ID NO: 61216 - DNA, 424 bp, Triticum aestivum
  unsure (1)..(424): unsure at all n locations
  Clone ID: PAT_TA_61216
cggacgcgtgggcgggttgacacgattctcctggcaaagccagcaggagggccgcgacccccccacaaggtggcactggatgatgactagttttctgtgtactcttgtttgctgtgtatcatgctgtgggattttcgtgcagaagactttcctcttatgtaggttcaattcgagtaatagattttggctgcttgggtttcacggttggtggggcagcatgctttagctgatgtctcgcggtgtatttgtgagtttcctctgtggtgctgtcttaccggtgtatcacatgataactattgagacttgttcgtctagtttatcatacgaaccaaagcttgtcttggaagatcgtgtttgtaaaattctgctgtgttaaccctttgccctttaattaagaatagctgtttgtttgagntttgtctgg

SEQ ID NO: 61217 - DNA, 707 bp, Triticum aestivum
  unsure (1)..(707): unsure at all n locations
  Clone ID: PAT_TA_61217
gccaatcaataatcgggttctccttttgtacagcacttccagtcacacttccgttcggatgggcttccatttggcacactcaatggagtgaggacacgaatgtttgtcttcaaaatatattaaggaagtgatgactacggaaagaatgagaatgacttccttcaaacccaagtaagcaaccgggccgaactggcgtcgaccggccaatcggggtaccggcttggcttcggcggcgcttgtncgttccacggggaagttgggatccctctttcgcttgaatcgcattcgccccttgttcccggcgcttaaccttcaccttccttccaatcccaaagcttcaggaacgttcccgcttccttatgccttgcgggtttcaaactctttcgtaggcgactttatgtcttgtgcgtgctccggcgacgtttgataattacgcctcggcggcattcacaagcggaagctaattttgatataaagctgcctaaaaaaagcttgcttgttcaatttacatgtaataaatgtgatgcaaggacaaaaacgtttgattaaacagggtggcctaatgaaaaagaaacagtttttttttcagtgcgcagggtgcccaggtgtatcaacaagtttgttgaacaatcttggtcttaattgtcgagtatgaactaagaaaaaaaaaatggggtgaacactttgtactgaagaatgatttggaa

SEQ ID NO: 61218 - DNA, 518 bp, Triticum aestivum
  Clone ID: PAT_TA_61218
atgctgttttctgaaggatatattatgtgtgtttgctgtgaattgcttggaagacataatctaacatcgttgcgtttgtcgtcgttgtactccataagtcacattttattttatgaaagagttatattttatgagaagcgtaactcgtttgagctgcagtgttggcactactgctttgtccatcttgaacgtgagatggtttcagtgcagaagattgctcaattatgtgtcattccaaacttggatgttatggttggaattacagagggtcagctcatgccccctccgttccaaaatactccctctgtccggaattactctttggagaaattccgtctgtccggaattatcggagaaatgaatgtatctagatatattctagtttttgatacatctattttcacgacaagtaatccagatggaggtatattgtgtaacagttttttcacctagtcttttagaaaaaaatatcaacatctccagtaccaaatttatatcagaaaagaagtattatatct

SEQ ID NO: 61219 - DNA, 268 bp, Triticum aestivum
  Clone ID: PAT_TA_61219
cattctcgtgtccagagcataatctggctttatttactcctgaatctcccatcgattctcacctgtcaaagcagacatcaagatcgccgctagggaaaggcattgagttgctgctattgccgaagctctgaaccccaacgccgcgcgcggccctgcggtgaccggactgtccggcggtgggggggggcgtggctactttttttttgggctaccttgtccgtcggctgcgtgctctgcttttgtggatactgtgatccccccggcgctc

SEQ ID NO: 61220 - DNA, 355 bp, Triticum aestivum
  unsure (1)..(355): unsure at all n locations
  Clone ID: PAT_TA_61220
gcgcaatgcttcagtgactatcactgggaagaggcaccgtcgacctcgctgtgttgccatcatcgggaggggtggaggctgccgcttgcgcagctgcttcacccagaggagcgccaggaggagcgtgtcctcgccatcgatcggaggaatgccagattggcatcgagccaagctgatgaaggatgatgccctttggttggcacttatgatatagcttccgacgtcggaggttccatagaatttgtgaagagaagtacatcgacagaaatgcctttcttctgataattgtatgtgctgaagaggngnaggtttcatgattatctagcattcattagttaccagcaggtatgtccca

SEQ ID NO: 61221 - DNA, 271 bp, Triticum aestivum
  unsure (1)..(271): unsure at all n locations
  Clone ID: PAT_TA_61221
ctcgaacaaccatccatcaagtaccgtacggacgtagtagcgtggcactcctctccttgaagaagaagaagaagaagaagaagaagaagaagaagaagaagaagaagaagaaaagaagttaataattgcactagttatgatcagtagcagtacctttggtggcttgtaccagtactaatttgtactacggggtggtggcccttgcgatgaaattgaagatttgcaaggccatatttatggaaaaaaaaaaaaaaaaaaaaaaaaaaanann

SEQ ID NO: 61222 - DNA, 608 bp, Triticum aestivum
  Clone ID: PAT_TA_61222
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttaaaagaaccaaattttacaacccggggctgggaaggtaaaattttttttttggggccccaaaattaaatttctgggcccgggttttaaaaacgggggggggggaaaacccgggggttccccaaattaaatcccttggaaaaaaacccctttttcccagggggggaaaaaaaaaaaaggcccccccccgtccccctttccaaaagttgcccccccctaaggggaaaggggaccccccctttaacgggcctttaaaccgggggggggggggggtttccccccaggggaccctttaattttgcagggcccttaggcccgggttttttggttttttccctttcttttttgaccagtttggcggttttcccccggaaagtttaaagggggggccccctttaggggttccatttaagggttttagggcccctgaccccaaaaaaatttttttgggg

SEQ ID NO: 61223 - DNA, 309 bp, Triticum aestivum
  Clone ID: PAT_TA_61223
agaacatcgctcccatctatgactggtggatggcgatcaggtttcaaaggaggagaaaaagcattttcatggactcacctcgtatggcgttaggaaaaattggaacattaagtcaatgacaccacattcaagaatatgattttgttatagttgttccggatgcatggtggggggctgaggttttgggcctcccttttcccctctattagacaaaatctacctgtatgggtctggctgtaaaactaacttcgactaacatatccttgcttgcgatggaatacaaatgtattttctttaagctgtaatact

SEQ ID NO: 61224 - DNA, 581 bp, Triticum aestivum
  Clone ID: PAT_TA_61224
tcttttttttttttttttttttttttttttttttttttttttttttttttttttttttttttttttttttttttttttttttttaaaaaaaaaaaaaaaaagttttattattgggattaaggggcaatttctcctttaggaaaaaaaaaccccccccatccccaagggaaaagggcgccccccctaaactttgggaggggggaaaaccccgcccccttgcttaaatggaaaaaaaacatgggccaaactttatatgggggaaacccggggggggaaatttaagaaattttggggggaacctcccccttcccgaatggccccctgggcctttgggacccccttaaaaaaatttttttgggaccaaacctttttttccaaaaccaaaacctttttaaagcccccctaaagcccccccatttttaaaaaaccaatatgggccttggggacacccccccccaggcccaaggcccttttaaaaaactttggaaggggggggggggcaccccaagggggaacccccccaagggggccccccttaaaaagggcctttaggggcgagtcccatccacaggggggaaaaa

SEQ ID NO: 61225 - DNA, 359 bp, Triticum aestivum
  unsure (1)..(359): unsure at all n locations
  Clone ID: PAT_TA_61225
ggccttgtgtatcgcacactacgacgacgagcgcctctaagaagaccgaagggtggaggcgctctagaagagacacgnctacccgcgaggcgtatgcggacacgagtatgaccaccatcatgataactagaggcacattcagtgcggcgagcgccaacgcacgcccgactgcgaaaaccgtgtcggtacctacatgaggtgctgtcgagctgctccgtgctctggtcagccggagcgaggcctgaaagaaccagaacgagcgccgtcaccaagagtgactgattatgcatgcagaatgacacactccctgtagctgcagcgctagctcggggggagaagaggataagatcattgagagc

SEQ ID NO: 61226 - DNA, 482 bp, Triticum aestivum
  Clone ID: PAT_TA_61226
aaagcgtcgaggaaagaagagataagatggtcttgtctggtaacaacaggagcgcattggactattggagggaggttctcgtgcaggctgagcagatgaagtttgtgtagccttctgttactcatgaagcttctgtagcctctgttacacatgaagcttctgtagcttcactagcttatgaatcttctttagcttctgtagattaacaaagaagtttctcatgaattcatcactatgaatcttctcatgaagcttctattactccaacttctgtagcttgttgaacttctgtagcttcagcttcagagtagcttgttaatcttgcagttcccttgctagtcatgaatgttcattgctttggcgagggaaattctgtagcttagtcgtggtgcagcttctgtagttttattaaactttagaaaaattgtcttgggtctgcatgtgcttcttcagaaaattgagaatttagtgtgtgtaccttc

SEQ ID NO: 61227 - DNA, 164 bp, Triticum aestivum
  Clone ID: PAT_TA_61227
tctcgcgtccgtggttgacggttccggtcggtgatttttgatctctaatggtggttgttctctcttctagcttatgcgattatgtgcggtgtctgaatcgctctttggtttgaatccttctgcgcggacggtctaccacggcggccggtctacagggtccctgc

SEQ ID NO: 61228 - DNA, 631 bp, Triticum aestivum
  unsure (1)..(631): unsure at all n locations
  Clone ID: PAT_TA_61228
aagcccgaaccatccctccccctccggcgccgacccaccgccgctcgccatggagcccgcggcgatggaccgcatcgccgcccggctctccgccgtcgacgacctctacttcccgacggccttcctccgcacctcgccgccgccgccggcgcgcaagtctgcgctcctcgacctcctctcccgcgacgccccgctcttcctcgagcggtacggcgccgcgctgcgcccggacgagctggcccccttcgacgtgctccggaacgactacgaggtgggctggcacctccgccgccttcgcgccgccgccgccggggaggccccggcccccgcgcgcgtgcgcaaccggcgccgcgcctacctccaccgcctggtgacccagggggactacttctccgaggaggcgatgcgggagcgggagccgtacctgcaccacgagtacctcggcaggttccaggaccccttcgggcgcgccatggtgcggcccggngagaagttctccgagacgctgatgcggcgggccgaggaggccgtcatcgtggagaagatccgcggngagcagatcaggagaggggttgaccccagcgagtgggtcggcgggtcccgttgagcggccgatgatggggcaagagga

SEQ ID NO: 61229 - DNA, 576 bp, Triticum aestivum
  Clone ID: PAT_TA_61229
gtccccggccgacccgaccacccctcgccgtcggccggaccgcatctccccccctcacccccacctccagatccgcgcgctcccctagcctccccccgcccgccgccgccgggaactttctgccgagctcgatccatccagtggccggctacagcgaccgcccgccgcgcggatcgatccagcgaccaacctggagcacggctgctagccgtcccctcaccagtcaacccaagtcgcaccacgtgccaccattttgaccagctccgccgctgctatttttctccctatattcctcccctcacaccgacggcgccccggccgctcctccccgtccgccgcgcccccgctccgcgtccatctcccgcccgagaaaccctagccagaggaaggaggacaccatgaggggggaagaagccgctcaaggagctcacactctccgtgccggcgcaggagacgcccgtcgataagttcctgacggcgagcggtacgttcaaagacggtgaactgcgacttaatcaaagaggtttgcagcttatctccgaggaaaacggagatgaacatcaatcaacaaaaatg

SEQ ID NO: 61230 - DNA, 665 bp, Triticum aestivum
  unsure (1)..(665): unsure at all n locations
  Clone ID: PAT_TA_61230
cagcaactccctccctgtcatggcgtcactgccaggagcatgctcagatctatttgccgttcccctccttcgcatttcagcacctattgatccggagcagctcccaggagaatcacaggatgaggtggcaagcatggaagtaacccacagccacttttcttcatatgcggcatggaacaaacaatatgagaattcacggcacggttctgaggcagcaccagcgattgtcaaaataccttacaggatggtgttggatgttcttttagagactctgggccttccagaagttgagtaccgaaccagagtatatgatggcagcagggtcgtgtgtgactgtattgttctatagaaccacatcatatgttgggaatgatattcctggggtacaatttgactgatcaatcaatgccagaagacagtgctgctatggaagcaattggatacattaactgcacagtgaagacagagataacagactataactacagcaccatgaagaaactcgaggaggaaaatcggtctctaaaacatgagctntatatatcctaggtacaacaagtagaagatgaagaccaagatcagatccatcaagaacaagctaatgattggtacatantgagaagaagcaaaacgcttgggctgggnttcgtcttaacaaggtacat

SEQ ID NO: 61231 - DNA, 494 bp, Triticum aestivum
  unsure (1)..(494): unsure at all n locations
  Clone ID: PAT_TA_61231
cgccgtccgcgcctcgccttgccgcccaccgcgtggcgcgggcagaggaacaatgcattaccttgggctcttggacgcacccagcattgccgtgtctcgcatcataacagcacatgcngtactgagaatgggcaatcatttgataaagcaagatctaaactacatactactacaattccgattgcatatgcactattattgtctactttggatgcgcaggctggatcttgactcagtgtggaaggaactcaacaacggatgcgcttggtgttggcgtgccaatgctgcacgatgccgacgtcgagcgaccagcgcaaccacgctatagaacgtgaaccagagcctgctgacctgggttcggatgcaggcacatgacaaccgctcggcgatgagggaggaggtaaagagcgtcttgaggaaggtcgcatgaatgtggagggctgaggtcctgtcctcgctgagtgcacctcaaagcgtgaacatggccatgaacg

SEQ ID NO: 61232 - DNA, 377 bp, Triticum aestivum
  Clone ID: PAT_TA_61232
gcgacggctccctaggcagctaccggtcacgccatatgcggatgtcccgcccatccctgacgcaccatatgatgcccttttttcaagagctcgaggccgtgctgaattgcctgccaagtcggagaggcattccccgagaaaaccgtgtctttgaggcggccatgatgatagtaccgcgctttgagaacctgcgcacacaagctgtgggattagttagcagacgacatgcctgcctcgctagaagagcctggttgaaaaggcggaaaactctgaatcccaatccacccatgcttttctgggtttgtatcttcggcctcatggacattatttagtgccgagcaatagttgttgaccgcgtggaagaaagagagaagaag

SEQ ID NO: 61233 - DNA, 649 bp, Triticum aestivum
  unsure (1)..(649): unsure at all n locations
  Clone ID: PAT_TA_61233
gaattttctaacatgattggcgcacccggtggaatataattgagggtgtttgttttggtctacagtaccttcatgagcaatctaatggtcccattgttcacttggacataaaacctgcgaacatattgcttgatgaaaatatgttaccaaaaattgcagactttggtctgtcaagactgtttgataaaaaacaaactatttcgactaaacatactattggaacactaggttacatctcaccagaatactttcgaggtataatcacgcctaagtccgacatattcagtttgggtgtagtaatcttggaggtaattacgggacacaggaactatccgtatgatattagaagatcctccgaggacttcatcaagagtgaagttcaaaaatggagaaactgtgctgcaggaagaaccaacattgaaatcagtagatacagattgcgaacaaataaaaagatgcattcagataggtctaatctgcgtgaaccttgaccggacaagaagacctacaatgaaggaaattatcaatatgcttcaaggggtggaaagtatggnatcagtacattagcaatgagctatcatgccacgacatccaggaggagcaatagtttatctaagcagattgaaatgacttccgaccgttcttcctt

SEQ ID NO: 61234 - DNA, 560 bp, Triticum aestivum
  unsure (1)..(560): unsure at all n locations
  Clone ID: PAT_TA_61234
gttgttattttgagtgggtacgccatttggaagatggatcggtaaattacatagaaggtgcaaagcaacccacatatttagttactgctgatgatgtggattctttactagccatagaggtccagcctctagatgaccgaaaaagaaagggggagatcgtgaaggtttatgctaatgagcagagaaaaattacttgcgatcctgaaatgaaggagctcatcgagaaaattctttcaattgggcatgtgtcttatgaagttctgctacctgttaaatttataaatatgtgggatcctgccttattggcaataaacagggaaggttacagcattaagtgtaatggacagcgtggtgttgttatgacagagaaattccggcaagctacgactatcaatatcccatatgggcgtcccactgaattttcaatccagtctgctaagggtgctgagtacaatctcaagcctgcaaaaagttccccatcacgagatgccatcgttctaatactgangctgtacagaatgaangctcttgagaagagcaagggaaggaaaaaggggatc

SEQ ID NO: 61235 - DNA, 361 bp, Triticum aestivum
  Clone ID: PAT_TA_61235
gcgctcctgcccagaggaaagtgttatcttaactaactgcgatttaggggctgatacaagctatcagggacatttctaacatctacattacttctagagtgtagtccgtagagactctacatactggaccgtagccagtttgtagggagaagcatccatctctagattccacagctcgcggtgatcggctattcggagagcttgacaactatatatacagcccagcttatggccaagtggatatcacattttatggatggtggttgcagatcaccaagtgacatagatgtgcgaagggatgcacttgaatggtagaagataatgtggcactactctacttactattctcgcaggacatgcc

SEQ ID NO: 61236 - DNA, 584 bp, Triticum aestivum
  unsure (1)..(584): unsure at all n locations
  Clone ID: PAT_TA_61236
gtcgtttgtcacgtagctagctaggggggggggagggggggcatttgttgtgggcgagagtcggtgagttgatgtgctgcggcgccgaggtggcggaccctggagagcaccggcggcggctagccgccggcgacgacgacgggggagatggacgggaggagcatgcactgtccccgccgcctgtcggtacgacgatgtgggggcgcagacaggcgcaggagatgtcggccatggtatcggcgctagctcaggtcgtcgccggcggcgtgggcgagggtgtcatggcgtcttcgaccaagagacccgccgagcacgaggccttcgcggaggaggcgtggtggtcgacgtcgtacggaggtggagacggagacggcggagcgccgtcggcggcctcttccttccttgccgattacacggcagcgcccgcggcatcctactcgccgcacggggcggcagccggcgacgaggagcttccttcgccgtcctccgccgagtctggtggctccgggggcacgccgaggaagcggtacaggggcgtgcggcagcggccgtggggggaagtggngcggnggagatccgggacc

SEQ ID NO: 61237 - DNA, 732 bp, Triticum aestivum
  Clone ID: PAT_TA_61237
aatgggagttccagccaatggcaaaaggagtgagggagtggccaccctcaccgggatctgggtacgtgctcagacagtcgatggggacacatttgcttttgaatcactgggggttctcatccttcgacgaagaattatgcacagacttatgcacgttggacatgaaaacattaaagattgagagagggggtgcttccacagtgcagagcttcgcatatagcaactatccaccatcgttgtcgtcaccgacaatatcaaatgaaatggacaatgttgaagttaccgcgtgcaagtggaaactccgggaaaagtggggtcattgtatggaccacttccatgaccaacactatgctaggttttttggctgaccttgttgctaaagggaagagaacttctagtggattcagggagacacatctcaaacaatgtgctgctgttttgaacgagcaattcaagctaactatcacctctgatcaagttagaaaccatctcaagaagtggaggaagatttgggtcagggttgtcaatttgaagaatttaagtggagctctatgggatgaagatacttgcacaattaggctcagcgatgagcactatgcaggtcattgtatgacccacaaacctgatgctcccttcttgaataactcaattgaacactatcatgctatggcgaccatttttgggacaaccggggctaaagggatgaatgcaaggtctggaaaagatctcctt

SEQ ID NO: 61238 - DNA, 720 bp, Triticum aestivum
  Clone ID: PAT_TA_61238
agtggcttgggtttgtttggcacgggcgcgagggccggccatgacagtagaactaatgacaggagagaatcttaaatcccctccctcccctccctgcctcaccagatttgatacatgccaacctgttgcttcttaacagaaccaaaaaggtttggaccttggcctagaagtagctagcaagagagagggtcttgggggagaaagagggagagtgccttaccttgttcagaagagaagaattcagaaacaggactccttgccagaggtgaggctgatacttcgtgtgggttggtgagagatggagaagaaacatatgaagatggccatcctgaggcaagagcagacattcagacaacaggttcacgagctgcatcgcgtatacgaggttcagaagcggctgatgaaggagatgcaggctgttaagatgagcccagctcaggcaagagaggatactcgaccagaaccgatgctggatacagatcgaccacaatggcacatcaactcaggcgagaagaccgctcgtttcaccgaggacttcaacctggagctgacactagcaactgggggtgatacaaggaagcaggagatgacatccaactccgagtctggagcaacggtgacatcgtcgacttctgctgaatcagagtcggggcagcgattccccaagtccaatgtagacctgagggttcaacatgagagcaagaggcatgatgatcagct

SEQ ID NO: 61239 - DNA, 700 bp, Triticum aestivum
  Clone ID: PAT_TA_61239
cgtcgtcaccgccgtcatggcgccctgggggctggggggggagaggagcaagggactgaggccaaagatgacaatcaccatcttcctcaagatcatgggtctcgcattcctcgagcctgtgattgaccagaacctgtacttcatgggggcgaagctcacctcggcgggattcgcgacggcgcggggggacatcctcccgttcttcacctttgtgctggccctcctcctgcgcatggagaaggtgcggctgcggagcctgcacagccaggccaagatcgccggcacggtcctcacggtggccggcgccgtgctgatggtcctgtatcacggccccatcgtgcagttcccgtggaccaagggccagcaccacgccaccgccagtggccagggcgtcggcagcgcggccgacgcgcgggactggctgaacgggactatcatggtcatcatcgcctgcgtggcctgggcgtgcttcttcatcctccagtccaacaccctcaagagctacccggcggaactgtcgctcaccgtgctcatctgcggcatgggatccctcatgagcggcggcatcgccctcgtcgccgagcgcgccaacactcaggcctgggttatcggcttcgacatgcgcctcttcaccgccgtctacgccggcatcgtgtgctccggcgtggcgtactacgtgcagggcatcgtgtcgagtcaa

SEQ ID NO: 61240 - DNA, 760 bp, Triticum aestivum
  Clone ID: PAT_TA_61240
gttttggactatcttgaacaccctaggggggggggggggccttgttcctgagaagcgaagccagccgcgccgtccctgcggactcaaatgccgggtctggttgcgggcaacaggacgggaagtgcgccggcgtcctgatgcttctctgactcggtcggggcagtcaactgaccccgagggcgctgggtggacaaaaaggttacagctcggtagtgcaccaccagaccagacaccttgtccctgggatgagtgctcacaattatgcagaggaaccgacaaagagtgtagtgcgacctgcacttgctcgggcgaggcatatgatttctacaatttgtacacttgggagatcgggttcggaattagatatgataagatcaggctcaacgctgagaggacaaaatgcatggaggagatagtctgcggttgctcgggattgggccaatgtactccccaagtacttctggttactgtacaacttagactatacatgcttggcgagcagtcataattctgaacgaatgaacaattggaggctagtgggacatgcgggtcttgaaaggttcaagacaataacaagcagttactacttactaccggggactgcatggaatcatttttcaggcatttgcggaatcattaggaatgaattttcttgagagttatgctacggaatccatcaatgtggagagaactttcataaatatgtcatcagaaatgaagaaaagataaccaggagctacacacttttagaggccttttt

SEQ ID NO: 61241 - DNA, 379 bp, Triticum aestivum
  unsure (1)..(379): unsure at all n locations
  Clone ID: PAT_TA_61241
cccactcgtccgggggtgccccctagggattctgtgagcgacccacctgtgtcggtttcgggtacaggtacccttttgttgaaggtcgttcgagcttttcctgggagtatggcatcagttacatacttcagcgccgtagcgcctggtatgagcctcgtggagaagcaatcgctantccacgggtctgatggggtcaactttttttttttnggtactcagacctcngctctagggattttctctaccccttcttaccctgaaaaagcagggtcaccttgtgtccttaaacctatgaccatgtttgagctaacctaaggagctgcgtgcgtgggtgccaacgggggggtgggggaggggagggggggggagtgggggtggg

SEQ ID NO: 61242 - DNA, 383 bp, Triticum aestivum
  unsure (1)..(383): unsure at all n locations
  Clone ID: PAT_TA_61242
gtccgcccactgtcttgccgagaatccatcttgagaggggtggggggggcataggacctctcaatctttcacaagaaaactaaatggaccgggccatgaaggtctttgtggtcgtcttcctgctccttgtggccacagggttccagggagcggcgcaggtagctttggcgagggactgtacttcanagagccgggggtgtggnngctgtgcctgagcgaccgcaactgtgcaagtgtttgcctgaccgagtatttcaccggaggcaaatgcgaccaccgacgttgtgtctgcaccaaggactgctagatggcccctgtaatcttcttgcacacatgcttccgtgtgataataataataataataataataactactgagtaat

SEQ ID NO: 61243 - DNA, 542 bp, Triticum aestivum
  Clone ID: PAT_TA_61243
acagttttctgccactcaaggggggggcgggggggcactttctacacaagccagcgtgggacactagctatcaatggactaccagatgagcgagagccaccaaaccatgcaccgatgacatcaaggggcgctattcttctaacactaatatgcctatctccttgaatagttctccctcggggggggcaattttctagtatctacaagaggaaatccaatacaaccgcaagagctgtttcccatgtatcctttataaaaaaaagaaccagcacaccattccagaagatccagcgaacatgtctcctactacaccgatgtagaccaatcatcagaaaaaaggcaagatcaaaaacgtcaccagccctcaacgacgaagatctgtctttatacgatggccatgtatataaacattataatcataatgtcaccaacagaacagacactcggactctcttacatacatgatacagacgcattaactctcgctaaatcaggctatgatgcaagatggcaccaagtgagaacagctactgattccacac

SEQ ID NO: 61244 - DNA, 484 bp, Triticum aestivum
  unsure (1)..(484): unsure at all n locations
  Clone ID: PAT_TA_61244
cccttcgtccgcggacgcgtgggggggggggggggggggggtcaaggtgtggcggcgggaggacggcaagggcggcgccacgaggcacgtcatggagcgggtgctgcgcaagggcgagagcgcggtgaccgccatcggcgtggcggcggaggcgcgcgtggtgtacgtggcctcctcggacgggggcgtgacgcactggcagtggcggcgcggagcctaccgggagagcgcgcctaggaacgggggggcgctccgcgggcacaagatgggcgtgctgtccctcgcggggggcgggcgcgtcntcntgagcggctccnccgaccggacgatctccgtgtgggggggcgacgagggcgcnnaccactcccggctgggcgtgctgagcgggcacacggggccggtcaagtgcgtgggcatggacgaggaggaggcccgnnacgcggacgggcaccgggggggggtggggtacagggggagcctggga

SEQ ID NO: 61245 - DNA, 337 bp, Triticum aestivum
  unsure (1)..(337): unsure at all n locations
  Clone ID: PAT_TA_61245
gttgtacttagggcctggcggaaggtagtaaggggggcgccgccaggaagaaaaatccagagggacaagggcatcgagccctccgaattcgaggatgccatcgcgtgggctgcaaataatcttgtagctgcgacggcagtggcaccttcagttcttgcttgcagggcacctactgcanatacaccttgtanatcagagtcctcccatctgggtgccaccgtcgtcgtcgcacgcggtgtcggagacatggacgaggtcaagcagtctctgcctttgtcttcttccctcgctgtgaggagctgaggatacagacgaggaggcaaggaaactgtggcat

SEQ ID NO: 61246 - DNA, 158 bp, Triticum aestivum
  Clone ID: PAT_TA_61246
cacgatgattactcaatcaacagggagggggggggagcagacaagccgctgaaatcaactaccctgtttttttcttctatatttgtacaaccgtacagtctcaacgttttgtctttgttaccttctgattataagattgtgcgtcctgtatgtagact

SEQ ID NO: 61247 - DNA, 195 bp, Triticum aestivum
  Clone ID: PAT_TA_61247
ccacgctttcggaactatgttcctggggcgtgggggggggttttgcctgatgtttgttgatttgcgaactcgtggttgcctctagatgtaatgtggatgtttatcttattaagtgctatttcgagacctcatccggttaaaaaaaaaaaaaaaaaaaaaaaaaaaaaaaaaaaaaaaaaaagggggagggaaaaa

SEQ ID NO: 61248 - DNA, 196 bp, Triticum aestivum
  Clone ID: PAT_TA_61248
ccacgctttcggaactatgttcctggagcgtgggggggggttttaactgatgtttgttgggttgcgaactcgtggttgcctctagatgtaatgtggatgtttatcttattaagtgctatttcgagacctcatccggttaaaaaaaaaaaaaaaaaaaaaaaaaaaaaaaaaaaaaaaaaaagggggagagggggaa

SEQ ID NO: 61249 - DNA, 263 bp, Triticum aestivum
  Clone ID: PAT_TA_61249
gtccctccgacggtaaacctccccaggggagagccgccacggagaacccccgggccgcctccgagcacgcgggggccctggccctgccggaccggccggcgcctccggccgagaagaggcccatcaccgctccgtggccgcggcgcgggacctcctcgcggcgctcccgtactccgccgagaacgccgcgccgcgccctttttttggccctcgccgacgcgtgctgccgccgcggcgacccgcgcgagatcgggccccccctg

SEQ ID NO: 61250 - DNA, 412 bp, Triticum aestivum
  Clone ID: PAT_TA_61250
aagaatagttgaggagaaggagaggaggggataagctatggcgtcgatgatgggaggagacttcgtggaggcctacgtgctcaggaacgcctacaaggagaagctgaggcgcatggaccaagcggaagccgcggcggcgctcggcggcgccaagagcagcacggagaaggtggccgccggggggtcgtgggagaagaaggctgctgctggtggcggtgcgagcaccagggggcgattctttggcctcatgaagaagaaggtgcaccccaaacccaaggcggcgcccacttccccttgatgaatactgtatttgcgatgccacgaaattgtaggccgcagcttgcttctagctaggagcgtgtgtgtgtgtaagtttgttctttgaatcgttagagttgtgttgggtgggggg

SEQ ID NO: 61251 - DNA, 521 bp, Triticum aestivum
  unsure (1)..(521): unsure at all n locations
  Clone ID: PAT_TA_61251
gtgtgttcaacttgcgtccggtaattgcgggggggaggatatgtgcaaaagaacaagtgaataataagaaggtgatggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccatgttgaaagaaaggggaactttttcttttttcctattaaaaaanccacacaaaaaaaaaattaattaaccaattttttaacaccctcttttactgaaaaaaccttggtattacccattttaatccctttccaaaattttcttttttcaaccacctttaaaatacggaagaggccccaaaaaatcccttttccaaaaatttttgcaatttaaaaggaaaatggaacgcgccttgtacccgcattttaagcgcgggtaaaggggaggttacccccannnttaacctttacttttaccggccccttagcgccggctctttccgctttcttccctttttttc

SEQ ID NO: 61252 - DNA, 614 bp, Triticum aestivum
  Clone ID: PAT_TA_61252
gtttataatgggcatgttagtcctttgagggttagacaaccgatgaaggacatccatctgatggcatgtctcacagcgtgttcgtgccatgtcgggctctcctttaaggttgttgattcattgcttgatctgcatcattttttttatgttttcttgagctgtttcgtgcttgatccttattggagcggggaacattcatttttcctgataaaaaattaatgatgtgtttcaagaatgttgcaatgcagagcctagagaaaggggcaaattggccttttcctgtgtgactgttgacaggggagggatctgagagagaaacggtgctgacagcattgacatgtcaccccagtggtgtctttgactcacagaccaaaatgtccgtttttaaacttcaagagaaaaaatgagggaccaatccagtcattaaccaaacatgaaatgcatccttattgttttatataccttttttaagaagttggaacatcacatgtaacatttagcacccaaaagtaactgtaactttgatagttcacataggcaatatgttgcttgatgtgttaactgaaaaacaactatgggaggtggaatatgtaggacattgtgattgggggtgg

SEQ ID NO: 61253 - DNA, 715 bp, Triticum aestivum
  Clone ID: PAT_TA_61253
atcgactcggtcttcacaaacctcggggggggggaggggttgtcacggagatacgtgctgctcccgcccatacccgaggaaatgaccgtccagcaggagcgccttgtcgaatttgcgcctatgctggttcccattggcgaggaggaggaggagacctcgttcagggtcatctgcacgccacgcgggggggcaagttggtcatgtttgtcttctcttccatcaccggacaatggtgtattgctgcatctcccagctggagctctttgggcatagttgagcccccttgtaatggcttgtcccatttcaactacgtgcgtggctgcttctattggccggctctttggaaggacaagttgctcatgctggacacgcgcttaatggagttctccattgtcaacattctcaccggctaccatgtgcagcttataaaccagcctggacagagtgtatgcatgtctactattgttgatggtacagaaggggcccttgagatgtttactcttgtcggtagttacagctatgccacgtttcatctctatcataccactcaacaaaacaacggcgaatctcccaaagagtggcagctgaaaaatgttatagcattgcctcctcaatgtcactatttcgctgtgggtgcaactgagagattcttattccttcgatgtattcgaatagctcagtgggatgataatgcacatgggttgttgccccgaga

SEQ ID NO: 61254 - DNA, 276 bp, Triticum aestivum
  unsure (1)..(276): unsure at all n locations
  Clone ID: PAT_TA_61254
tgcccgtctacttccagtantatacggtgggagggggaggagcacgaggagtccgcttncgcttctgtgcgtgcgctgggttccttgcgttaatttatgcgctagtactagttagtaaataaacaacgggctgggcaatgcggctaatccgtgctgtgcgtgctatatagtagtaccccactagagagtcaggtatatatacatgttgggtaaaaaaaaaaaaaaaaaaaaaaaaaaaaaaaaaaaaaaaaaaaggggcggggcgggctaaagggg

SEQ ID NO: 61255 - DNA, 576 bp, Triticum aestivum
  Clone ID: PAT_TA_61255
gcggtgttcagcagggtggtggcatgggcggggcatgaaactgcaggatctagatcgtgttatttttctatgtatatagtaaacttatatatatcttttgccgggaacactttctatgtatttagtgtttacttacttatggatctaggcttcgtttgatgtaacgaaaaaaaaaaaaaaaagggggggggaaaaaaaaatttttttttaaaaaaaaaaaaaaaaaaaaaaaaaaaaaaaaaaaataaagaataaaaaaaaacccccccaacaaaacataaaaataaaaaaaaagggggcggccgttttaaggactccattttatcttccccggcgaggacaggggtggttttttttttggggcccctaaattccattccctgggcgcgtgtttacacgggcgctgggggaaaaaccctgggggtacccaacttaaatgcctttggcacaatcccccttttcccccggggggaaaaaaaaaaaaaggccccccccaaccccctttccaaaaatttgcccaccttaaggggaaatgggaaccccccctttaaggcccattaagggccgggggggggg

SEQ ID NO: 61256 - DNA, 263 bp, Triticum aestivum
  unsure (1)..(263): unsure at all n locations
  Clone ID: PAT_TA_61256
ccgggtttaggcctccatgggcgggggcgggggcggtgttctagtagctagtgtaaaatcaattaatcgatcatattattcccacgatcaaccatcccacgccaaacgaccagggactagttaaccgcaaatcattgggacagggtctgattatatcgtcgtactagttccgtcggactgggggggggcgtacgtactactacaatggaacagctacnaagtagcggggtgcatgcatgattggatttgtccatcgcatttac

SEQ ID NO: 61257 - DNA, 705 bp, Triticum aestivum
  unsure (1)..(705): unsure at all n locations
  Clone ID: PAT_TA_61257
gaggttgcactctcattgggtacaggggcgccggggggccggggacgtcgatgatcggaagagcacttctggcttcatcttcttcctcggctcaagcccggtgagttggcaatcgcagaagcaaaaggttgttgccttgtcttcgtgcgaggccgagtacattgccggcgccaccgcaggcggggagggtgtttggctgatccggttcctcgcccatctgctggggaaggaagctgcaccaaccactcttcttgtggacaatctgtctgcaatccaactctgcaagaacccagtgttccacgggcgaagcaagcacatcgagacgcgctaccacttcatcagggagagcgtcgagaacggcaagatcgtcgtggagtacgtgaacaccgacgatcagctcgctgatattctgaccaaatcgctcgggcgggtcaggttccaagctatgcgcgagaggatcgggatcgtcgacatcaggaacatctagatcaggaggagattgttgaataatctagctgtcaggttagctgtcagatttttctgttagcattcagttagccggactagccggatcctgcccatgttntgtgtgaggccagcagctcaacacgccctggtatcgtgggatggcacgatcgcgtccgtgggggccggtggctgaagccacgatcgcatttgcttcttgtataagttcagagataatca

SEQ ID NO: 61258 - DNA, 710 bp, Triticum aestivum
  Clone ID: PAT_TA_61258
acgcctttttcgtaacgctagctcggtgtgtggggaggggggtactgattaccgagccgttgggagctgagagctactcggtgcagctgagtgcccgagtactcctctgtcctctccactccccccctctcctcctctctctctcggccgagaaggatagatagacctaacctctccctctggggggcggcgttcttggggtagacgcgccgagatggagcatatcgcgaggttcttcttcggggtctcaggcaatgttatcgctctgttcctcttcctgtcgccggtgtaagtgctcctgtggcgcatagcctccttgatttcctctgtttcctttcggtgagctcttgcggtgtgagcacaaacatggaaacagaaggacctgtgaatgatatagcgctctgttcttggaaagtgccagccttctctgaactttgctttcctctccacgcaccatttcgttctttctcgaagagtggttctgagaaaccaaccagtcagcacatgaaaccctgcagatctttgatgctgactgaaagttagaatctgtgtaccatctatctagagacagactaactaactctcatgtcgcactccattgttgttattttttttttagaaaaggaggatgacccctaattaattatttcctgaagctctgatctacatttcctgcgtttctcggcgtgctcgattaatattttcttctg

SEQ ID NO: 61259 - DNA, 425 bp, Triticum aestivum
  Clone ID: PAT_TA_61259
ccgccttcgacctcgcgtcttctcctgggcggtgggggggcttcctagtttccacgatgaagctgatcgctgcctacctcctcgcctatctgggtgggaactcttccccaagtgccgctgacgtcaagaacatcctggactcagttggtgccgaggctgatgaagaaaagcttgagttcgttctggcggaactcaaaggcaaggacatcacagaagtgattgcatctggaagggagaagtttgccgctgtgccttcaggtgggggtgccattgctgtgggagctccagctgctgcatctggtggtgccgccgcacctgctgctgagtcaaagaaggaggagaaggttgaagagaaggaagaatctgatgaagacatgggtttgagaggtggggactaagggctggaggggtgggggggtgcggtg

SEQ ID NO: 61260 - DNA, 289 bp, Triticum aestivum
  Clone ID: PAT_TA_61260
atcacctttagccacacgcgctccggggggccgggggggctaaacagctcacttcacgacaggccatatataaagtgccattgcagttttgacaactctgacattgctttgggttttccttatccatttatctttcttatttgttcctaagaatatctgtatgtccatgttcatgaaccaacatgggtggagaaaacatgctcctatcagaatgctatcggtgactatatatattaacggacacataatattatacaatatggcgactatatactttttaatggtaacc

SEQ ID NO: 61261 - DNA, 454 bp, Triticum aestivum
  unsure (1)..(454): unsure at all n locations
  Clone ID: PAT_TA_61261
cccacgtttccgcggaggagaccgggggggacgaggggctgcccccgggaaccaggaggaagatgaaggacacgcagcagaagacgaggccgagcggcagcaccgcagccggcgcaggcgcggcgtcgtcggcgtcctccgtccgcgccgtgctgcaggacttcctggagcagcagcagcgcctgggggcgcagcggcattttgtttttgcgcggcacgcgcaggagcggctggccttcgagcagcagtggcggcaggagatgcagagactggagcgggagcggctgatgctctagctggcgagcctcaagaaagcagagagcagagacgaggcgtgaatgcatgttgggacatggtgatgaaatgcgtgtcgatgaagttggagctttgcatgaatttgcttatctttgtctgaaaaataaataaatttgcttatctgctcatgcaagcnnaa

SEQ ID NO: 61262 - DNA, 393 bp, Triticum aestivum
  unsure (1)..(393): unsure at all n locations
  Clone ID: PAT_TA_61262
accaaattaacaaatcaatcatccagggggggcggggggggggaaagaacgcggagggcagcggcaacccactgctgcgcaccaccaacgggcacgtcggccggcagggatgggagttcgatcctgccgcggatgaccccgacgagggcgccgccgttgatgccgcccgccgcgacttcaccgggggcggggaccanatgatttatcagctccnacctcctcatgcgcatgcaggtctccattctctctttcttaaagccaacacacagtctctagtactacctctgtttaaaaatttaagacgatttgggaggccattttagcctaccaaaacggcctgtattttgggatggagatcgataatacatgccaccgtgcacttggtggtcaggt

SEQ ID NO: 61263 - DNA, 580 bp, Triticum aestivum
  Clone ID: PAT_TA_61263
gggtcattcatctctcagcgaccttgggggcgggggtggaggttgttgttattgcaactggggctactgttgctcgtgacctccctatcaagggccgccaactcgagggtattcactacgctatggagttccttcacaagaacaccaagtctcttctcgactccgagcttggtgacaacgcttacgtgctgccaaggacaatcacgttgttgtcattggtggtggtgacactggtaacgattgtatcggaacctctctccgtcacggtgctaagtctgtcaccaacttcgagcttctgccccagcctcctcctgagcgtgccaacgacaacccttggcctgagtggcctcgcatttaccgcgttgactacggtcacactgaggttcgccagcacactggcaaggaccctcgtgagtactgcatcatgtccgaggagttcatggacgatggctctggcaaggtcaagggcatcaacaccatccgtgttgagtggaccaagtctcccagtggtggctgagacatgaagaaggacaagggctctcaacaagagttccctgctaacctcggcctgcttactatg

SEQ ID NO: 61264 - DNA, 445 bp, Triticum aestivum
  unsure (1)..(445): unsure at all n locations
  Clone ID: PAT_TA_61264
cctctctctccttttctcatgctgctgccgccgggggggggagccgagccanccccancaaatcgatgggcacccgctgccacaaactttgctctctactccgctattggggcggcgcgtggttgcgaagccaaaggggaaacggccactgcgtgccgctattgcggtaattgagtactgcaacgggggggcggancgctacagtgaagggctcgccattgcttgtgagcgctgcaatggggcgctcgccagcgctcccgacgctgcaatggggaggtcgtcggtgctgaaatggggcactcaggggcgctgcaatggggcactcgccagagccccctcccggggctgcgatggggagcgtgcgcgggctggaggggggcgctcnccngcactcccgaggctgcaatgaagcgctcaccggcgggcttggagctgcgatacagct

SEQ ID NO: 61265 - DNA, 421 bp, Triticum aestivum
  unsure (1)..(421): unsure at all n locations
  Clone ID: PAT_TA_61265
ccccgcttccgcttaacatcaaatagggggtgggggggggcctcctctcgatccatttcctcaccacaccaacacaacacaacccaccgggcctcccctccaacctccccaccaccccccttctctcccctcctcagctcccaacagcaagcatggacaagcagcaggtctttggttcctccgggggggggatgcctttcttttcggccaatggggcagccacggcacagggggagagccggccgagggcgcggcgcaggaggcggagggccgcgaggtgcggcagaggggacggtgacggcggggagatggacgggggaggggacctcaagaagcggcggctgaccgagagcanggcacaggctggagctgagcttccgggaggagcgcaagctggagacccggccggaagttcatctcg

SEQ ID NO: 61266 - DNA, 630 bp, Triticum aestivum
  Clone ID: PAT_TA_61266
gcgagagtgcatgccggcaccagcgcccctccccggcgacggtggccaccaccacctgcgtcgtggccagccccgttgcgtgcgccccctcccctccccttcccttcccatgactccggcgtgatcctctgatctccatgggaacctgcgccgcccaaattcgcctcacatgcatgtcgttccgtggggctggcggtgatccatgatccagtgctgttgggccacttttcctccgccaacatccgcggtgccgccaagccggccctgttctgtctcctcctccctttgggaggcccgtgtccgacaggtgcaggctgtcaacggtggatgtgccaaacctccaccccatcaggtggagagtttgatcccgagcagtgatgattttatttttgcctcctctgctaggaggcagaggaacggagagtggcggcaagggcagccgccggtgcgatgaccagaacccaggggtggacacacgggagatcgggtgctcgcgcgaagcctcctgcagcacggtcgcccacgagcccacccggagctgtcgtccccatgaagggcgccgccccgctgcactggtaaggaagctgtctggatgaaaaaaggatcgcgggctgaattcttacgaacata

SEQ ID NO: 61267 - DNA, 616 bp, Triticum aestivum
  unsure (1)..(616): unsure at all n locations
  Clone ID: PAT_TA_61267
gtccgcccacgctgtccgtacacagacaccacggggggggggcgcgtacagtgaggcaggtacacaacggaagccatgtcgccgcccgacagcggccgtgagaagggggactcnaaggcggcggtgaagccccaaatgttgacaatcaagggggggggccaggagaaggggggccaccacaccatgagggggggggagaagctcaagggcctcatggacgtgtgggaccacaaggggcccaacgtgacatatgggaccggcgtcttcctctacgacgggttgcgggtgcgcagaaatatgaccccggggggccttgagatggaggacggggacatgcttgatttctttgaacatatggatgggggagctggaccattcattgttggatctatgtagtatgtcgatcgatgtttgcgcactagggggagttgttgtaacttgaagcatatgtctcttgcaaaatttgtattgctagatcttatttcaaggaaatttctgacgtgagcgggtcaaaatattagattttttgaactagtttcgctcatgtattatcattattatctgggtntttgggagtgctcattantatctattttggcatatgggtgaacagggg

SEQ ID NO: 61268 - DNA, 398 bp, Triticum aestivum
  Clone ID: PAT_TA_61268
aaaaatattaaaaaaaaaaaaaaaaaaggggggagcgggggggaaaaaaaaaaaaaaaaaaaaaaaaaaaaaaaaaaaaaaaaaaaaaaaaaaaaaaaaaaaaagggggggccggttttaaagaacccaactttactaacccgggcatgcaacgtaaaagtttttttatagggcccccaaaattcaatgggggggggggggtttaatttttttttaacgggaaaaaccctggggttacccaattaaatcgctttgaaaaaaatccccttttccccagttggggaaaaaacaaaaaggcccccaccaatcccctttccaaaaagttgcccaccctaaatggcaaagggaacccccccttaaccggcccattaaccccggggggggggggggttaccccc

SEQ ID NO: 61269 - DNA, 563 bp, Triticum aestivum
  unsure (1)..(563): unsure at all n locations
  Clone ID: PAT_TA_61269
gtccgcccacgctgtccgtgngagacccagcgaggggggggcggggggggacatctactatgccaccgagcaacctgagcagcccatgggcactctggagatgtgcatgactgggctcgacaagaagaagggctctgtgttcttcaagacttctgctgatgggcatgtgtcctgtgctaaggagatgaccgggggctctgggatctctgacatcatccctgggatggggggctgtgacttcgacttcgagccctgcgggtactccatgaacgccatcaacgggtctgccttctccaccatccatgtgacccccgaggacgggttcagttacgcgagctacgagggcatgggcatgggcgcttcnggcctgggctatggggacatcgtgaagaggggcctccggtgctttgggccttcanaggtctcagggggcggcaccatcgtgcggtggccggggccatgccggcacctggggcaagaagctcnacgccgagggatacgactgcgacaacgggtgggagcangagctcnctgggggaggcgtcctcatctaccanagcttt

SEQ ID NO: 61270 - DNA, 177 bp, Triticum aestivum
  Clone ID: PAT_TA_61270
gccgccatctcgcccaccctacccgaggtgacccacgtggggagtagcgcgagggaggcggtcagaggccgaaagatttggatcgatggagatccgcgcccgcgcgcccggcaagatcatcctcgccggcgagcacgccgtcgtccacggctctgccgccgtcgccgccgccatcga

SEQ ID NO: 61271 - DNA, 360 bp, Triticum aestivum
  unsure (1)..(360): unsure at all n locations
  Clone ID: PAT_TA_61271
cggccccgctcggggggggggggaggggcagaaccagaccacgcgccgacgcgcccaaaaccatgcaactcggcgaccgcgaggatttctttcacggccgtcttctctccctacgcattcccaagtttctgccatcgttccggcgatgcatcctacaagtggtacttgnccgtnggagggcatgcatcatgtgcgggcggcggggcggccggtcacggcatcgtgcgaagccgtgcgaagccgtggcgcgcgcgcggtgggcgtcaaaccgatggcccggcggggtgttgctgtcnctaggaggcggcgtgcgcgccggcgtcgaccgcggcgcggcaaaacgggcaggagtgcgaggcg

SEQ ID NO: 61272 - DNA, 624 bp, Triticum aestivum
  Clone ID: PAT_TA_61272
gctcctacgtcgccggcgagacgggcggggccgtgggcgccgcctccatggtcttccgcaagtccaacccgcactacgcccacctcctcctgcaccacgcccagcagctgttcgagttcgcggacgggtacaggggccagtacgacagcagcatcgcggaggtgaagagctactacgcgtgggggggggggtacaaggacgagctgctgtgggccgccctgtggctccaccgcgccaccggcaagcccggctacctcgactacgtcgtcgacaacgcccacgacttcggcggcaccggctgggccatcaccgagttcagctgggacgtcaagtacgcgggcgtccagatcctcgccgcaagactgctgctgaggggagagcacacggcggagcagaagaggacgctggagcggtaccaggccaaggcggagcactacgtgtgcgcgtgcctgggccggaacgcgcaggccggcggcgaggacgccaacgtggagcggagcccgggcgggatgctctacatccggcagtggaacaacatgcagtacgtgaccaacgcggcgttcctgctgtccacgtacgccgactacctggccgaggccggcgtggagacggggacctgcaccg

SEQ ID NO: 61273 - DNA, 572 bp, Triticum aestivum
  Clone ID: PAT_TA_61273
gccttgtactgattcagtcatttgggggggggggggagggtcgtcgttgactctgtgatgggactctgaatgcaaaaaccttttaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgcgcgtgtgggggggggggacccattttttcgtgcccccaaaatcaaatccatttctattttgtaacccaaacctcaaaacagtgacacgcctcgcacaaccaaaactaatggaaaaagcaaaaccttcccctttccaaacttaattggaataaaaacaatttcccctttgggcggtattaccaaaaaggaaaaagcccaaacggttacccatacccaacctatcctaaatcataaaggggaatggcacctgccccttacaataaacattaaccggtagagttggtaacgcccaaccgcacggttacttttaccattgccctacccccaacgccctttcctttcttttttccctttaacttcaaaaccgcgggctccccctttcccccccaaaa

SEQ ID NO: 61274 - DNA, 483 bp, Triticum aestivum
  Clone ID: PAT_TA_61274
atgtgttacaccagaagaacatgtgggtgacgtgggcgtcggccaaacaatctgatgcagagaagtgtggaagtcacaacaaccaaggatttctcaggggcgtccaaagggcatttagaggctgttcagcaacaggactcaatatactcgttgctctttgcatggttggagttgctgcagcaatagggggccatggacgtctcctttgtgggatcagtttgtagtagagggggatcagaagcgtgcctagttttagctgtacaaatctgtagcatctacgcactgtaatcttgacagtaggcactgtgattgaagtggatgagcgatcgagcatgtggccttctggaggtacttgtcgttacacgtaatgtgtgctctggtgcaggacattgattcccttatatctggtttctgcatggtgtttgtacatatgaagcccttgctttttgatcagtgtggctagtattatggtgatggatgagt

SEQ ID NO: 61275 - DNA, 711 bp, Triticum aestivum
  unsure (1)..(711): unsure at all n locations
  Clone ID: PAT_TA_61275
atattttcaggtggtcgttcgtaggaggggggcgggggggggacacatcatattacatgtgaacactgatatctttgaatggccttacatgtggacacaacagcctgaacttaaatagtacaatctataattgtagctagcacatcaacaaacagccatgtgaaaacattagtttgctgcctttagggcgttttttggagccgtaattcttttatagcatttccttgcctttattgctttgaaaaacaccattgatcataagctgattgcggcagcagggtcggatatttaagcatacctaggatatttatattttagttggcaaatagttatgccaattttgtgatttatctatttctttcacctttggtcataagctgattgcggcagcaggctcgagcttgtgtgttaatcaaaaaattaattaatccgctaccggtgagaaatgtctccggtgtggtgcaagttaatatattctgtacacataaatagttaacatagtctgtacctgcctcttgggtgattttgtgagttgtgatagattgctcctgatgatgcctcctctacagatttctaggattcaaggtcccctgaccttggccaaggactatgacatggagtgacctattaatggtgntgacacatcttctctacatttatcctgtataagcttcggtgtcatactttatttatatacacacatatacccat

SEQ ID NO: 61276 - DNA, 178 bp, Triticum aestivum
  unsure (1)..(178): unsure at all n locations
  Clone ID: PAT_TA_61276
ccccanataacggcaatccatccaggatgtttgggggggggggggaatacacaaccccagcaggaacccccccccctatgccaaggagggcgatactgcggagggtacgaccggctggacgaggagggggagttcccggtgcctatgggccaccttcctatacagaacctcccacact

SEQ ID NO: 61277 - DNA, 150 bp, Triticum aestivum
  Clone ID: PAT_TA_61277
cccactcgtccgcagcacaaaacaagagacctggcattccgataccccagtaattgtagggctgattcacattggtcaactgcagctgtgactcgagtgtgatggcaagcttcactggtaaaaaagcaatgaaaaacaccccctgaattg

SEQ ID NO: 61278 - DNA, 587 bp, Triticum aestivum
  Clone ID: PAT_TA_61278
ttgatgatatcccactatggtggggagaggtgatgcgggggatttccgggtgcaaaacctggcaaccaactagatccgcccctggatcacgtattagtgttcaagatctggatcaattgtatgctcccgtagtgtgtcatcagccgttctatcgattcttgcaagagatttttatgtttttttgcggggcggagattattctgttcctacagttggacatggcatcatctgctaccatcagttcagttggcgctcaggctgctctggtttcaaagccaaggaatcatggcatcggtggcttaaaggcgtcctcatcaattaacttcgaattgggatcctcgggcctgggcaagaccgggtctcttctggcatctgttaccacaagggttgtgcccaaggcgaagtctggggctcggatactaccggaggcatcttacaaagtggcggtacttggtgctgctgggggcatcggccaaccattgggcctgctgatcaagatgtctgctctggtctgggagctgcgactgtacgatattgcaaatgtgaagggaggcggtggtggtctgaagcactgagacacaccttgt

SEQ ID NO: 61279 - DNA, 378 bp, Triticum aestivum
  unsure (1)..(378): unsure at all n locations
  Clone ID: PAT_TA_61279
cacatattacgtgcaagtttgagggggcggatggcgggagagacaacctgaagctggtgggcatgtgggcgagccccacgtcctgcgagtgcagctcgcgctccgcctcaagggcctaagctacnagttcgtggagatggagggggagcaaggcctcnagaaaaacaagggggagcgggggcgcctcaacagtaagctgccggggctgatccatgggggcaagcctatccgggggaagtcgttgagcatgatacagtacatcgatgaggccttcgttggcgccagcccctccctcctcccgggcgacccctccgagcgtgccatgggtcgctactgggctgactttatcgatgacacgcttgtgaaggcgatgcacat

SEQ ID NO: 61280 - DNA, 728 bp, Triticum aestivum
  unsure (1)..(728): unsure at all n locations
  Clone ID: PAT_TA_61280
cccacgcgtccgcccacgcgtccgcgcggcggggggggggctcccaaaccctagctcccaccgcagtggccaccgcctctcgacccccgcccctctcccggttcgccgcccgcttcattctcccgcaccagcgatccctctcccctgcccgtctgctcgctgaatcatccgcgcgtttgagggtgggggcgcgcctgtttttgtatacgagaagcggctgaggcgaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggatttctcttgccacacacaaccactgatcaagagcttcagcatctgaggaactgcatacctgatcaagtggttgttcagcgcatcgatgagaggctgtctgcccttggcaattgcatatcctgcaatgaccatgttgcgctcacacaccctgaccttgacaaggcaactgaggagcttattgcagatgtgcttggggttgaggtgttccgtcagacgattgcaggaaatatccttgntggcagctactgtgcattctctaacaggggtggactgggccatcct

SEQ ID NO: 61281 - DNA, 268 bp, Triticum aestivum
  unsure (1)..(268): unsure at all n locations
  Clone ID: PAT_TA_61281
cccacgctgnccgcgcgtcgatccgctgggtggggagcgacaccgcccccagcgagctcttgcgtactatgagcagggagttctcggccatggtcgccgcagcagccagcgctaacgcctcgtcctccgccgcggcgggccacagggagagcgtggaccgcgcggcgaacgangacccgctgtttagtatcggcnantattttttttatganacnaacccnctgnccatcgtgccggacagnaacccnatgccgaaaacgcgccgggg

SEQ ID NO: 61282 - DNA, 630 bp, Triticum aestivum
  Clone ID: PAT_TA_61282
cccacgcttccgcccacgcgtccggggcgggggggggcgagattcttccggccatctttccgcattgctttgttcattcaagcggagaagccaacgagctcctcctaggccccagctggcgcgtgggcccgacctgccagcgacccaacagcagccgccttgactcttcttccttgttggattgcgggggcgtgtgcgtgttctcttgctgttccttgacgggctggagaagtacgggcggggggactggaggaacatctcgcggttcgcggtgcggagccggacgccgacgcaggtggccagccacgcgcagaagtacttcatccgccaggccaacgccgccacgcgcgactccaagcgcaagagcatccacgacatcaccaccccttgaccacccaaggcgacggcgacgcactcccttgtttaatcagtcgccactactcccacaatcttatcctagtttacttacatgacgacgtgtacattatatcctactactaccactagtacttagacttagccttaagaagactctgacgaacagcttggctcgggcggacggaggctgtggctcccggccagcaaatggtttagtgtctagctagattttaccatcacggtggaacaact

SEQ ID NO: 61283 - DNA, 293 bp, Triticum aestivum
  Clone ID: PAT_TA_61283
ggtggttatgacaatgaagacaagggtgggagggggggggggctgtctgctctgaaaattggggggccatcgacgcacaccaatttcccgggatgcatgacaacatgacttgggtcatggaaactaaaactgtggatgtgcattttcttaatgtgaagtactccagattagtggaaaattatggagagggggaggagatgtaaagcatgacaagggaggaattcgttgcacacttgagaaggtaaaaaaaaagcaggagccatttttcagtctatgatttttcagtttaggtg

SEQ ID NO: 61284 - DNA, 198 bp, Triticum aestivum
  Clone ID: PAT_TA_61284
ctaggtttaagagtactgaactttggggggtgggagggtgcacccatgtaatacagtagttttctttgcacctgttatctttgatgtcaagttaagtgtactccctgttcaaaaataaataaaaagtgtactcgaacactagcttatgtttaaaaaaaaaaaaaaaaaaaaaaaaaaaaaaaaaaggggggggaaaaa

SEQ ID NO: 61285 - DNA, 335 bp, Triticum aestivum
  Clone ID: PAT_TA_61285
atttcagatggaacctgagcttatcagtttcagatggaacctgagcttatataagggctttgctgcttgtctgcaccaggagttgctgtgatgataccgcgacagccgtgacttagaagaaggcatagtgattaaataaataaatatgttcatagctaggaatttggtgtgttgtggtttgctcccgttgttctaggattgacatgcttgtaatatactgtactactaattagaggatgtttagagacgattaaagggtatgcaggcacaagaggcggctgttgcatgtgtcctcactctcgtggatttgtgtgatgatgacgtgatggtttatt

SEQ ID NO: 61286 - DNA, 287 bp, Triticum aestivum
  Clone ID: PAT_TA_61286
ggcttgggctgggcggctgcgacgtacgtccgggtgggctgattcccgtaagtttagaaatttgttgtgaggcagacgtgttaattcccattaattgtggctaattttctgtagttgattggacgcgaacgcaaagggtggaactgtttttttttttcgggggaggtgcaactgtttgatcgatggcagagtttcgtccgctcatgtaaatcgctaaacgtacacaggggaggtctgacttttatgtggacggttagatgcctgatcctggagatggtaatttgtct

SEQ ID NO: 61287 - DNA, 643 bp, Triticum aestivum
  unsure (1)..(643): unsure at all n locations
  Clone ID: PAT_TA_61287
ttcttcctcctctccttcctggaaggtataccgtaccccaagaatcgcgcaaaggaccaccgctcttcttcctccagaatccagctgctgctgctgctgctgctagtggtagtaaccaactgagcgcttcttgatctgttctggtgtccgtgtacatggagatgcgatgggtgcggaggtagctgcgctgtgctgagtagtaggtgagcagtgagctgcagctagcggcgagcgcgggggaaggagatcgatggaggatctgtacagcatccacccggggatctcgcgcggcggcgagggcggcgcggcctgcagcgaggcgtcgggggtcgccggcggggccagctctcctccgccgcctccgccgcctgcggatctgacggagctgatgaaggcgcagatcgccgggcacccccgctacccctccctcctctccgcgtacatcgaatgccgcaaggtgggcgcaccgccggaggnggccgcgctgttggaggagatcggacagccggagaggcgcggcggaggcgccacagccgccggggagattggcctcgaccccgagctcgacgagttcatggaggcctactgccggctgctgtcgcgggacaaggaggagcctgtcccgncccgttggacgaggccg

SEQ ID NO: 61288 - DNA, 110 bp, Triticum aestivum
  Clone ID: PAT_TA_61288
gccagcatccaggagcacacgagaggagacctgcataaatcacgggaacaaaaactattacccaactagatccctccctggagcaaacattatagggcccgacctggacc

SEQ ID NO: 61289 - DNA, 165 bp, Triticum aestivum
  unsure (1)..(165): unsure at all n locations
  Clone ID: PAT_TA_61289
tccggcccgtttccgccgccgacgagagggggggaggagggaagagaggcagaccaggcccaagaggaagcgcccaaagaagacgcagaagaaccaagnaggcgccgcggagcagcaaaagcaacaccctacatccaggcagccaggcaccgagggacgacggca

SEQ ID NO: 61290 - DNA, 498 bp, Triticum aestivum
  Clone ID: PAT_TA_61290
cccacgcgtccggccgccaccggcgctgccgcgcccgcgcccgcggccgtgcagccgctgcggcagttcaagctcgacccgcagagcgagctccgcgtggaggtgctcccggacgcgaccctccgcgtgcgcctcgtctccggcacggcggagatcttcggcaccgagctcccccccgagggctggctcaccatcccgccccgctccaagatcgccattttcacgtggcacggcgcgacggtggagctggacggtgtcagcgagagcgagtacacgtacgacgagacgccgatggtgatttatgggaacacacatgcgattctggacgcacggagggtgagggccagggcagtatatggaggtgacttggaggcctcacagggacctatagtgattgttgcgaggccaactgattctggaaaaagcactctgggcaaaatgctatttaagtggactgacgaactgggatggaaggctacgtatggggatgtagatatt

SEQ ID NO: 61291 - DNA, 685 bp, Triticum aestivum
  Clone ID: PAT_TA_61291
ggcctctgttgtgaggcaaatgaaagattcagacatggcgatgcagtggtcgctgatataccagctaaccagtagactccgtgtcatcttccaatccacaccgtccaatcggcttctctttgagtactctgcaacgtcgcaggattgatcaattttctgtcattgcacagagctagggctgctgttttagccaaaaggttccgtgtcctgatcaattgtttctgtagataaagcaagtattggcaagctacagttgctgcgtttttgctctttgttggtagctactccgtatattctttctctcggaaacaaagtttctgaggttgtacatacgtagcaagttgatctctctctctcttagcgtcagagatgtaaattaacaccagtataaaggaatccagagttttccgtcgtcttggttgcatggaattctcttatgtggctaacaaatgcactccctctgtaacgtttatgttagtttacagagggggtagcactctagcaatgttcctatcacacgtaaaggaaatcggttgacaatttgccaggtctaacttatcactagtagcagatcgcttgttttcattgatcatttgcatattcgaagttccaagctccattggtacaatttaatctgtacagaacttgtgctgaacaagggtcacggtataaagcattatcaggt

SEQ ID NO: 61292 - DNA, 592 bp, Triticum aestivum
  Clone ID: PAT_TA_61292
atcctattcctcagcacgattcccgaggacttccggcgcccggcacgagaagagcggacgagaagaagacgatacactctgcccgcagacctacatacacaaattccccgtaatgattgacacgagcaggaagggtgcttacacacacacaactggaaagtcctctttatcgcaaaaatgagatgaagatgctcattcacggacactaattacactgcaaataacaccattctataaaaactacagctagaaaaaatttgaaatattatcattacactgcaaccaaatgttgaaactggagacaaccagagcctcacatataccagactttatgtgcacaatatataaaactaaatatccagtttttaagaactagtttcaaaaagccccagattctattctgctttacaaagttctgacagcatagcatacctggttatgcttgataaagactcaaccggaactttaccgaggttcttcttgacaatactggactagtgatgatcagatacacagctgataccactacattcttattcgctaatgacatccctaacgcacttgaggtggattctttgcactagcaaacctg

SEQ ID NO: 61293 - DNA, 614 bp, Triticum aestivum
  Clone ID: PAT_TA_61293
gccacattatacagggctagattatgaagaggtggggagtcctggaaaccatgaagaattggtttcaatcaagaagtattctacctatgataatatccacaaggatggcccttacccagctgtgtttgagacatcatcacttaatacatggtcaggtgtatgggaagcagctaaatgggttgcagaggggcgagaacttacttttatgatccaaagcggtctgtaattcttaacttgacaacagatgttgcggaagaaagcaagccatttggaaaccaaggaattagcaaccgaaactgctttcctaattaaaatggtgaacaatacctgaacaacatcctttgcctttcagcttccgaaattgatactcaaactcaatgatacagcccatgagtgacatgtgctatgacagcagacctccatgtctaacgagatctgatgattagcccatcgattggagcttatatcagatgatctaggaaaaccataagcacatattcctacattatatgagatagctgcccactcgagctatcttaaatggactgatctactgccaccaccgacctggtctgccacgggtctaccaattggatgaagatagaataggatca

SEQ ID NO: 61294 - DNA, 505 bp, Triticum aestivum
  Clone ID: PAT_TA_61294
ccacgcactcgcgcctggaaagcgcgaggaggaggagcacgaagcgggggctgaagaggagcgacccgcaacgcgcagagcagcggcggccacagaaggcgcgcgggagaggaccaagagaggagcgtggtgagggcgatgagctcgccgacccgcaacatccggactaggaggcgaagccgcagcgctgctccaatggcggctatggcggacatgcccgatgctacttcgggtctggggcgcggtgagagcacgtggccaccagcgaggttagccgcggtacgcaggacggcgggcatgcactgcacgtggtgggcctaaccagaaaaagaaaggagagatagagagattaaaggctggcagtgggccttttgctgccaaaaaatattgccggcgccccagctgccccccgattccctgggtttgccttgggtgcgccagccgtagtttttgttaaatccagcgcaaaacgagcctgtgggggtgtgattggaacacttttttt

SEQ ID NO: 61295 - DNA, 283 bp, Triticum aestivum
  Clone ID: PAT_TA_61295
gttggcctaaacttaatggtggttggctgctacctacaatctatagcatgtatgttacgttctcatttggtggtgctaatccaggatgaaactgatattttgatttgtgagccttggtatgctcgttatgtcattcagtaggaagaaagcattgcgctgctattaacttgcccctcctcatgttattgacacatatattggaactaagagagtgtgagatcacggcatcgtacaaatgctttgaagtgagtagtatttctgtgcacactgtctttatgttctg

SEQ ID NO: 61296 - DNA, 175 bp, Triticum aestivum
  Clone ID: PAT_TA_61296
cccacgcgtccgcccacgcgtccgcatatttgatgggtgctgcaaatgtcagaagtttgtgcttgctgtttttcctatgttcctggaatccatttgtagctcagatggatctggtgaggattgtatgagttcgaattcggttgaattgaactgacaatgtgtgattgcgcttttt

SEQ ID NO: 61297 - DNA, 286 bp, Triticum aestivum
  Clone ID: PAT_TA_61297
tctggcacgtagagcaggccgttggcgagtgtgctggccaagtttgctactcctacatgcatggctgagttagttagctagatgagctctcctaggagtggatgagtacgtgcggttagtggccggttgtgaggccgggtcctgcttaggtgcataggttagtggccggtgtggcctatgagctgtgcgcgtgcatctactatttaagtgatgtgcttgtgcctgtagccgtgaggtagttgcgagctggaataaagggcgtttgagcgccggggcgttggtcgcc

SEQ ID NO: 61298 - DNA, 762 bp, Triticum aestivum
  unsure (1)..(762): unsure at all n locations
  Clone ID: PAT_TA_61298
catggagttaaaactgctcattatagatagcaatggattctactctggaacggagggagtatatgtgtaagtatttatgtgataaaactaaaagggcatatgaccaaaagatagtggcatgctaacaactccgagtttactcggagagcaccacatgatggccttactaatttaagtatgtaagattcggcaactcatcttcagtctgcgcttcatcggttacaagagcgccaagagggttgctttcaccattgacatgacagacctgagccgcgcggtgtacccttctgagccatcggagctgccgatcaaggtgtggcaagctcagacaacactgtcgcagccaaacctggacaagctgatggcctccataagggacgaccttcagccggggcgtgtgatgatcctcaggctatgccggatggtgtcccagctggttaacacattgcctgtcaggccgccaagtgcaagctgtgcaggagatctgatcatctgatgggataccaccaccttctgtaaatgccgctctcggagctgaccctcttcctgaacgatcttgagtaggtattgtgctgcaaatggagtagcccagtgtgctcctaatcctcctggttgtgcgagcatcttgtatggagtangagtttctttgcatgctgaacgaatggcacctgacgcgctgncaagtgaagctgccgtgggtgatataatttccgtgaatcttcgtcatagaaatacaagcaactagccagaaattacggtctg

SEQ ID NO: 61299 - DNA, 636 bp, Triticum aestivum
  unsure (1)..(636): unsure at all n locations
  Clone ID: PAT_TA_61299
cccacgcgtgggcatgacatctatgccttagtgttcgcgtgcccgatcgcaccaagcgcgggagcacacgccgccatgcacaagcgcgtgaagggaggatagaagctgaacaacgtacggatgtgattgtgtctggcggaggcaatgaggttgaactgcgtccacgacagcgngcgccatgatcctgactatcatatgcttgacagatatgaaggcaaggctcagcggcttgcttcgtgtgtgtgcctgggagatgcacatgacaacagtgaacaacgcgatgctccaccagcagatgacagggaaggagggagtcatgccgcgccaagggacggatgagaagacactggaccgtgaaaagaaaaaatgttgagccagaagatatagaagccaatgccatagatgctgaaactatgggtactagcagttctaaagaaaaggaggtggtaaaagggcaaagcctagcccagtttttgaagcatctaagaagacttctgctacacatgatagtccagcaaagaacacaagaagtaaacaatgtcctccatcaaagagcacaagaagcaaaaagttgtgaaccttcctgtgcaactacatgctattgtggggagcaccatgccatatgggaccttgcta

SEQ ID NO: 61300 - DNA, 639 bp, Triticum aestivum
  unsure (1)..(639): unsure at all n locations
  Clone ID: PAT_TA_61300
gcggctccgcccccttgccgcagattcgcggcgagaggggaaggcggaggtttccgagccggcggagcccattctccggtgagttttccggcggcgtttcgaagccgcaggtagacgcaaggcacgatcttgcggctgccccccgtcgaattcttgccgggctatatctgaggattgaaggtcgcgcgaggctaggcatttccaccgcgtttcttgtgcagatttcgtcgatttcttggcgctgctgccgagaatccggtgttgaacagcttgcggtggacgaaaggcaaagaggcgatggactactacaacatcctcaaggtgaaccggaatgcctcattggaggacctcaagaagtcgtaccggcggctcgctaggacctggcaccctgacaagaacccgactggtggcgctgaggctgaggccaggttcaagcagataactgaggcctacgaggtactaagtgatccagaaaagcgtgcaatttatgaccaatacggtgaagaaggtttaaagggtatgcctccacctggttcgcanagccggaccggcacagcttctggctcaagtggtccaagtaatttccgttacaatcctagtgatccagatgatatctttaatgagttcatggcgagcaac

SEQ ID NO: 61301 - DNA, 686 bp, Triticum aestivum
  unsure (1)..(686): unsure at all n locations
  Clone ID: PAT_TA_61301
ggatcagcagggtcgccacgtccctcgtcttgctgatgctcttggttggtaccactggtctagcggtggtgatgtcggtattctcagcaagtaccccatcaccgcggattacggtgtcatcagcggacctgcccgctctggtggtgttaagattgctcttgatggcaccaacaaggagatcaacttttttgtcgcccacttgggttacactccctatggtccttacgacacatgctttgaccactaccctgttgacaagatcatcgagcgtgaggctcagtctggtcgcactcctcagatgaaagctacccttgctggtatgaagagtcagcttgacaatgccgacgaaatccccaccttcctcgtcggtgacttcaacgctccctctcaccttgactacaccgaaggtctcaaggacaagaactgcggctactctgacatcaagtggcccacatctgttctccccgaggaagctggtctcattgattctttccgtgtcgcccaccccgatcccgtcaaggagcagggcatcacttggtctcccatttacatctggaacggtggccgtcgccgacctgagcctcttgaccgtattgactttgttctgcacaagggcaagggtctcaaggtgactgactctcagactgtcgtcgntggcgagcccaagcctcagcctaaccacaaag

SEQ ID NO: 61302 - DNA, 563 bp, Triticum aestivum
  unsure (1)..(563): unsure at all n locations
  Clone ID: PAT_TA_61302
cacgaggatgagggggctgggcaggcacgtctcgccgaggcagatggcgctgctcgccgcagggtaggcaagaggcgttctgttggtctctctcgttgctcctccagtcctccgtggtttgattaatcatcaaatctgggtggttgctgtatgcaggctggtgttctttggggcgacgacgtacgacgtgcaccgctccatcaagaacaacgaccagcccccgaccagggaccaggtggccgcgctccaggacttcatcgactccaggaagcgctaatttggattttgggcccgccgatgctcgatcgattccccctgccggcggcgctgtgtgatctctgttctgtgctgcgttcttctgaagcaataaaagcggccatggatgtgtcgacagtattatattccccaaaggaggaactgactagtgcgtatggaatctgtacactaaggaatggcttgtattattagttgtgggagttgngatcatctcgactctctccttgaaacagctagctataataaactgctgcaatttcataaaaaaaaaaannnnnnnnnnnnnn

SEQ ID NO: 61303 - DNA, 186 bp, Triticum aestivum
  unsure (1)..(186): unsure at all n locations
  Clone ID: PAT_TA_61303
gttgctttctcttcttttaatttattcagaagctgtgactcattctagtatggcatgtttccaaaatattcggcatcaataacataccatactgcatctccagttttttctgccaaatgttatctcgatcctcgggggaattttttttaaaaaagaggggggggggnnnccccccggggggggggg

SEQ ID NO: 61304 - DNA, 743 bp, Triticum aestivum
  Clone ID: PAT_TA_61304
cccacgcgtccgggacgccctgcggagcgcggcgcggctcgccggtcatctcgtggaggccgtcgacggcggggtgcaggagctcttcgtcaacgagaagcgcatcgagctcgaggcccgcgcgctgctcgggaccatcgcgcggtacaggaagcagagcgaccagtggctcgccgccaccaacgcggtcaactcgatcctcaaggaaatcggagactttgaaaactggatgaagatcatggattttgactgtaaaagtataaatgcagccattcgtaacattcatcggtcatgattttgtccagcgcctgcaactatgatgctatggagatcataggttgtgactgtaaaggtatcaatgtagccatctacttcctccgttcctaaatatttgtctttttagagatttcaaatggactaccacatacggatgtatatagacatactttagagtgtagattcactcattttgctctgtatgtagtcacttgttgaaatctctagaaagacaaatatttaggaacggagggagtataatatttctcagtcactatgatgctacaaagtgttcgctttgttctcttctccgttggattttttttccagtcatgatctctctggtatagaatcaattaactggtgtgtttgtacacattcagaaagccaactcttaccaacttttgtactggaatgctaccttgcattctcgagttctggaatattgatgatatacatatattctg

SEQ ID NO: 61305 - DNA, 772 bp, Triticum aestivum
  unsure (1)..(772): unsure at all n locations
  Clone ID: PAT_TA_61305
gacaagggtcatcgtcgacgtccacgcccacgccaccgccgactccgtccaagctacaccttctccaagcaggcgagtgcacgtcgccggcgcccatgaccgatcacgcccagacgcacaggccggcggcggctccacggcagcagctagcagccaccgtaaagccctcgggtggctcaataggatacctacagtcgaccgttgcggccggcgagcatcatcagcaggagggagccgcggcgttgctttaccagcagtactccaagagcacaaacaccttcgcgtccacgtactcgctgctcaacctggtgaacgcggcctccatgggcgttgcctcggccgcggccatcgatgagctgagcacgctggtgggccacggcgcggcccagctgccgtcctaccacagccccgcgtcatccggcggccaccacgaccacttcgtcgttcccctgccgacgccgccgtcgcagccaataacgccgctggggacgctgccgatgtcgctggccgccatctcggacaagatctgggactggaacccgatccccgacgcggcggtgggcagagattacggtggcgccagcttcaagtgacggatcaagagggaagcgcctgcgcggcaacagtgtatgcacccgtgcatggctagctgtgcaattaattggtaccactccaccttgtacaccntcctctttctctctctcactctctcctctctctctccacagttattattcttctgagtaaacgaacaattagaccattatagcat

SEQ ID NO: 61306 - DNA, 571 bp, Triticum aestivum
  Clone ID: PAT_TA_61306
cccacgcgtccgcaggttgtctccattcgtggactacatggactgcttcgactccgacccacatgcactcgggatgtacatggtacaacagctcaacaagcatcaaggatttgtctattgccatatggtagagccgcggatggccattgtggatggtcgcaggcagatacctcacgggctcctgcccttcaggaaagcattcaacggcacattcattgccgctggagggtatgatcgagaggaaggcaacaaagtggtggccgatggctatgctgatcttgttgcttacgggaggatctttctggctaatccagatttgcctaagagattcgagctcgactcacccttgaacaagtatgaccgcaacactttctacactcaagatcctgtcattggctacacagattatcctttccttgaaggctcgaatgccgagtagttcacccacccgacttgaattagtgatatgcttgattttatgaagtatgtgatgatttattcaatgtgtgtatgcacggggcatgtgcattgttatcctttccaccaataatttacttttgttctcccatct

SEQ ID NO: 61307 - DNA, 653 bp, Triticum aestivum
  Clone ID: PAT_TA_61307
gtgggagaagagcccggcgtggcggtggctggtggggcggacgcgggactccaagcccttcttcttcaccttcgccgcgctctgcggcgtcgtccccggcgtcgtcggctacggcgtcatgcagctcaccagctcccgcaacgacaagctcgaggcccacctccgctccaacgcccgaccagagaccacgatgatgggacaaatcaatagggagagactcgcagagtttctcggtgagatacaaaggaaggagaacacaaatgacagatacgtcgctgctcttaaaggggagacactgacaaggaagcgctatgaacgtatccagcccgtcccccagcaagctgcacaggagaatgcgaaggaccagaaagctacccaggagaatgccaaggcaaagtgattggtgcatggttgacgaccaggctgaaatgtgcaagtgaacataaatgagctgtagctccaaaagcttcatgagttgcggaactcttttttttttttgtaagcgtcattatctacctacctgcctttgatttaatcatggcactgctccatacaaaaaactgaaaaacttcaaagacagtgttgaatcatgtaaatgttttacgcgcctgttacgtggtagtaatattttaggaaccttcacacttgagtcg

SEQ ID NO: 61308 - DNA, 724 bp, Triticum aestivum
  Clone ID: PAT_TA_61308
cggacgcgtgggaaaaaaaaacgtttcatatgattgttgccccgcacgagaagacgagggttcctctgccgccgccgccgcgcccacatcttcttatccccggtgctcgtcctctccccgccgtcgccgaatccggatgagatcggcaggatcggctgcatctcgcgcgacgcccggccactgtgctcggggagaagggagaaagtaggagcggtgctgcgacctaggcagcaactcgccaagccgggcggtggcaaacgagagcctcagcggttggccgtcgaagcagaggaagagaggagctccagccggatgcgagcggaggacaccgatggctctcggcggccatcgacgggaacttgaatgccccagcccccaaagctcgcctcatcttctaccggcaacaggggacggcttccctcctggcacccgtaggcagcctcggctcaccgccgtcgggatctggccaacaccggctcctagcgttgcatccatcagtcccggatctcgccactgcaggatgcggggaagaggatgaggtacggcatgcaacaacgaaagaaggtgcagagccagcgactggattttttttggttaaagaaggtacagggcaacgactgtatttagatcataataggatcggttcgcattggtggcgcagtagtgctgcgtaggcagctgctaccaatcttcaccatgctggatgaagccgtcaaggaaagca

SEQ ID NO: 61309 - DNA, 756 bp, Triticum aestivum
  unsure (1)..(756): unsure at all n locations
  Clone ID: PAT_TA_61309
gcgctgcatatcgtcggcgactttgtcgcgctcatcgactccctcggccaggagcgggtcttcgtggtggggcacgactggggcgccataatagcctggagcctgtgcctgttccggcctgacagggtgaaggcgctggtccccttgagcgtccccttcatccctcggagcccggcggtgaagcccgtcgatgctgtcagggctctctacggcgacgacttctacatctgcagcttccaggagcctggggcaattgaagcagaattcaaacgccttggtacggagttggtgctaagaaagtttttcgctgatcgaactcctggcccactgttcatcccgaagagcgggtggggctcaccagatgatgaggtgcccttgccgagctggatcacagaggaggacgtcaagtactacacgacccagcttgataagtctggtttcaccgggggattgaactactaccgggccctgaataagtaataaagttacgcttactttggactattttcctcttgagctttttttacctaattatgaaggcctaaacttgaaatttgatccaaagcttaacaaaatgttttctagaaagttataggaaattttctagagaaaaagagactagatttgattcaaagcaaatatatctacaatttttggaatgctctatataaggtncgaaattctaaactgtattttagatatgaccaatattattataaaatatanaatatacagatttttggaaacactgattac

SEQ ID NO: 61310 - DNA, 777 bp, Triticum aestivum
  unsure (1)..(777): unsure at all n locations
  Clone ID: PAT_TA_61310
ggccgctgtcgccggcgacggcaacgacgcccgcgtacccagccaccgctactgctactgctaccgccaccgtcacctcggccacgcccgggcgagcgctcggttgtggtgcgcgtgctgcgggactacggctcgatcccgaagcgggagcccttcagctccagccgcagcatcctcgacgagttcttcaagcaggagaagcctctcgtccagcgcaccaaggaccacatcacagattattgcacgacccttgagggtgatgattgctgcagctgctgggatgcctattttgaactcaacaaactcgagcaagagctaccgcaagaagaaatttcaaggatggtgaaggactcgcggtcagacccgaggtaccttataagcagcatccaccaccggtcagacctacggaagaagatggccgagaaagctcacaattcggcgccatcaaactccccggggcaaacagcgaagccgaggcctttccccgtccccgacgggctgccgaaaacgcaggaagagatcgacgaggatgaggaggccctcatgccggagtctccttacacgaggctgctcagaaggatggggaggtttcccgactggtatacccctcgcccagaccatgagaccgactgaatcacgccatgaaccagccttgccttccagatgtacagcctgaagctctgttctcctggcatcgagcatggaaccttgnattgcctgttgcctgcttagntggntnttgctgagtggataaatggaactatgtaatggtgcgta

SEQ ID NO: 61311 - DNA, 618 bp, Triticum aestivum
  Clone ID: PAT_TA_61311
ccgaaccgggaggaacccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttggcctgcattctctgcgccagcgacactggtacatccagagcacatgtgctacctctggagaggggggtacgagggggc

SEQ ID NO: 61312 - DNA, 767 bp, Triticum aestivum
  Clone ID: PAT_TA_61312
tctctctatactacctctcaaaatcagcaaatatgcctgtcgaaaccgcctacgaccccaaggacatgttgttccgtcacctgggacctactggtctcaaggtcagtgtcttcagtcttggtggctggttgacatacggtggaacacaaaagggagatattgttaaacagatcttgcaaacagcctgggatcacggtgtcaacacatttgacactgccgaggtttatgccaacggtgaatccgagattgagatgggccgagccctcaaggagctcaactggccccgagacgaatacgtcctcaccaccaaggtcttcttcggtacaggtcgcaaggagcccaacacccgtggtctctctcgcaagcacgttgtcgagggtctcaagagctccctcaagcgaatggaacagccttatgtcgatgttgtgtttgcccaccgccccgattacgctactcccatgaaggagatcgttgagggatttacccaggtcatccgcaacctgaaccttgcctactactggggtacctcagagtggagcgctgctcagattaccgaggctactcaaatcgctgagcgctacaacctcattgctcctgttgttgagcagccccagtacaacgctttccaccgtgagcgtttcgagaccgagtatgctcccctctacgaccaattccagtacggaaccactatctggtcccctctcgccagtggtctcctcactggaaagtacaacaacggcatccccgacgattctcgcttcgccacc

SEQ ID NO: 61313 - DNA, 225 bp, Triticum aestivum
  Clone ID: PAT_TA_61313
cccacgcgtccgcggacgcgtgggtgcagctgatcgcgccggaagctcgcatcgtacgagatagtgtgtgtgcctagataatcacgtacatatcatggctgatggctgcgcgccggccgcagaggctcgctagcgagctgcgcaccgtggaccaggccatggcccttgagctcgtcgacggtgctggttctcggggtgcatcaggggaccaaagcagggggtttt

SEQ ID NO: 61314 - DNA, 658 bp, Triticum aestivum
  Clone ID: PAT_TA_61314
cccacgcgtgcggacgcccgtgctgtgccgctcgatcgccacgcgcggcggcctcctcctggggcgcctgtacgtacccacgcgagcgacgatgaccagctggtacccaacgtcgtccgcttagctgtgtgcgacacgctcgccggcaggtgggacgtgctgcccgagctggactgcgacagccagttctgctactccgacacttacggctacaccatcataccgagcagctccggcggcgacgacaggcgggccttcagagtcctattgatcggcgccgacaagtacgagtcggagtcgcagttcaacctccaccgattcgcctccagcgaccggagctggagcgcgccgcgcaagtgcttcgacatgatggagcgccatatctggtccatgaaggaagagaacgccgtggtgtgccgaggcaacgcgcactggctgttcgtcagggcctcaaaccaattccacgtcctcattcttcaacgtcgacgtcaagaccggccacgtctccctgacgaagatcctcacaccaaccaggggagaagttcatcccggcggctgactttgacttattgcatgtggaccatgccacgggcttggcgaacatccggcgcagtctacgtgacatcccccggtgccgaccgtctcgccaccaccacag

SEQ ID NO: 61315 - DNA, 178 bp, Triticum aestivum
  Clone ID: PAT_TA_61315
cttcctactaaaataaaaaatcaaggatggcactccagcctctctcctggtgtacgtgcttcgtcatcattctcattgtggcttctacttcctttgccgtcgactatgactgtagtagatcattgagtgtggttacttcacactgcaaggaagagctcacatgggttatatcttccgg

SEQ ID NO: 61316 - DNA, 283 bp, Triticum aestivum
  Clone ID: PAT_TA_61316
gaggaattcgatggaatatggggataaagatggccttttccgtatgttgcttagggacagcagggatgacgacatggagctcacacctaactcggacggtttgctgaagagactcttccgggacaaggaggacagaccgggcgacgatgaccagaaggaaggtttttttagcaggatattcatagagggagcgaggagaggtttatagcatgcatggaaagcttgccgatgaggaaagagtaggtaagagtttgcaggatgatgatagggaagggcgctcctc

SEQ ID NO: 61317 - DNA, 249 bp, Triticum aestivum
  Clone ID: PAT_TA_61317
atggtcgccgtgaagcgcctccaccccggccacgacgacaggacctcgcaggagcagttcatggcggaggtgggcaccatcgggaggacgcaccacatcaacctggtcaggctgttcggcttctgctacgaagccgacgtgcgcgcgctggtgtacgagtacatggagcacggcgcgctcgactcctacctcttcgaccggagccgcgacctcggcttacagacgatgcgcgccatcgccgtcgggcgg

SEQ ID NO: 61318 - DNA, 231 bp, Triticum aestivum
  unsure (1)..(231): unsure at all n locations
  Clone ID: PAT_TA_61318
ctctccttcgccggcgttgccaactggagtgggagaggatgggggcgtgtctgtgcgtagctattggtttgcttttttcttttctcctccttggccaataaatctgatctggatccagatccacccctttctttgatccatttcttctccctcgagtccctattgagggcagcgaggttgaagattcattcatggatggcggtgngcttctatgnccgaggctttcgccag

SEQ ID NO: 61319 - DNA, 744 bp, Triticum aestivum
  Clone ID: PAT_TA_61319
caacctctttggtaccgagttctccgtcatgtcggaaacggagcgtcggcaaaccacaaagggtatctggatgtccaagaacaagcgggagacaagcgcaggcaccccgatgtcggagaacatcctcgtcatggacgttgagggtacagatggtcgagagcgcggtgaggaccaggactttgagcgcaaaagtgccctgtttgcgctggctaccagcgaggttctgatcgtcaatatctgggagcaccaggttggtctgtatcagggtgccaacatgggtctcctcaagaccgttttcgaagtcaacctgcagatcttcctcaaggacaagcaatcaacccccagatctctactcttcttcgtcattcgagatcacctcggcaccactccccttggtaacctacgaacgacccttattcaggacttgaccaagatttggtcgtccctctccaagcctcaggggcttgaaggctcgcgcatcgaggactacttcgattttggcttcgctgccctgccccacaagatcctgcaggctgataagttcaccgaggaggttcagaagcttggtgctcgattcacagctggtcacagacacggcaaggctggtctgcacggtgaccaagagctcgagggcggccttttcctctctgagtaccaccgacgcattcccgccgatggtttctccgtatatgccgaaggtatctgggaccagatcgtgaacaacaaggatctggatctgcccac

SEQ ID NO: 61320 - DNA, 518 bp, Triticum aestivum
  Clone ID: PAT_TA_61320
cgtcgggtcaggtgggcggcttctgccgcagaggctaagagggcagctcgtggaggctgcaggcaggctggagggccggcaagtggacaggggcacccagcaaagcgagctgctggccatcctggagcaccacctcccgcgttttctcgttcagacttgaatgaaggtcgcaacctgcactcaaactgcatcggcatcggcaccgtcatcgtcatcggtcatcgcaagcaagtagcgaagggcgtcgcacccaccatccatcctcatcgtaccctgcttgtcgacatccgcaatgatagcaccaccctgagaggctcgccccccctgactctcctgcaggcgctcttcggagagtatatagttttggtacaagatgttgtgttgtgtcgtgtgtgtgtgtgtgtcgtctctgtgtgtgtgtcttgtgcgaggcgtctgttgagtatttaccggaactgcaaccgtcagaaaaaaaatgatataagcgtcgtcgagaacatgtttctccagttttcagt

SEQ ID NO: 61321 - DNA, 688 bp, Triticum aestivum
  Clone ID: PAT_TA_61321
ccacgcgtccgatttttcctttcttcaccctatttctaacactaactgtatatcctcaattgcaattcttcaccccctattcacgtggaaccttgacttggtgcgactccatctcactaccgcattaaaagccaccttgcatctacgccaagcatcgtacttaaaccttacatcaagaaacgcatcatcgccaagaagcccagaaaaggattcacccatacaaaaccaaaacttaccttactcataaaaccccaacatattcacaatggatcccatggctcaacaacaacaacaacaagcccagggcgaacagcctgaactcaatgcatttggcaagctcactgctcagttcttgcagtacggcgccaatgcctccaacaacatttcaactgcattcgattcaatggacacaaaggcatggattcgcctcatcgtcattgtcggaggctacatgctcctccgtcctctagcccttaagttcatcacaaaaggagctgttcaaaagatggaggacgacgatgccaacgagaagcgcaaggcccagatctctcccaatgagctgcgcggactggttgaggatgagcctgaaatcgacgcggacggcgacggtaccggtgctgactggggtcaaaaggctcgtgtgaggcaaagaactatgttgaaagaccttcttgaagctgaggagcga

SEQ ID NO: 61322 - DNA, 698 bp, Triticum aestivum
  unsure (1)..(698): unsure at all n locations
  Clone ID: PAT_TA_61322
ccccgcgtccgtcttcatccatcgctgaggtgacgaagctagctccattggattggaacacgcaagaagatggagggggagacgaacaagaggctggccacgctggtgggctgcaactacgtgggcacgcgctacgagctccgcggctgcatcaacgacgtcgacgccgtgcgggccgccctcgtcgcccgcttcggcttcgcgccggccgacgtcgccgtgctcaccgacgggcgcggcgccgaggtgctcccgacgggggccaacatccggcgcgcgctcgcggagatggtcgcccgcgccgcccccggggacgtgctcttcttccactacagcggccacggcacgctcgtcccgccgcgacacggcgacggcggcgcggaggaggaggcgatcgtgccgaccgacttcaacctcatcacggacgtggacttccggcagctggtggaccgggtgccgccgggcgcgagcttcaccattgtgtccgactcgtgtcacagcggcggcctcatcgacctggagaaggagcagatcgggccctccgtcggctccggccccggcgcaccgcctacggctaccgcgcgcaccgcccggntccttccctacggcgtgctcctcgaccacctctcggccgtctcgggcatgccttcctcccaccacgtcgccgaccacctcgtggcgctcttcggcgccgatgc

SEQ ID NO: 61323 - DNA, 690 bp, Triticum aestivum
  Clone ID: PAT_TA_61323
gccagtaccagtagccactacgatcgcttaagaagaggcacggatcacggatgtcaagcatggcatccagcaagggccttcttgtgttcgctctcctgcttgctgctgctatcctcgtcgcctccagtccctcgactgatgaacaccctgaggccaagaaggaagagaatgaagccggcatagagaacttccactttggccacggaggccaccacgggcacggaggcggcgggggaggctacggcggaggcggaggaggttacggcggcggcggaggcggaggctacggaggaggcagcggaggttacggtggcggcggctacccaggcggtggaggaggctacggcggcggtggcggctaccctggccacggtggggaaggcgggggaggctacggcggcggtggcggctaccctggccacggtggggaaggcagtggaggttacggcggcggaggctacccaggcggcggaggaggctacggaggcggtggcggctaccctggccacggcggaaaaggcggcggatgtcactggggctgctgcgggcacgggctgttccatcaccatggctgccgctgctgtgcgcgcgcggacgaggttccggagcccatgtaccgggcgccggcggaggtccccaactgagcacacgatctgagacgaaatgcagccatgcatacgtacgtacgta

SEQ ID NO: 61324 - DNA, 187 bp, Triticum aestivum
  Clone ID: PAT_TA_61324
aacactttttccaaggaccgcgacgggagcgtggggggggatcataactaacagggagcacaggccgttcccgccgattcaagtccgtcaccttcacagtcggaccaggcgatgcgccacgcgatccaagccatgaactgccaggacctggacggccggaacatacaccttcaacgaattccactcc

SEQ ID NO: 61325 - DNA, 114 bp, Triticum aestivum
  Clone ID: PAT_TA_61325
gcgacacctttgagttgttgtggtcaatttatcaagtcctatcagataatgttaatctgcacgggttcctcctgtgcaatgtgatgtctgtctcaggttgctcctaagttcttc

SEQ ID NO: 61326 - DNA, 453 bp, Triticum aestivum
  Clone ID: PAT_TA_61326
gacgtgcccatggatgcgaggaagcttccttgctccttccgacaccagcgtcgaggaccatcatcagttttggagcatttattccatctgactgtgcatatttttgtgttggtgacgatgctcggtgtggctaattttctacaacaaatttggtacattgattttttaggcgaatttggcacgtagttagtattgcactagaagaaataacgctcatggtgatgtgcttcgttgctctattattgaatgtattgtttggagattgtttgatgtaatcttcagggtgaaaacgtacgatctgaactcaagtagttgaatttggcgacggcagcgattgcgcgccattcacttcctagaggcattattttccggacaatcgttctcgatgtcatgtgttgtcaagggatggtcgatgttgcttcttgtatcgtggatcattgttactctttcctt

SEQ ID NO: 61327 - DNA, 485 bp, Triticum aestivum
  unsure (1)..(485): unsure at all n locations
  Clone ID: PAT_TA_61327
gcggacatctacgacgccgcctcctttgagccggcgatccagggctgcgagttcgtcttcctcgtcgccaccccgctgcagcacaactccggcagctccaagtacaaggacaccacggaagcggtcgtggacgcgacgcgcaccatcctgcaacagtgcgagcggtccaagacagtgagacgtgtcatccatacaggttccgttgttacggcctnncgccgcctccggtgagaaaaacggcgacgggtacaagggaggtccgtggaacgaatnccttgcttgggaaccccggttaggggcttgtgttttaaagggccccagggaaaaccggaggggggtttttttggggagggttttaaaggggnnnncccccccaaaaaaaacccctgtttttttgtgggggggggggggggggggggtttttttttgggggcccagaggggggggttttttttttttttaaaaagggggggggggtttttttt

SEQ ID NO: 61328 - DNA, 521 bp, Triticum aestivum
  Clone ID: PAT_TA_61328
cccacgcgtccgcccacgcgtccggaaggaagaagatggcggacgaggggaccgccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcatgcaggaggggctcctctgcctctgccgctaggtgatccatggcgaacttgttctgtgtctggtacaagccgtttgtctgagatgcgagtcgcggttcatggtgctgcggtgctgcctacgtgtgtgttgatgctgttgtacatctgtttcttgttcgtgcttgatgattagcctcctctctcgtcagttgtcaccttcccttctccagtgtatccatccagttgtgttgttcgtccgggcattttcgtcgtccatgtactttgaactttgattaattaattaatcaatcaattgattggtggag

SEQ ID NO: 61329 - DNA, 771 bp, Triticum aestivum
  unsure (1)..(771): unsure at all n locations
  Clone ID: PAT_TA_61329
ggcgagaaacaaattctcaagatagaattataggggctcattttttcagccctgctcatattatgcccttgcttgaaattgtccggacggaaaggacatcaccacaagctatccttgatctcataacagttgggaaaataataaagaaagtccctgttgtggttggcaactgcacaggctttgcagtaaatcgtacattttttccttacggacaagctgctcatcttctagttagtcttggaattgatcttttcagaattgatcgagtaataagcaacttcggcatgccaatgggaccttttcaactccaagatgtagctggatatggagtagccttggcagtaaaggatatatatgcagctgcctttggaacacggaattttcactctggtctagtggaactgatggcgaagaatgggcggcaaggaaaaatcaatggaaaaggttattacctttatgagaagggtgcgaagccaaagcctgaccctagtgttcaacatgtgatcgacgagtacagaagacagacaaagaaaatgccgggtggaaagcctgttactttatcggatcaagatatattggagatggttttcttcccagtcgttaatgaggcatgcagggtcatggatgaaaatgtggtgatcagggctgctgatcttgatattgcatctgtccttgggatgggctttcccagtacaggggtggcctcatcttctgggctgatacggntggagcatcctatatacattcaaagcttagcaagtnggctgaaat

SEQ ID NO: 61330 - DNA, 679 bp, Triticum aestivum
  Clone ID: PAT_TA_61330
taacaatcaattgatgtgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaggggacccatttttcttcccggggggggggaagtttttattttttttttgggggccctaaatttaattcccggggcggggttttaaaacggggggggggggaaaaccctgggggtcccccatttaaagggtttgggaaaaatcccctttttccccggtggggaaaaaaaaaaaagggcccccccgatccccttttccaaaatttggccccccttaagggggaaggggccccccccttttaggggccttttaggggggggggggggtggggtttccccccggggggccctttatttttgccgggcccttaggccccttttttttggttttttcccttttttttcccccccggtggggggttttccccggaaaggttttaaagggggggcccttttaggggtcccgtttaagggtttacggccccctccccccaaaaaattttttttgggggggggggtccccgggggggcccccccccttgtaaacgggtttttcccctttggggggggg

SEQ ID NO: 61331 - DNA, 176 bp, Triticum aestivum
  Clone ID: PAT_TA_61331
cacacgcgtccggctgtagctcctgagggctgcgcgagcgctgcccacatgaacacatggctccccagggacagctagctccggtgtccgtccaacccggtcactagcctgccagcttgctccatatgtgctctggtgcagacaatccagagcatgccattcggtgctccaagaca

SEQ ID NO: 61332 - DNA, 172 bp, Triticum aestivum
  unsure (1)..(172): unsure at all n locations
  Clone ID: PAT_TA_61332
ccaaggagcacctcgcagcctcgctcaccagcgcccgacctagaaacagaagcggtggcgcccaggaagccacacgacggcggcgcccaggtagccagctattgaagatcggttannacatcaattgaatacttcttgtcaaggatacttggagccaataattctttggggt

SEQ ID NO: 61333 - DNA, 718 bp, Triticum aestivum
  unsure (1)..(718): unsure at all n locations
  Clone ID: PAT_TA_61333
cccacgcgtccggcaaaggaggactgggagcaggagcaggggggccgcctctactccatccagtccgatccaatccgatccacgggagaaaagccaaagatttgacttttgctcgtgtgctacgcttgaccgaccgaaggattggcgttatggcagaagctgacatcacgcggtactggtgccatgaatgtcagcaggccgtcgaggaggccatggtggaggagctcaagtgtccattgtgtgatggtgggttcgtcgaagagatgaccgttgagcaggttgaggcattgacagagcaaggggcaactcagtgggaccctctggacaacccttttgagcaggcaggatcgccgggggacagcgatgatgaagataatagtgatataggccgtgagtttgagggtttcatcagaaggcatcgacgggcatcggcactgcgccgtgtgcttgacagcatccatgatgaccttagagatgacagggaaagggacaactccgttctgatcagtgctttcaaccaggccctcgctctacaaggtgcagcgcttgaccctgacgaggaccgaggtgaccatggtaacgcaaataatgatgatggtttgctagatgagtatgtcctcggggcagggcttagtctgcttcttcaacatttggctgagaatgacccgagccggtatggtactcctncaacgaagaaagaagcagtcgaagccctgcc

SEQ ID NO: 61334 - DNA, 237 bp, Triticum aestivum
  Clone ID: PAT_TA_61334
ctcaagtacctgctcctcgccgacgacgcggagtcggtctccacctcctgcgccgacccatactgcgcgctcttgcggacggcgctgaacgagtacatcacaggggggaggaaggcgaccgtgacggcagatggaggccatggcagaggggctggacattgaacacgacgactcgctgagcgcgatggtgacaggggaggtttttttccaggtgtttcagatgaaccactacccgac

SEQ ID NO: 61335 - DNA, 494 bp, Triticum aestivum
  Clone ID: PAT_TA_61335
gcggcggtggcgggagcggcgtctccgtggagagcgtcgtcaccgaggcgttcttcaacgggatcaagtcccgggccggcaacgggtgcgccggcaagagcttttacacgcgcccgtcgttcctgagcgccgcccgggccaaccccaacttcgggaaaggccgcacgaccgacgacggcaagagggagatagccgccttctttttctacgtcacgcactactgcgacaggaagtacacgcagtggccgtgcgcctcggggaaggggtactacgggcgcgggccgctgcagctgacgtggaactacaactacggggcggcggggaagagcgtgggattcgacgggctgaacaacccggagaaggtggcgcaggacccggaggtggcgttcaaggcggcgctctggttctggatgaacaacgtgaagcaggtcctgccgcgggggttcggcgccacgaccagggccatcaacagcggcgagtgcaacggcgggaac

SEQ ID NO: 61336 - DNA, 454 bp, Triticum aestivum
  Clone ID: PAT_TA_61336
gtgggcttcctagtgattggatggcttgtgttccacgagattaacaatctaggtggagaatcattacctaaatgatttggccaacgagccatagaaatttaaggacttaagctgcaatgttctgccatgcgtaaatagaatcatatttcacacctgaagaaaaccttagagttgcctaatagtaaatgccaggacaaatattgtgtctcgtacctcctttcttatttgatattgcaaactaaataccaacgagaaacaaacgccatatagtatgtgtcacgattttcgttggatcgaaaacgaacacgtctacatgttcaggatgtttctgagagaagaaagatcataaacagaacattattttgtggacataaagcctgcgacactggaatggtcagaagaaggctactaacacaatggttgtttcatagaagaagaaagattctgatcgcga

SEQ ID NO: 61337 - DNA, 762 bp, Triticum aestivum
  unsure (1)..(762): unsure at all n locations
  Clone ID: PAT_TA_61337
cttcctcctccacgatagaaaccgaactctcccaatacctagacaattatcagtcagcaagccttcatttggtttgtcgactctggggttccggtacttttctcgcgcgagttcttctttgccctgtccgtgtctacccagtccgtgtaatagactcgacctgcattctccaaacgttattgaacctcaaccatcaacaacctttggacttgtagtttttagggttctctccctccaccttttacgctttccttactcacagacgactgtcttctctctttgactgcttgaatttgagactcatcgggtttcctatataccatcgacattgttttatcaccgctcacaacaaaagcaattctttttctggtcccaatcggtagaccattcgcaaatcatatcgaatccccacgattcgtttatatacgttttcccgtaccttgacgttacaacccacgatctaaggtgcttcagtaaatggcccgaagcgcctactgaactctagtcgatttattatcggcccagcctcgaatcactttcgcgttcacgccaacaggaccgtcttaactgtggtataaacccacagtttcgctttacggccctacgtttcgcttcatcttccgacaaaggtcgcgttcgatcttcgtcggttctatctcanatccttcatcatgcccggaggcgtgtgtgccgtcctcgactatgaggtcgacatgatgtccgagtacgttgccgagatggccacccgtgtcgtcacacctg

SEQ ID NO: 61338 - DNA, 245 bp, Triticum aestivum
  Clone ID: PAT_TA_61338
gagtaggcttcctggaaactttccttctgttttttgttctgtgttttgctgggtgggatgtgctgtggtaatgttttattatgataggtggtgcgtgtttctgtccgggcaattcggtcctgacgagtccacagattggggcaacatccctctggaatcctattttgttttctctttgtcaattattgtgtgtgggagatagagggacctaggatgatggttcatattaattgtttttggtatac

SEQ ID NO: 61339 - DNA, 759 bp, Triticum aestivum
  Clone ID: PAT_TA_61339
gcgctctacgactctgacaaggccttccgcaacctctacgacggcgtcgccgacctcttcgtctggctgctcaagtcggacctggagcacctgcgcacgggcgacatggctaagatcgtgttcgccgccaagtgcgctcgtcgtacgcatcggtctcctttgctccatgggtgccgctggctgaggatggagtagcaggcatagaagaaatctacagccaatttctcttggctgcgccatcttccgctgacagtaactctacacaacagcctgctaaggtgcaccaggagaagtctgatgataaggctgaagctctttcatcttcaaaaaaagggagctgtgctactggaaagggggctgggatagcaaagaaatcaaggcagttactactctacgtcatctatgcagagattaattacctatagaaaagaatgcctttatcctgataggcatggaaacaccgcttcgcattgagtgcatcatcgctaatcagctactatctatgagagcaatggatatagaagaaatatgtaaacagttgtccctggaagaaatatgcaacaacttattcagtagagagcaagggacatataagaaatctccaggcagcttcgcttagatgcatcatcttctgctaggacctaggagtcagcttgaagaacgaccttctcaggagactgcaactgacatgttggatggtgaataaccaaatttgtggacaaagacagagagttcatcgtaaggggtgggtgtttagga

SEQ ID NO: 61340 - DNA, 768 bp, Triticum aestivum
  Clone ID: PAT_TA_61340
accaaaaccaaaaccaaaaccatggccatgttcccctgtctaatcctcagtctgctcctcacttttgcatcggcgcagctgacgacgttgagcgccggctcgactctcgccgtggaggactacaccatgtttcaagacgacgatggcccgagcttcaacaacaattccaggcttgcagtcctcgatgacaagggttggttctcctcaaccgatggcctcacggctcacggtagcagaagaagactgacgctcgagcacgacggcaacctcagaatgcacagcctggacgcgtcgagtggaagatgggtggtcacatggcaagccatactgcagatgcactatgtgcatggcctatgtgggaagaaggggttcttcgagtactcgccgagactccgctgctcgtgtcctcctggattcgagatggttaatccaaacgtgtggagcaaaggctgcaggccgacgttcagctacaactgtggtcaagacaggtacagcttcatccagatccctcaaaccgatttctacgactttgatcttggcgtcaacgactccatctcgtttgaagagtgtagaaacatctgcttgggcatgtgctcttgcatcgctttctcttaccggctgaccggaaccggcgtttgttaccctaaaggcctgctgttcaatggctacaagtcgcttgcattcccaggaagtgtctatccttgaagtgcccctcactgctgacattcagattcaggtctctgaatcaccacaatcagctctcacatg

SEQ ID NO: 61341 - DNA, 718 bp, Triticum aestivum
  unsure (1)..(718): unsure at all n locations
  Clone ID: PAT_TA_61341
cccacgcgtccgattttgtatctgcatcagcatattgctgcattgttcatcagttcagtgggaatttgattcattaaacatatatattgaccaaatagtctgtcgaagcttttgaaacatatacttataggatatatgcttccgtgatgcaggttctagaacagacccagcaactagcgaggtaaacgtttccactatgtttgtcaaagatgccactcgcttcagctgttttggacatgaagtagttgaactgggaattatgtttcatgcaacttttttctctcaagtgcagtacgtcccaacggtttatccagacgacccacaaggattacaatgtgtgttgcagtacctgacagaagcctatgggggcctccccatttatgtccaagagaatggcaagtcgatctacattctgggcacaacgatctgcaaactgttgttgattcagttttcatctaaaattaattgatacggtaaatttgatgaagtttggccatgatctctcttcaggcaaggcatccgcgaatgacattctcgatgacaccgacagggtggaatacttgaaggcctacatagggagcacattggatgcattaaggttagccattcaaacaaattccaccaagaattttcgtgaaaccttcagagttcagttaccatggntgcagtttttcctctgcagaaatggagccaatgtgaaagggtacttcgcgtggaa

SEQ ID NO: 61342 - DNA, 726 bp, Triticum aestivum
  Clone ID: PAT_TA_61342
ctcgtcttcttcttcatcccctcctttacttgtttctccttgacaccagagagagagagggagggagatggcgaacatctgcggtggccgggaaagggctcgtgtggcagcggattaccggccgtctagcccagatgaggaatctggtctccaagaacctaattcagggacaatgaactccaaggcaagcagcagtgccaccaccggcttcatggcctctgtcgacagcgacggtacaaacggtgcaaccaaacaggggtgtttcctcgaaggccaaatactggaggcaccgaacctccgaaaattcacattccttgagatccagacagctaccaagaacttcaggccagatcgtctcattgggttcgggggatttgggtgggtgtacaaagcgtgggtcgatgagaagacgatgaacccgacaacgagtggccctcacatggctgttgctatcatgcatggaaaggaggaatggcagaaatttctgactgtcaacttgcgatcggacataaaccttttgggaaggttctctcacccaaaccttgtcaagctactgggctactgctgggagggcaaggaagtatttcttgtgaatgagttcatggcccaacggagcttggaataccatctattcacagtttcaggaagatgtcctccactatcatgggaaccagaggctgagatcgccatcggtgcagctcgaggacttgctttcttgcatgcatc

SEQ ID NO: 61343 - DNA, 764 bp, Triticum aestivum
  Clone ID: PAT_TA_61343
ccataacaaggaagattcaccatacaacacccatatcataccatttatcatgtctatgtcagcggaagagacttccaaagtacgagatggtttccctagaccatttcctaacattccatccaatgttacagagcaattccgcttgaatggcaaagtctgtgttgtcaatggcgctgctgatggccttggatacgctgtagctgaaggctatgctgaagccggcggcaatgttgccttgtggtataactcgaatgatgctgctattgaaaaggctcgttccttatcagagaagcatggaatcaaagcttcggcttacaaggtcgacgtgtccgacgctcagcaaattcaagatgccctgaagaagatccttgatgactacggtaaaatcgatgtttatgttgcaaatgcaggcatggctatttcgaaaccaatcctcgagcagactatcgaggagtacaagaagcagatgtcggttaacgttgacggcgttgtttactctgcaaaatacgctggcgagatcttcaagcgtcaaggtttcggtaacttcatcatcacatccagcatgagtgcccacatcgtcaacgtgccaaccgaccagccggtctacaacggtagcaaggccttcatcacccactttggaaagtctctggctcgagagtggcgagaaattgcacgtgtaaacatcgtatcccctggattcttcgacacaagatgggtgcgagcccccgagctctcaacgaggcatacccgatgggctgtgctgg

SEQ ID NO: 61344 - DNA, 636 bp, Triticum aestivum
  Clone ID: PAT_TA_61344
cccacgcgtccggctcaaggaagtggtggtgctcttgactggcgaagcaagctcgttactcagcgtggtgccgttgttgctaccgagatgaagaacaacagctgcaagcttgcccgatggacagtgcagagcatcctcgccagcgctgatgtcatgaagcttggtttcgtttcccgtgtgacaccccgctccaatgataagcacgtggtcttgggcgttatcggctggaagcctcgtgatttcgccaaccagatgaacttgtcccttaacaacggttggggtatcgttcgcactattgccgacatgatcctcagcagcagcacccaggacgccaagttcgtccttgttaaggaccccaacaagtccattcttcgattgtacgaggtgcccacaggcagcttcgatgatgatgacgaggaagaggttgaggagccccagggcgaggaggagcaataaagcagatagaattgaagacaagcatttcacgttgtgcatatttggtagttttaagaccaggggctagaggaacgagatttgcagggagtcccatgctctaatgatttgaagcagtggatgcaagttctatcggatcctgttgttcaagggtactgtacttgtttgcagttgtgggctgga

SEQ ID NO: 61345 - DNA, 779 bp, Triticum aestivum
  unsure (1)..(779): unsure at all n locations
  Clone ID: PAT_TA_61345
atagttttagcgtgccactatagcacttttagcgcgtcggacccaacaatggtttatcagatgcccaaaaacacgcgcccaaaaaaactcgtaatataaattgtgaagcgcacgcagtccggcgtctcaaatttgcagcatgcggtagcgttttttagcgcgcgcacaaccctttttgcgcgcgcattattttacagcttctgctgaagctgtccggccccacaaaaacccgaattttaacgcgcggagcagattttggtgcctgttggagatgctctaaagagcaattttattaactaaatgtagtatcaagaggatataaagcatcatcggcaacatctggtgtctgcataattaggctgcacacaaccacaaaccagagtctggtagaaataaagtcgacataacaacaatagaggtccatcattgacctagctttactgagcgatgaaatacacacatattccgaacgttgggtcgtgcagcaatgcgacgcatgcatggcatgttgtcatgtgattggatagcacaatagctatatgtaacttggccgaatttcccccgcaaaaaaatggccgaatttatatacagtttggttatgttgattttgattttgtggggggaagaaatgattgaagggaaaaaaaatggagggagggagaagaagaaaaggacggccgttaatcttaacagtctagaaattgacttcacaaaataaattttcaggcaactcacataacatatagccggtcccatcgaccagtgntgtcgcgtgtctg

SEQ ID NO: 61346 - DNA, 657 bp, Triticum aestivum
  unsure (1)..(657): unsure at all n locations
  Clone ID: PAT_TA_61346
gaaccatcgcgttcagccgaccactggaaaatcccggtggaagcacgacggctaccatgcgagagcgggaaaatatcatgtactccagtgcattgggtgctccggctactccctatccctgttacttggctatgctgtgcccagattggaatagcaagaacacgaacagactagggctgtagggcatcgagggtccggcggcgggtcgccggaggctgcgctgcgacatcggtagaacaagctcgccgcagtatggtgctccgacgtccagccgacaacttatcccacccctgccccgcccttctccacctcggcgaatccctccgcagccccacacaccaggcgcctagctccgccatccgccggcgccggagaagaggactcccagccttcagctaagcttttgggtgttacgaatttgtgttattattgtgtattttagatgtgatacattttccccttcatgctgatttcgtgagttgtaaccaatcctattttgagtagaatatgttggtatttctctgtatcgtggcgcggcgaagttaatcactgaaatttctatatttgtcttatactacatattctagcaattatgtatagtaaaatttcagcaacttatggcctgacagtctacatgattacaaagtaattntatct

SEQ ID NO: 61347 - DNA, 300 bp, Triticum aestivum
  Clone ID: PAT_TA_61347
acggcgcgtacagacgcgggtgcgcgaccagcggctgcgactctaccaggagtacttgaacgccgacggagcggatgcgtgcggtagcagcaaatcctcggacagcgctgacacctgcggtttctgggactccaagcacaccggaagaatacgccgaacgccgctctgcggagcggtcgcgagacggcagtagctcctcgcgccgaagactgcgaccaccggtcgcgccccatcgaggagacccaccccatgctgaacaccaggaaagacgctgacctcaaccccgaccacacgctccca

SEQ ID NO: 61348 - DNA, 595 bp, Triticum aestivum
  Clone ID: PAT_TA_61348
ccccgcgtccgctccgataatacaaataccatggcccccgtcgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttcaacaacctgcgccaggtgcagtgcgtcagcttcatcgccttcaggccaccgggttgcgaggagaccggaaaggcctaaactatgagttgaaacaatggcctatcttatatgaagatct

SEQ ID NO: 61349 - DNA, 393 bp, Triticum aestivum
  unsure (1)..(393): unsure at all n locations
  Clone ID: PAT_TA_61349
cccacgcgtccgcccacgcgtccgtcatttagctgttcttgcttgctgcttctgaaaaacctgcatgctagcatccccagctcagaagaaacagggctctcgaggaggtctgtctttccatcttggttttgttctgggttcgtcgaggagaagacaattttttggaggtgcaagctaggggctgatcaggaggtcagacatggaggatgtggccaagttcttgtttgggatttcgggcaatgtcgttgctctatttctcttcctatccccggngcctactttctggaggatcattcgtaacaaatcaacagaggaattctccggggtaccatacaatatgacgctcctcaactgcctcctgtccgactggaaccggctgccccttctgtcccc

SEQ ID NO: 61350 - DNA, 428 bp, Triticum aestivum
  Clone ID: PAT_TA_61350
ggtttcctttttcgaactttgtaatcccatgtagaataaatcaggtgttaccatgtggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccgttttaaagaacccaattttcctcccccttccttccaacgccatactttttttttagggcccccaaaatcaatttccctgcccgttttttaacaccgtgggacctggaaaacccctgccttcccccaactaaatccctttgcaacccatccccctttccccagctggcgaaaaagcaaaaaggcccgacccgttcccctttcccaaaaatggaacaacctaaatgcgaaatggccccccccctccaacggcccttt

SEQ ID NO: 61351 - DNA, 419 bp, Triticum aestivum
  Clone ID: PAT_TA_61351
cggacgcgtgggtgcaggcagagcagagttgagcgtgtgggagtcgaaggagatcgagatggaaactgcatatgctcctccgatggcgagccaggtgatgaagagcggattggtgagctccaagccgcgggggctgtccggcgcctcactcactaggaggccccgcttcgtcgaaaaggccgtaaagtctgacaaggggacgtaccaggtggtccagtccatcaacggggacccgttcattggcagtctggagacgcccagaacctgcaggcccctaggggggggggacctgtgcaacctgcccgagtaccgaaccgacgaaagaccgttcctacgcgggatggaggtcggactggaccacgggtatgtgctgaggggaccctgggggctgagccgggccggtgcggatcacgcgggtt

SEQ ID NO: 61352 - DNA, 634 bp, Triticum aestivum
  Clone ID: PAT_TA_61352
gtatgggtgagggcagccactaccaggttgattggcgcaacactggtaactttgtcggtggaaagggatggaaccctggtactggccggcaagttctctcagacatattatcttacaaatcatttgacttacactatgcagaaccatcaactacggaggttccttcaaccctcagggtaacggatacctttgcgtttactgatggacccgcggtcccctcgtcgagtactacgtcatcgagagttacggttcttacaaccccggcagccaggctcagcaccgaggtaccgtctacaccgacggtgacacctacgatctctatatgtccacccgttaccaacagccttcgatcgacggtgttcagaccttcaaccagtactggtccatccgccgcaacaagcgtaccagcggctccgtcaacatgcagaaccacttcaatgcttggagatctgctggcatgaacctcggaaaccactactaccagattctggccactgagggttaccagagcagcggctcatcttctatctatgtccagactagctaagggatgtcagctgtggtcggttacagatgatttgacagatcatgtgtggaaattgaagagggaaaggttcttggctgactgaaggat

SEQ ID NO: 61353 - DNA, 695 bp, Triticum aestivum
  Clone ID: PAT_TA_61353
acacagctcgcctgttgccccacatactactctacctggctgtttgacccgaaacagcacgagcctttgatcaacgattgatggatcattggaactctcacactgcttacggccacaattgtttggcgtttatggaattggacttgtgcaagcctggcatggcgagccgggcatccgcattggagtttgggggatttgttttacctgcgagttctgttttctttcttctttgctatcgcggaacaccaccgcctttgttttactctgctgttttaatcattggatccatgtctggtcgcctcaatctatgactgctctccgttgaccggacagaggcggtcttaatatggattgggtgtgcaacagaatgaccttgctttatttgtatttacgcagatggagagcgaagcctggttttacgcgtgtcacgatgtcgccgagagtgcgttctttgtgcgcctacaacgatgactttattgaatgcgaagactgtacaatggcgcaggggaaaagggaaatgaattgctactgattgatttgggaatggaaacaaaaagtttgcttccttgcgaggaatgcaatgcaatggatttgtgtcttttggaaggaggagtcggtcataacagatatacattatactatacacaagctgccagaagccatgcaggtacagcttaagagaaacattttccctc

SEQ ID NO: 61354 - DNA, 254 bp, Triticum aestivum
  Clone ID: PAT_TA_61354
cccacgcgtccgcccacgcgtccggcgatggcctggctgcagggtcgcctgggagggtttcagcgacgcctcggacgcggacctcatcgccgagcatgagatctgggctgccgtccatccgttggcaaagaacgaagctttcaattgcagcactggggatgcgttcaagtggaagcagctctggccgctgctgaccgatcgtttcccggcgaaacgggcaggctatgaggcccgagggcacgcgcttcgtcctc

SEQ ID NO: 61355 - DNA, 566 bp, Triticum aestivum
  Clone ID: PAT_TA_61355
cctcgcgtccgctctgactcgcgctcttccctctctgtccctctggctcccaaccaagaaagagcgacgacggcgacacgtctaggtagtcggaacggaaccggttgcgtgctgtacggagcatggggctcctcgaccagctctgggacgagacggtcgccggccccaggccggaccacggcctcggcaggctccgcaagtactcctccttctcgccctcgaccgcggcggccacggacgtcgcgccggcggtgacccgcagcatcaccatcgcccggccgccatctctctcggtgccatctggcgaatcaagctccttgccgccgtccccggccagcgcgccggactccccgttcgcagcagctaccagtaggagggacggctggagggcgtttaggcggaaatccaagatggccaacgtcgacgtcgtccggcctgagacggccgtcgggcccagaagcccaccgtgtacgactgggtggtgatcagttcattggaccgatgaagcagcacgcccaaggtacgaaataatggaccaatgccgatgaagcagatgagcttaactg

SEQ ID NO: 61356 - DNA, 138 bp, Triticum aestivum
  Clone ID: PAT_TA_61356
cccacgcgtccggttggctgtggactaaacttgcacatccatgacaagttcagggaccaaataatccacttttgcaacttcaaggaccaaaccatcacctgacatgcaacttcagggacctgcagtgctattacctcc

SEQ ID NO: 61357 - DNA, 558 bp, Triticum aestivum
  Clone ID: PAT_TA_61357
ggaaaagtttggcctgtgacagaacagacggagagggttttccccaagagctaggtaggatgcagggcgccggcgtggaggggaggagcaggggctcgccatcggccatggacaaggccgacgagagcgccaagaaggcgcggctggacctgcccgacggccacctcgtgaagcaagagctcgtcgcgcacgacgcggcggccggaggaggcgccatcgttgcggtggcggagcacagcccgagggcggagctcgcggtgaagatcgacatgtgcgtgctccactgcccgctctgcaccctccccttcaagccccccgtcttccagtgcaagggcggccacctggcgtgcggcgggtgcgtggcccagcagccctccggccagtgcggggcgtgcacggacggctgcggcttcttcgacccctgccccgcgctggacgccgtcgtgtcctccaccaggattgagtgtcccaacgccggctgccagaggtatgtcacctaccacgaggccgacgagcaccgggagcgcgtgcccgcacgcgctctggcggtgcacggag

SEQ ID NO: 61358 - DNA, 647 bp, Triticum aestivum
  unsure (1)..(647): unsure at all n locations
  Clone ID: PAT_TA_61358
cgcactttgattatgatttctttaaagttccaagaaagaatttgtttgacccttcatttgagacgtatgttgtgcacgcagagaggttatcgagaagtataccatgctgactagagacgtggggatggagctgctacggctactgtgcgaggccatggggctccggcctgactattttgagggggacctcggcggcgccgatgtgatcgtcaccctcaaccactacccagcatgtccagacccgaccacaatgattggtctaccgccacgctgcgataggaacctcctcagtctcctcctccccagcgcagttcctggccttcaaatctcccacaatggcaaatggatgaacgtcgagcccctgcccaacgccttcatcgtcaactttggccttccgctcgaggtacgtactacatacctaataattaatctttcacttcgtgagaaagttttgatcgattgctagtttgctactagcctactactgtacgttgtcattgcaggtcgtgaccaacggcatgcttaagagcatcgagcaccgggtggtgaccaacgcgacactgccacgcatgtcgntagggacatgcatcactcctaccaaagactgcctcatcgctcccgggggaggagttccttagcgacgaaaa

SEQ ID NO: 61359 - DNA, 494 bp, Triticum aestivum
  Clone ID: PAT_TA_61359
gtaaaatgtacacccaagaaatcaaatggtttgttggcaaaaaagactcttttaactgcattactcaaatggaacttgtgcagcttagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcctttaaaaaaaaaaaaataaaacgaccggggtaaaaaaaacaaaaactttttaaaaaagaaaaccaaaaaaaaaaaaacgggcccggcttaaaaaaaggtgaaaaaaaaaaaaacctggggaaaaaaaaaaaaaaagttttaaaaaaaaaaccctttttgaaaaatgggaaaaaaaaaaaaaagccccaaaaaaagcccttttcaaaaaaggtggcaacctaaatggaaaaagaaacccccccttaaa

SEQ ID NO: 61360 - DNA, 520 bp, Triticum aestivum
  Clone ID: PAT_TA_61360
gaattggcgagccggcacgcctcgccggcagctttccgccacggcaacaagttcaggtggagccgccgcatccatcgttctggtgagttcttagacaaggcgtgcgtcagggacgcggagcaggggggcaacacgaagccggagaagcccgtggcggctgtgcacggtgtcggaggtgcagcaggccaagaccctcctcgccgtgacgcccatcttcgcctgcaccatcgtgttcaacaaccgtgctcgcgcagctgcagaccttctcggtgcagcagggcagcgccatggacaccgtcctcgggggcgccttccgcgtcccgccggcgtcgctgcaggccatcccctacgccatgctcctcctgctcgtcccggcgtacgagctcctgctcgtgcccttcatgaagcggctcacggggacgcgctccgggatcaccccgctgcagcgcaatcggggtcggcctcggcaccgtcgccttctccatggtcgccggcgccaccgtcgagcgccggcgccgcg

SEQ ID NO: 61361 - DNA, 273 bp, Triticum aestivum
  Clone ID: PAT_TA_61361
gaggtaacgctggctaggcgcctcaccactgtctatcgttagacggcggcaaggacaacggcgccaagggtgagctgatctgtgcacgaggcgtcaaagcacagtatcgctatgatgtgaggctgatctatttcctcctattgcaagagcccaatatttacacattgataagttactgctagactgcgcttcatatttttctgaggactttctccattagcatgatagtcctcaacgaccagtatcaatctggctggagactacacatcacat

SEQ ID NO: 61362 - DNA, 697 bp, Triticum aestivum
  unsure (1)..(697): unsure at all n locations
  Clone ID: PAT_TA_61362
gcggtcgccagctagcccactcccatgtcccatcacgccgccggccggccggccgcgcagtcccctcccctcaccggctcgcctgttgggcgtccgtagtccgcaccatcgctggctcctccgcgggccagaccggcactgccgatctgccgtagcaagttaagcaagccgtcctgcttgatgaaatgtcggcatcaacatccattccctgtggttcaaagagtgcgggaggcaacgggaatggtgttgacaggctcagcagcctgtcagacgatctgctccaccatgtgatgtccttcttgccgatgccggaggtcgtgcacacaagtcttctctcaccaagatggcgctttctttggtgctctacaccattcatccgcatcgacagcgaagacttcatggatcagtgcaagctggagaagttcggggaccgcttgctgctcttgcgtgacgtaatggatcatcatctacttgacggccttccgcatgccacaacgttggagctgcatgcgccattgcatgagcgcgcatttgagggaggtatgctaacatgcccagcatttagcaacctgacaagcttggtgctgggtgattgggtcatgactgctgacttctacccattgcaccgcattctccagctctcagacagctgaaggacctaactntgaagctcgaaatggaggaatgcagcacatgc

SEQ ID NO: 61363 - DNA, 704 bp, Triticum aestivum
  unsure (1)..(704): unsure at all n locations
  Clone ID: PAT_TA_61363
cgattttatctggggtgtcatggatatcattcccaagaccgactttcccgacatccgcatgcgttgtgcgattcactcggctgagaacggtagtcttatggtcatccccagagagaacaagctggttcgtctgtacattcaattgaaagaagtgacacccgatgcttcaggtcgtgcagatcgatccaagatcagcccggatgttatcttcaaagcggcacagaagattattcatccttataagttggattatgagtattgtgactggtggactgcttaccagattggccaacgcgttggtacagcctttgactctcatgagcgtatcttccttgcaggcgatgctgtgcatacccattcgccaaaggccggacaaggcatgaacgtctctatgcaggattcatacaatttgggctggaagattgctcttgttgtcaagggcatcgcaaagccagatattctcaagacataccagagcgaaagacgtcgcgtggctcaagaccttattgagtttgaccatcgttttagtcgcttattctctggacgcccagccaaagatgtcatggacgaagagggtgtcagcatggnaagagttcaaagacgcgttcgaaaagggaacatgtttgcatcaggtctatctgtggaatatggacctagcaacatcgtcgccaaggcaaggtgattcactggctcaggccgatgga

SEQ ID NO: 61364 - DNA, 686 bp, Triticum aestivum
  unsure (1)..(686): unsure at all n locations
  Clone ID: PAT_TA_61364
gaggtaacgctggctggcgcctcaccactggctattgtttgacggcggcaaggagaagggcgccaagggtgtgctgctctgtgcacggccgtcaaagtacagcatcgctatgatgtgtggtttctctatttcctcctattgcatgttcccaattttacaaattgttaagttggtgcttgatttcgcttcagatttttctgtggctttctccattagcatgtttctcctcaacgaccatatcaatctggctggtgtttgcacatgtgattttggttgaggtatgtgcaagatcatccctctctagactgtaaatttgtctgtaggttttggtagatttgatttatcggtagctagggcagtggtgatgccgcaggttgaccaattgtgtgctagaaggagaggtgccactattattttcattatggctcatgtagttcaaatcagtttttcatatgaaagaaattcaagccatggatgcatgatatttggtaatactttaactgcagcttaggatacaaacgcgattacattaatcagttgttaaacaggctactgacatgcttcctcttnctcatgatggtataggagcacacgctgatccaatgaacaggagcgaagtcgccaacgcattccggctattgatcacccttgatcggncaattatcatcttaatggttatctgcatt

SEQ ID NO: 61365 - DNA, 176 bp, Triticum aestivum
  Clone ID: PAT_TA_61365
cgatatcatccgcttcgaggagaccctctacggctcctccagactcgccgccagcgccaccgtcggcgccaccgcctgataatcttcttcttcttcttcttcttctttttttacgtttttctcaacctgaaaaacaaggtgtccgttatagagtctgaagcatgttgttgtcttgt

SEQ ID NO: 61366 - DNA, 508 bp, Triticum aestivum
  Clone ID: PAT_TA_61366
ccaaaatcgagaggaagaaccatagacagagctcatggcgaacgccaaccaagctgcagatccggtcgcactgcctttagttccttgccccgattgtggaaggcgggtggtgacgttcgttgctaggcgcggtcagttccagggtgagaggttttacaagtgccgcaatcacaatccgggtagaggtggctgagcttggaacggcggcacctccgttggcgcaaatcaatccaggagagaacgaggtagctgcagcaaatcaaggtggtcagatgcagccggcggacggcacggtggggcagcagaacggggcaccggatggatcgcagatgccgtccgcggctagtggcgttgttggatctcagctccgcgcgggggatgttggtcggcgtcaggcatccttcactctcgatgctgcatctatcaaatctgggggtgtctgttgagaatatggccatctgcctcgccatccttgtactggtagtatcttttaccgtgatgcgtgcgt

SEQ ID NO: 61367 - DNA, 453 bp, Triticum aestivum
  unsure (1)..(453): unsure at all n locations
  Clone ID: PAT_TA_61367
gattaaccaccgctcgccgcagctccaggtctcctacctcgaggcgatcatctccccgctcttcatcgccatggcatggaggaagaagaacggcggtgagtcgttgtcgcccggggcctcgccgtgccgcgacgacgagcgcgagaaggtccccagagggcacgtcccgatggtcaccggctgcggcgcgcgcgtggtggtgccggtgaggctgctccgggacccgtgcatcgcggagctgctcgacatggcggcacagcagtacggctacggccagcccggcgtgctgcggatcccatgcgacgccgggcatttccgccgggtcgtcgacggcgcgctgcacagagccgactagccgcccggcgtcactagagcatgtgtgaatatgtatgcagcagtgccagtgtagaagaatatataattggatatatgaagtctattctttgattgntc

SEQ ID NO: 61368 - DNA, 395 bp, Triticum aestivum
  Clone ID: PAT_TA_61368
attatatctgtgattgattgcaagaagacaaaaacaaattgaagaatctcctgatctagttttcctcttttgcagaagcatgtccatcgattcttgccatggaagggttatggttgattgaatcccgctggatggagtcgtcatcgcgagtacagaggcagacgctggcgctgccgtgactaatgtcgccatccgtgccaagactcgttgctgcagtccgccgcgcgagataaagccggcagtgctgggaatcgcccgaggcgtcaagtaggtctggcctaatcgttgtgttagggcaaggtgctgataacgtgtgaaagtaaaaacgagatagggagcaaatgatggaacagttactttcattgatgaaggttgtggtatatatacccggatac

SEQ ID NO: 61369 - DNA, 562 bp, Triticum aestivum
  Clone ID: PAT_TA_61369
cccactcgtccgccagctcgagagtagctcccatggcagcgccaccggcgcgcgcctcaactgccacgccctccacctcgtgtccctccggtccggcgccgccgccgtcgacttctccgaccgcgtcggcgaggtcacgaagacggtgtaccttgggagcgacgccggcggcccgcggccccaccgcgtcatcacccagctcaccgcgcggtggtgttgtgctgcaggctggccagcgacctgcagcagccgacgaagcagggacagactagccgtcgttgcggtgaagcacctgaatcaccgggactaccgaagctgcaatgaagcgctgtaaggtcatcggagcttcgccggaatttgcaatgaagcctcgccagagctgcaatgcagtgttgcggggtcgtcgaagcttcgtcggagctgcaatgaagcgtcgcgggatcgtcggagcttcgccggagatgcatttaagcttcgtcggagcttcgccggagatgcattgaagcgtcgccggagctgcaatgaagcgtcgcggggtcgtgggagcttcgccggagatgca

SEQ ID NO: 61370 - DNA, 583 bp, Triticum aestivum
  Clone ID: PAT_TA_61370
ccacgcgtccgcccacgcgtccgcccacgcgtccgcggacgcgtccgaacaaaaaaaaaaaaaaagcggcggcgtcggaaggggatcgagcgagcagcgaaggcgaggcgaggaaccctaaatcccaatcggaaccctcaggggatccggcggcggcggaagtgctagctaggattggagaggttcggcggggatcaggccatggccacggcgcttcgccacgcggcgaggaggttcggaaccagagcggcggcggaggcggaggcggaggctatcattgagcgtagtccgctgtacactagcacacggatcgtcgattccaccacaggccgtgacctcacgcccaatcagaggaaagatgccatcttccgcttggctcaaatccatgcccagaaagaggacctctacaacacaatcgctgcctggcaagctgactacactgctaagggcaatgtagtgacccggaaaaacaaccttttgctcaaacaactctctcagcatgtcaaacctagacccgatgacccccgctggcgctcaagtcagcgggcagtatactttaatgatttcctcaaattacgggggc

SEQ ID NO: 61371 - DNA, 518 bp, Triticum aestivum
  Clone ID: PAT_TA_61371
cccacgcgtccgcccacgcgtccggagagccaagaggcggcgccgacgatccaccgagcccgagagcacctttgccgacggcatggcgctgctgatggagcccgggtcggagcccctgacggagggggagaaggccgacttggccgccatcgccgccatcaaggagtcggcggcgcgcgagtacagggaggagggcaaccagttcgtcaagaagggccggaagcactaccccgacgccgtcgactgctacaccaaggccatcgcccagatgggtgccctcgccgccccgaaccccgacgcctccgtcctcttcgccaaccgtgcgcacgtcaacctcctcctcggcaaccaccgccgcgccctcgacgacgccgagcaggccgtccgcctctccccctccaacctcaaggcgcactaccgggcggcgaaggccgcgcttgctctcgaccagctgccccaggcggcgtccttctgccggcggggggctcgagcacgaccccgccaacgaggagctcaag

SEQ ID NO: 61372 - DNA, 505 bp, Triticum aestivum
  unsure (1)..(505): unsure at all n locations
  Clone ID: PAT_TA_61372
acttgttcgacctgagcacggggatggccagcaccaaggcactctctgacagagctcacagagaagattctccagttcgtagaggccggacagatatcaagagaaccgttgatcctgctaaagtttgtatagaggataaactggagacaagtactaggagttctttaagcagcaaatcagatgcatcacccatgaagaagctactagcaaaccagatagccaaagaagtggaatcaaagagaaaaccaccaagtgttgttgccaggttgatggggcttgaagatgatctacctgctcaagaacaggcattacattctgccaaaagtaatttgaggagaagtcattcacatgataagtatgcagcaacaaagagggccctgcagcagcaagagcagcacctctacagcaaaacaacacggngcaaacacacaggccccaaggaaacagtagaatttaaggatgtgtatgcagtctgcgaagaaccattaagaacacatcatcttca

SEQ ID NO: 61373 - DNA, 283 bp, Triticum aestivum
  Clone ID: PAT_TA_61373
gctaagccctacccacagagcggcgcgctaagtttgccagaacactgacgctaacgccattgctggcaggcacactcctggaacattcaccaaccggatgcagacttcattcattgagccaggccttcttatcctgaccgaccccaggactgagcaccagactatcaaggaggctgcacttggaaacatacgcaccattgacttctgcgacactgagtctgctatacgttacattgatattggcattcctgctaacatcatggggaaacaaagcattggttga

SEQ ID NO: 61374 - DNA, 511 bp, Triticum aestivum
  Clone ID: PAT_TA_61374
gctgtctgtgtggtacaagagcagcaaccaccaccgctgccaaggagctccagctatcacgcgctcactcttgcttcacagactatgtatggtcagttcagaaaattggaggttttaggatctttggaagttctttgaggcatcacccttcttgtccgcagttgaaaggtcaaatgagtgagaccgtcgtttttgtattggcttcaagggaggatgatttgctgtgtacgtttcatttgctatcaaggccatcatgacttccactcatgtttgacacagtacagcgtgggggaggcggtgtcctctgcagctaggtctacttgctggcgacctcaccatcaccaaaccatctgcagggatggacatatggattgagtggtaccctcctgaaaagtagtggcaggcgttcaagacctggcagggctgggtcaaccggcccttcgtgttcaagacccggctctgatgagccttgacaaccgtcctactggctggacatcttcatcctgagcct

SEQ ID NO: 61375 - DNA, 484 bp, Triticum aestivum
  Clone ID: PAT_TA_61375
cccacgcgtccggccatgtgatcattctgtatgttgatgatagtgcctacatggttgatcttaagtcaatgcaatccacaaaacttgatggaagccgttcgatgaatcgctgtcaccctttcaccagtttctatccaccagacatggccatataagaagcgccgatataggaacatggacacgaggatacgggcacagatacaaaagcattttccagaaacagccatacggcgacacggcgagtatatacataaataaataaagtacaacatgtattgttgtgaggacaagagtatatttgtaagatgtaaggtcaaagtactgcccatttgttttccgctttcagttccacgtttgtatatggctgagcttaatgcagctgattctgcaagtatatgtgagtgaaaaattcaggaaagggaaaatataatacagcatgtaatatggacataattatatttgtaagatgtgggatcaagtcctg

SEQ ID NO: 61376 - DNA, 528 bp, Triticum aestivum
  Clone ID: PAT_TA_61376
gtggtgacagccgctgtctggtagtagtcaccactcatcaacagaccgactaccgacagcacacgccaccttccacctcaacttccctttcattccccaacatgtccaagactctcaaagtcgccgccattcaggccgagcccgtctggcaagacctccaaggcggcgttgagaaatccattcgtctcatccaagacgccgccagcaacggtgccaacgtgattggcttccccgaagtattcatccccggctatccatggagcatctgggccaactcgcctgttgaaaacgccgcttggatcaacgagtatttcaaaaactcccttgagagggagtcgcccgagatggaccagatccgagctgctgtccgcgaggcgggtgtttttgtcgttttgggatacagtgagagataccggggcacgctttacattgcacagtctttcatcgatgaaaccggtaccattgtcctccatcgtcgaaagatcaagccaacccacgtcgagcgcgccatctacggcgacggacaag

SEQ ID NO: 61377 - DNA, 225 bp, Triticum aestivum
  Clone ID: PAT_TA_61377
gctagggacatgtacccggttgtggtggcgcatccagtgcacagactaaatcctgctgacaggagaaggtcggtctcgtcgtcggcactcgatgtcgacattcccagcgcagatttttccttcagccaaggatgagacaagtttctgtattgatgttagtccaatgtatagccaacataggatgtcatgattcgtacaataagaaatacaaatttttactgagtc

SEQ ID NO: 61378 - DNA, 644 bp, Triticum aestivum
  Clone ID: PAT_TA_61378
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgttttaaagaacccaattttacgaccccggcctggcaaggtaaaagtttttttttggggcccccaaaattaatttcctgggccgggttttaaaaacggggggaggggaaaaaccttgggttacccaaattaaatccctttgaaaaaaatccccttttccccagttgggaaaaaaaaaaaaagcccccaccgaatcccctttccaaaaatttgcccaccctaaagggaaaagggacccccccctttaccgcccaataaaccccgggggggggggggtttcccccaagggggacctttaattttgccaggcccttagcccccgctcttttggttttttccctttctttttaccccaggttcccggtttttccccgaaaagtttaaaatggggggctccttttagggtcccaattaagggtttaagggcccctcaccccaaaaaattttgtttggggggatggttcccgaaggggccctcccccctaaaaaacggtttttccc

SEQ ID NO: 61379 - DNA, 316 bp, Triticum aestivum
  Clone ID: PAT_TA_61379
cccacgcgtccggagatgttgacacatcgatatcctagatcgccgccaggacatggacacccaaatggagtccgtcccacagattcattccgatccccccctcctcagtatctaaattcatgtgcataaggccctggtggtctgataaaaggttagataaccatgacatctcagattaaattggagatggtcaattataggaacaaattaaattgaagatggtcaattataggaatgaatttagctgagcaatcatttgaaatgatttcagaactgtgcacatctgtttataaggtttacatcaaatttactcgac

SEQ ID NO: 61380 - DNA, 654 bp, Triticum aestivum
  unsure (1)..(654): unsure at all n locations
  Clone ID: PAT_TA_61380
cggacgccgtgggcaagggcagaatggcagggtcgggaccgtcaccctgttctgcgctggcgccggcgaggtggacactcagcaacaggaggtacgacctcacctacaagcgcgcggggaacaaggaccccagcggctgggtcatgagccgagtacccagactcacctcgcctccgctcttgagcacggtgctcacccgcatcggattgaccgtcgccgccggggagcagaggaagcgacagccggccgacaggaggcgtttgctcagcagggccctgaaaggtgctggccgtcgcagccgctgccgccgccgccgaacatcaacgggtgtcaccaccgccatttgaagtcaggccctgacgcgcaagctgacgaatggtgctctctaccatgacgatcntagcgtcaccggcgtggaggagaaaccgtgggcactacactgttccgcttctgctcaacggccaagagtactacaaggacaaagcccgcgtcaaacgcaaacggcggcgatatgggggcatgagccttncctgatcgaacctgaatccatcgggagaagcncgcccgtacattttgatcacgaatacatgggtatgcaatccgttctacaatgggtttttgggggaaaaaaaaaaaaaaaaaaaaaaagggcgg

SEQ ID NO: 61381 - DNA, 567 bp, Triticum aestivum
  unsure (1)..(567): unsure at all n locations
  Clone ID: PAT_TA_61381
cggacgcgtgggcttttcttctcctctcttctcttccacctctcggcgacgggtaagtcacaggtacggtattcgtaatcggttcctttcgctgttcttcgtccgattgtattccaggcgagcgttctgtctcggtcgtcgtggtgctctttccgtcgatgtcgaggtcttagtcccggtggtttcaccccgtctgttccgttgatatcggtaccgtgttctgaacctttgctgctttgatttagggtcgcggctaatctattctgctttgacttctgatctgatctagggatccatcatgctctgattgcgatgtgatttagagccgtgccttatcatttatcattatcatggtcatgattgctgatttgatttaaggttgtgatgggtaatgggagattatatttggcgggaataacgagttccgttggtaacttggtatagatactggnaagcgggtcgtttnggtttaattttctggttcgttattcgcggnatttcgtctcgtcggnttaagnttggttccttggnaaaatggtttgaacatggatctgaatgagagattga

SEQ ID NO: 61382 - DNA, 494 bp, Triticum aestivum
  unsure (1)..(494): unsure at all n locations
  Clone ID: PAT_TA_61382
cccacgcgttccgaaaaaaaaaaaaaaaaaaaaaaaaaaaaaaaaaaaaaaaaaaaaaaaaaaaaaaaaaaaaaaaaaaaaaaaaaagttaactatatatagaataaaaaaattttttattttatatagagaaagatttattttttttttttttggggcctttttttttttttttggtggggctttttttatctttgttgtgtggttgataacttttcgtttccctcctcttttgctctcttttgcaataaacccttttttgccgccggtgggttttaacattaaaggcctttcgctgttttctcctttttaaaatgtgtggcggccttttttttgaaaattcctcgccttgttttgggagatttttcgccgcggtgttgtgtttggttttttccaccgcccgggtatggtcttctttttttttttccgcnttccccttttttgtctcccctttttttttttnccatctttttttttttctctctctttttttt

SEQ ID NO: 61383 - DNA, 662 bp, Triticum aestivum
  Clone ID: PAT_TA_61383
gacggcaggtaagggaggaggaggaggagagcggcggcgaagatggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatgggagagtatccacaagtccaaggctgagaaggcaagagagaagaaccctctctggatcagtttgaggccaagcgcgccaagagcaaggcaagcagggagaaggaagcatgccaggagggaggaagagattggctcaggcccccagagatcatgcaccagcaccagcggctgcagctccagctccagctccggcagcagcggca

SEQ ID NO: 61384 - DNA, 203 bp, Triticum aestivum
  Clone ID: PAT_TA_61384
atctgacttcatcgcaaggatcatgggcctcagtgaagcccctccatcgtacaggctcacgccacatctatcttgtgacccatctggcatgacctttgctttcggcggcgctggcgtctacgaggtgccggacaagaaggtgccgacccttgccacacaggtcaatgctttcacgaggctactcaatgctgggggttaatctt

SEQ ID NO: 61385 - DNA, 655 bp, Triticum aestivum
  Clone ID: PAT_TA_61385
atcgcctgcctccttcacctctgcccctccctctcgcgcgacgacgcgctcttgcacctcccctctccaggccgacctctcccgagccatcgcctctgcctccgattccgtctcggcgcccacccaagccgcctttctcaaggccgccgaggcggcgcaccaccccatgccacacgctttggcgctcttcgtctcctcggtacttcccaaggttgagcgtgatgcgagaatgcttctctgcgtcaaccgggcgctcaccgcccctgagctcgaccgcctctctgacatgctggtgccctccccgcttccggaggacctctatcctcctcccccactggtgacgtcctgggtggccgccgtaatcaagtcgcgcatcgaaggctgcaaatattcccaggaaacctcacgccagctggttgaggctgcattgtccaaatatgctcagcaaataggccaacattacgagctccatttagtctgtggcataaatttgttcatccaatccgaagccttttggcacatcaacttcttggcacggccaaaggacgcttgctggtgaactgcccatttacttcttcgccgagcaacggttgcaatgggcgaggacgacgaattccagaggaggatatcgtcttgtgctgcccaatcaaccgct

SEQ ID NO: 61386 - DNA, 622 bp, Triticum aestivum
  unsure (1)..(622): unsure at all n locations
  Clone ID: PAT_TA_61386
tatccatttcgatggcgatggcgatggcgatggcgacggcgacggcgacgggtttctctggcgacggcggcggcgacgggttgagggctgcggggatgccgcggcgaggaggggcagatgctgcggaggcgacacagtgaggtggggcagtggcggttgtgcggcaaggcagggcaggtccgcgcccacgccagagcgctgctttctgtgcacgcccgcgtgctcgcccttcagcttgcctctgcccgcaccccaccacacgcgcgccggccagcccagccaccgggaacgcccccttcctcctacccccgatctagatttcccaaaacgcctccccagacacccgtagggcgccnccgtcgatccagcttcggctccacagctggccagcgccgcactactgccaaggacgggtgcggacacgccggcggcgagcacttaccaggtgaccaacacctccttctctcttcctctcagcctgctgctcactctgtacatacgcactcgatgtgtcctgtgttcagaatttcggattgggcctgtgtacttgctcttgcaacttttacttggggaattcttgaattccctcgcacgtgtgctggaatcgagtactaaatgtcgt

SEQ ID NO: 61387 - DNA, 274 bp, Triticum aestivum
  Clone ID: PAT_TA_61387
ggccgcccagccggctccgggagatgttcccgtcactgtccgccgcgggcttcgacgtcctcagcgggctgctggcctgcaggccggacaggaggctcaccgccgcggaggcgctccggcggccctggttcacggacgccgagtcggccgacgctgaccagcctctcaacgcatgcggcgggcgcttcacggcgcgcgtcggtggcgttgctgacgcgatcgttgtatagaaagctctagattcgtcatgattcaacattcttttaatcggctg

SEQ ID NO: 61388 - DNA, 651 bp, Triticum aestivum
  unsure (1)..(651): unsure at all n locations
  Clone ID: PAT_TA_61388
ctcgccggcgatgtcgatgccgttaccggggcggacgctcgtcgacctcgacggcgacgccgctggcccactgcgcgcgccacctcggcgcccgcgacgtcgccagcctcgccatggtctgccgcccgctgcgcgccgccgcctactgcgacgccgtatggtaccacctctacagggggcaatggccatttcaacaagtgcctcatggagctttagggattagagaactgtacattcggaggcacactgaagtacatcaaatgaaatttgatgatcccttatcatctatttattatctagatcccacggagccgacaccaatccatctaatgcttgataggaatggtgntttggttctctcaagggccagtagtcaaaagattgaggcttggtctggacatggaattagtggaaacctacaggacccatagtgcgaggatcacctgtatgagattattcccactaatcgacaccccgttgtatcgaagtgatgcacatagaaatgaaaaggcattagtcacttcaagcacagataggacagtccgtctttgctggaagggccaatcacgctgttacaagggccattcaggacctgttactgctctggctgacaaattgcttgatgacggtgaatgtaaaatactcgcaact

SEQ ID NO: 61389 - DNA, 348 bp, Triticum aestivum
  Clone ID: PAT_TA_61389
cgtcgccaagccgacctgcaagacggcgccgcaggcggccctcgacgcgtgcaggaacgactgcaacttcttcggctaccccgcgaacaaggcctactgctcggccgccgaaggcggcatctgttgctgcctcaggtagtacgtagaagaagctggcgacgaaggtggacacgtgtcgtcatcatgtgctagctagaaaagccaaccgtgaatcagttagtcagtcaattccctttttttttgtaacggagaaatcaagaatccatccgtcgagcctgcattgtttacgcagacgcagaagaaaataacaaggtcaggagaaaaatttcaataaatatgaacgtcgaa

SEQ ID NO: 61390 - DNA, 419 bp, Triticum aestivum
  unsure (1)..(419): unsure at all n locations
  Clone ID: PAT_TA_61390
cccacgcgtccgcccgcccggcgtcgaacaccccgcgcgcacaccgccgccgccgtcgaccccttcctccctcccctgatggcgttcgcgctcaaggcctccgcctcccccgccctcgccgcgtcctcggcggcggcggcgtnnnncccctcgttctcggccgactccgcggngccgaggggccggggggggggggngaggagggccgngctaagcggggccgcgcgcccagcggccgaaatgagggcggaggcaccgtctccgctcctgccacaggcgcggtattagacgagcgatcaagacaggtcaatgactactatgaggaggagataaaaattgatcccttatgtcaatagaagtgctgaagcatgtgccagatgttgaatatagaggaagtagactatgtgtgctttggacgc

SEQ ID NO: 61391 - DNA, 388 bp, Triticum aestivum
  Clone ID: PAT_TA_61391
aaaaaaaaaaaaaaaaaaaaaaaaaaaaaaaaaaaaaaaaaaaaaaaaaaaaaaaaaaaaaaaaaaaaaaaaaaaaaaagggagaaccgatctaaagaaacacaagcttcaaaacgcatacatgcaaaaataataacattttttatagggtcccctaaaattcattttactggggcggcgtttttcaaaggcccccctgttaaacccctggcgttccccaacttattccctttttttcccatccccctttccccagctgggggcctaccttaaagccccgccccgttgggcccttccccgcggttccccatttctgattggctttatggaaccccccctttttccggcgctttaaacgcggggggggggggggttcccccccctttcc

SEQ ID NO: 61392 - DNA, 460 bp, Triticum aestivum
  Clone ID: PAT_TA_61392
gagctgagatctggagtgaccgttactacactatccaagcataaccacgctgccttgcctcttcatagctctgtatctagtgatatcgctactcgcagacacacgtggcctttgcatgacaacattgttcacagtgaaaaccctgtcgttaccacagaatacctgcactggtatgcacgatacacattacagcctataccagattaacgcagacgacctgaccaatctaccatcaccatctaatgcatcatgctgaaactcgaactgcatcgcaccctttatagtatcattaatcgcgctgcatgattagtatacgcgcatggtaacaactatacttaacttggatctaatgccctttccttgatcatatgtatcccttccttgctcgccacgctcctcaactatccaccactacctcataaacttgccatcatccacttgactgtcaccaatgcatggc

SEQ ID NO: 61393 - DNA, 576 bp, Triticum aestivum
  Clone ID: PAT_TA_61393
ccgacgcctggccggacgcgcggccggacgcgtgggtaacgatgccacaccgcacggactttccgccgacccggaggcgttcgctaggaacagggcgctggacgtgatccacggtacgtggggtgccgatgcgtacgacgctcttgggcgcgtcttccccgaggtgctccagaagcgtgtggccgtcgagttcaaggagcccgactggttcatggccggctcgaagatcttctgccgagcggtggcctcaacgtacctatgggaacccacaacctcatgcacgctcagagcatccttgtcgtgctgggctatccacgtccttcctcatgggcctggtcgaagggttccgcatgaatggtctcgacggcggctgggagggcaactacctctaccccggaggccagctacttatacccgctcggtcttgccgacgaccctgtcaccttcgctgagctcaaggtgaaggagatcaagaatggccgtctcgccatgttctccatgtttagggttcttcgttcagctatcgtcaccggcaagggcccattggagaacctgttacaccacctcgactaccct

SEQ ID NO: 61394 - DNA, 605 bp, Triticum aestivum
  unsure (1)..(605): unsure at all n locations
  Clone ID: PAT_TA_61394
ttcatttcgaacacgtaacccagaaggcaactgagagagatatccatggcgatttggagccccccctcgccgctcgtcggttttgttcgattcgattaaagtatgggcagaatcatgaagggtcttggtaagggcttttcttctgcttgcttagaagagtctgatgattttgatggggatccttttgtccccaatgatttcgccgaggacgattctttccaagcttcagaggaaggttcaatggatgatcctgattttgacaaagctttgtatgatttctatgtgtcgcatcgaattgcctgaaacggaagatagcagatgttggagctcgcaatgtgaagcgcacgaggtcttctgattttcccgtagcaaatacattcactagatactctagcaagttgttctccactattattggcggcttgtctcctcagcaagtacgtgttcttcagagttatggggcagattgccttctcaaatttgtgaggacagaggtgccatttaggtttgtcaaatggctagcatccaatttgatggtcgtgcttcagtgattcagatagganaatgtttattccgatttgcgaatatgtcacccatgatatatt

SEQ ID NO: 61395 - DNA, 603 bp, Triticum aestivum
  Clone ID: PAT_TA_61395
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctttaaaagaacccaattttcctaccccggcctggcaaggtaaaattttttttatggggcccccaaaattaaattccgggcccgggttttaaaaccggggggaggggaaaaccccgggggtccccaaattaaaccccttggaaaaaaacccccttttccccaggggggaaaaaacaaaaaagcccccccccaaccccctttccaaaaagtggccccccctaaagggaaaagggaccccccctttaaccggccaataaacccgggggggggtggggggttcccccaaggggaccctttacttttgccagccccttagcccccgctcttttggttttttccctttcttttccccccagtttcgcgggtttcccccgaaaagtttaaaatgggggccccctttaagggtcccaattaagggtttaagggcccctgaccccaaaaaaatttgtttagggg

SEQ ID NO: 61396 - DNA, 99 bp, Triticum aestivum
  Clone ID: PAT_TA_61396
cttccttgtttgtcctcgtagatgcatgcttaggtcaaaccgtgtgtttctcttctgtatgtgcttcaagattcttgcattaattaagatggtaccatc

SEQ ID NO: 61397 - DNA, 532 bp, Triticum aestivum
  Clone ID: PAT_TA_61397
cccagcgtccgacggatcaattttttttattctataaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaagggggggccgttttaaggatccaagtttaactaccgggggttggaaaggtaaaattttttttatggggcccccaaatttaattcaaggggccgggttttaaaacgggggggcggggaaaaacccgggggttcccaatttaaaggccttgggagaaaatccccttttccccggggggggtataaggaaaaaggccccccccaatcccctttccaaaaattggccccccctaatggggaaagggaaccccccctttggggggccttaaaggcgggggggggggggggttccccccagggggccggttatcttgcccgggccctttagccccccccttttgcttttttcccttttttttttgcccccgtttggcggggtttt

SEQ ID NO: 61398 - DNA, 567 bp, Triticum aestivum
  Clone ID: PAT_TA_61398
agacagcccagcgaccggtccacggcagcgcagctcttggatcacccattcgttgcttccgccgctgccgccggcgactataaggctgcgccggcgaagcaacaatacacgtctcccaagagcacactgcaggacgcactctgggactcggacaccgacgacgaggcggacgagatgtcggcgacgccggccgagaggatcggggcattggcctgcggcaactcggccctgccggactgggactcggacgacggctggatcgacgtgtgcgacgaggtccacagagtccccgactcgccgccggccgacgcgggttacgacctcgtttggcccgaagaatctgacgcagagcgcgagccgttcgcggttgctgctgacgacagcaacgacatcccgcgcaatgcagtggtgaccgactcctccatttggcaggacagttacgtgcgccctgtgcatttaggcagctgtagaaatcaatttcacccgtttcagtctgacggggatgaaaacttgagatttgatcgtcgttgtaacaaagacagagtaatggaattcatttttttgctc

SEQ ID NO: 61399 - DNA, 589 bp, Triticum aestivum
  Clone ID: PAT_TA_61399
cccacgcgtccgcccacgcgtccgcttccatcgcctccccaagatcgcagatccgctccggtgagaatccgtcgccatgtcttccagcgaggtcgcctgcacccttgccgccctcatcctccacgatgacgggatccccatcacttccgagaagatcgcgacggtggtgaaagctgccggaatcaaaggtgaagcctactggcccgcgctcttcgccaagctcctggagaaaaagagcggcgatgacctcatcctttccgtcggatctggtggaaggggggctccaactgctggtgctggtgccccggctggtggtggtgctgctggcgctgaagagaagaaaggagaaaagaaagaagaagcccaggaagaaagcgatgatgacatgggcctcaacttggtcgactaaactggtcaattccaggtcttctgtgggttcttctatgcgaaagacttggcttatgtgcttttaaggcgaattttgaaaaattattatggtatgccggttgagactaaatatctgggccatgagtaccggaaaaccttcttgggaagggcttggtaaaaagaaaatgggtctacattaaaa

SEQ ID NO: 61400 - DNA, 426 bp, Triticum aestivum
  Clone ID: PAT_TA_61400
ctgaaatttcgagaacgacatgtgccagcgataatgcacgcgacacggtttcttctcaagcgttccgtgtggaaggggccacacttggtgcccctccccattgtctggcccaagtccaccagcgacaaggtgcctccggtccgaacacaagcccgatcagccacgatcctgcccaactttgtcggtctcaagttcgaggtgcacaatggaaaggattaccacgaggtgaccattactgaggatatggttggacacaagcttgtacaagaaagcccaatatttgggacaagaggtagtctgttgggataggatgagaactggaatctgagtatacccatgtacaaaaagaaaactacatgtaacatcactagagcaatgatttcaacaaagggatcgatcgatacacattgaaaggcgatctattgc

SEQ ID NO: 61401 - DNA, 99 bp, Triticum aestivum; identical to SEQ ID NO: 61396
  Clone ID: PAT_TA_61401

SEQ ID NO: 61402 - DNA, 515 bp, Triticum aestivum
  Clone ID: PAT_TA_61402
aaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaataaaaaaaaaaaaaatgggggggccctttttaaagattccaggtttcctaacccgggcttgcgacgtattatttttttttttggggcacccaaaatacattgccttggcccacttttaacaccttgggaatgggaaaatccttggcgttccccaattaaatggctttgccgaaaatccccttttttccaattggggaaaaaccaaaaaggccccaccggatcccctttccaaaaatttgtcaaccctgaaggggaaagggacccccccctgtagggcccctttaatcgcggggggggtgggggttacccccaggggtaccttttcctttttccaggcccttagccccggttctttccgtttttttcctttcttttggcgccctttggcggtttttcccggtgattttttaaacc

SEQ ID NO: 61403 - DNA, 558 bp, Triticum aestivum
  Clone ID: PAT_TA_61403
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttaaaaaaataaaacttaaaaaacccgtgaatgaaaagaaaaaattttttaaaagggcaaccaaaataaaattaattggccgtgttttaaaaacgtcgaaactgaaaaaaccttggggtaaccaaaataaatcgctttgaaaaaaatccccttttcccaagttggcaaaaaaaaaaaaaggccccaaccaatcccctttccaaaaatttgccaaccctaaatggaaaatggaacccccccttaaccggcaaataaaccccggggggtgtgtggggtaaccccgcaaggaaaccgttaaatttgcaagcccctaaacccccgttcttttcgtttttttcctttcttttttcccaacgttcgccggttttccccgtaaagtttaaaatggggggctcctttaagggttccaattaagggtttaacggaacttcaacccaaaaa

SEQ ID NO: 61404 - DNA, 414 bp, Triticum aestivum
  Clone ID: PAT_TA_61404
gaacggccttaagaaagaggcaagacacgcgagggggagagagcgcacccacgacggaaacggacccaaggcgaggcgaccgcaggaaaagagaacgcccgcgacaccaagggatccgaacagataaacgacgacagcccccagacccgcaagggccgggccaagcaggaaggagacgaggacgacaagccgaggagacgagacgagcaacgacatgcacgctcaagagggagaacacgatgcaaaaggaggagagccccagaaagaggccaccccgcccacccaagaggagcggcggaacagacgaccagcaacacgcaccggcactacaagggaacagacgagcgaaccgggagtgacacagaaggtagagacccacgcacggtgcaaacacacaaacacaccacatccagg

SEQ ID NO: 61405 - DNA, 597 bp, Triticum aestivum
  Clone ID: PAT_TA_61405
gtagcttcaaaattaagtatcattcgcatggatcaactgttattttattttgtggaggataaagttcagatcatgaataatggcattacaagtcaacttggcacaattacacatgtcctgaatctcatagaatctgacactagcaagtcttcattggcatgcaagtactattacattgtcatgacaggaacaattaattatttgacatgtatcattggtactgctaaaacatttcgttcatgtttcaacaaatttggtgaagaccacttcatatgtattttgcatatatgaattatctcctgttgctttctaagatgctatttctttcagttctagccctcctatctttaattcctggctgctggactacctgcaggacaacgagttcatctgcggcagctatcgctgtgagcagtccgtccgcgacgcgctccgcagcgtcttcgtcgggcacaacgagatcctcaacgtctggaaggattaagtggagaaaaagaagaaaagattattagaagattagttttaagattttcttttatttccttgcaattttccttttattggatacttgtgaagacattgtaatattcttactat

SEQ ID NO: 61406 - DNA, 567 bp, Triticum aestivum
  Clone ID: PAT_TA_61406
cggacgcgtggggtcggttaatgtactgtccctgtgtttgtggatcaattaggttgttaagaaccgattgaaagttggctagaaggtgcgacactctcattcgtctagtggagaaggagaaccaagagtgtgatgagcgtgatagacaggccaggaaagataagaagaacatgacaccaacaaagcgtccttcgtcaagtagtccaatggactctcccatgcagaccccctccaagagggggcggagggacggcagtgcaccctcgggaaagagaaggcggcgatgatctagtgttccctgaggaacaaactcgtttggcggttgacaaccaaagggaagccccagacgtacccgtttatctcatccagtgtgtttgcgcctagttatagtagcccaaaacgtaatagaggtcaccctcaagtctgaaccagttaaaagagaactccgaagtctgaactcctatgttacatagattccagtgacatggtgaacttatgtcggttaatgtactgtccctgtgtttgtggataattaagttgttaagaaccgattgaaagttacactcc

SEQ ID NO: 61407 - DNA, 589 bp, Triticum aestivum
  unsure (1)..(589): unsure at all n locations
  Clone ID: PAT_TA_61407
tccgcacgggcctcccgtngagcaaagctgccgagcatcatctcgtcctcctccacctgcgtcaacgccgcagtcaaaactccacattcccactcccaccatgccgcccgcccggctggccgcgccggccgccgtcctcctcgtcctcctgcacctcgccgcgacggccacggcgaccaacttcacctgcagcgcgccgcggggcaccacctgcgactccgccatcggctaccgcgtgcccaacgccaccacctacggggacctcctcgcccgcttcaacaccaccaccctcgccggcctcctcggcgccaacggccgcccgctcgccacctcccccaagacgcgcgtcgccgcccaggccaccgtccgcatccccttcagctgcctctgcgccggcaacggcgtcggccagtcggaccacaagcccgtctacaccgtgcagccgcaagacgggctggacgccatcgcccgcaacttcttcgacgccctcgtcacctaccaaggagatcgccaccggcaacaagatcgncgacggcaacctcattactatcggccagaaactctgggatcccgctgccctgcagctgcg

SEQ ID NO: 61408 - DNA, 485 bp, Triticum aestivum
  Clone ID: PAT_TA_61408
acgcttgactctgctcatctatgacagaaacgcgagggaattcgtgcgaattacagatcggggaaagagatggcatctactatttcgcataatatctagagctatcgtcgataatggattcaccactgccctacataatctaccttggctatgtgtataagacgctaatcaccaacactactgtgctgcgatgctctgtcttgcaataccatgctctgcctgtttattttgttctccacgtcgtaaatgctgtccttctgtggaagtatagatgcctacttatggactacattgcggctaaccaaaatgagcgtacattcctgacaccattgggggtaaccgaaagattgtagttgatgattaccaaagcgtgtgcgcccacgtatttgtcgctcttgtaactaggcgagtgcgtggaaaacatgcacatggcctaaagcttgacatagtgcgagcaattaggggtttcatcttggctctgaaaa

SEQ ID NO: 61409 - DNA, 177 bp, Triticum aestivum
  Clone ID: PAT_TA_61409
gaagcctaccaaatcctatttgctgtatgtaggttccagtccttctcatctggagccagcatgggaggatatgaattcctggtaccaagttcaaagacagacaaaagtactgaccttgatgaagcaaagggacatttctagcagatacataccacagatggtagcttctggacgtgt

SEQ ID NO: 61410 - DNA, 373 bp, Triticum aestivum
  unsure (1)..(373): unsure at all n locations
  Clone ID: PAT_TA_61410
nncgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaaaaatccaagttaacgaacccgggcatgcaaagtaaaagtttttttatagggcccccaaaattaaattaacggggcggggtttaaaaacggggggacgggaaaaaccctggggttacccaattaaatcgccttgaaaaaaatcccctttttgccagttggggtaaaagcaaaaaggccccaaccaatcgcccttccaaaaatttgcccaacctgaatgggaaaaggaacccc

SEQ ID NO: 61411 - DNA, 548 bp, Triticum aestivum
  Clone ID: PAT_TA_61411
gcagtcatctcacaaactattaaatcacccaagttcatggcaaaggtaatccatggaccacctacaaaacgttactcaaactccaaccgcatggaaaaacccaattatcaaatcaaaactgacgaaagcagtttatgctttttgccgtttcgccccgaacgtcggtcaccatatatagaaaaactaaaaaaccaacgcaacgcaatacaacgggggcaccagcacggttacaaatagcacactcaactcgacggcagcaaggccacaacgtccctgagccctttaactacaaccatcccagcgaactcagccgaaaatttttttttcctttttttcactggcgccatgctcgaataatgggacatcccatccagccggccactcctataggggcactagggccacctgggtggggttctttttgatcaccgccgttgccctacttttaagtcgccgaaactcgaccacaaaaacgctgaatgttgtccttgctgccgcgtgcgatggcgagctccaccacacgcttgcggagtcggccgccgtgctcc

SEQ ID NO: 61412 - DNA, 189 bp, Triticum aestivum
  Clone ID: PAT_TA_61412
tccggcactcgtacgacggcgagcccattgattccttggtctaccggcaccacacggcaggcattcgatgaccgcgagcagatatcctcaaacactagatagcacccccctggagctgctgttaaaggagggagggaggacgaatgactcatggggctactctatgtagcgctggcaatacagagtacc

SEQ ID NO: 61413 - DNA, 599 bp, Triticum aestivum
  unsure (1)..(599): unsure at all n locations
  Clone ID: PAT_TA_61413
aaagatagtttatgcaagaaaagacaagtgtttgaaggaaggaaacaacaagcaggactactggaggcatccttgggatcggcacgagctgcagcagctaagtattacaatggatgactttgaggaagccatcaccgaaatagttcaaccatcaatgagaagagaaggattttcttctgtgcctgatgtcacatgggcttgtgtcggaggtcttgattcattaaagaaggaattggaccgctccatcgttcaatgtatcaagtatcctgaatattataagaaatttggagttaacatgcaagctggtgtgttgctgtttggacctccgggctgtgggaaaacactaatagcaaaagcagttgcacacgactcaggggctaattttattcatattaagggtcctgaagtattgaacaggtatgttggggaagagtgaatcagatataaggaagatattcacccgtgcacgaatcaactccccgtgcattctattttttgacgaggtagatgctctgacaacaaaaagagggaaggagggagcatgnggttggttgaacgtctcctaaaccagttacttattgaacttgatggtgctgatc

SEQ ID NO: 61414 - DNA, 593 bp, Triticum aestivum
  unsure (1)..(593): unsure at all n locations
  Clone ID: PAT_TA_61414
caacaattgctccatgaagaagaaagtggaacgctctcttgcagacggccgcatcacgcagattgtctacaagggcgcgcatgatcacccgaagcccccctccacgcgccgcaactcctccggctgtgcggcggtcattgcggaggatcataccaacggctcggagcactctggcccgacgcctgagaattcatccgtcacattcggagacgatgaggccgacaatggcgctgagcctgagaccaagcgccggaaggagcacggtgacaacgagggcagttcaggtggcaccggcgcctgcgtgaagcccgtgcgcgagcccaggcttgtggtgcagacgctgagcgatatagacatactcgacgacggcttccggtggaggaagtacgggcagaaggttgtcaagggcaatcccaaccccaggagctactacaagtgcacaacggtgggttgcccggtgcgcaagcacgtggagcgggcctcgcacgacaaccgcgcggtgattaccacctacgagggtaggcacagcnacgacgtggccggtcggcaaggggggcccggtgccagccgcgcctgnccgacgtcgtcttcct

SEQ ID NO: 61415 - DNA, 541 bp, Triticum aestivum
  Clone ID: PAT_TA_61415
tcccaaacaatttggaagcagcaagcagcagcagcagcgcaagaagaatttgttagagaaactgatatggcgtccatgatgggaggggacttcgtggaggcctacgtgctcaagaacgcctacaaggagaagctgaggcgcatggaccaagcggaagccgccgcggcgctccacggcgcgaagagcagcaaggacaaggaggacgccggtgccactggagagaagaaggctgctggtggtggtggtgcgagcagcaggggaggattctttggcctcatgaagaagaaggtgcaccccaaacccaaagcatcggcggcgacttcctcttgattatattactgtagtacttgccatgccacgaaattgtaagccgcagctttcttctacgtagctagtagcgtgcgtgcgtgcgtgtgtgtaactttgttcctttgatcgattagcttctcttggaggagtgtgtaaagcaagttcttttgttaattggtcaaaacaagttgacaggaattcagtcatgaatgatcctgcattaattgggttg

SEQ ID NO: 61416 - DNA, 632 bp, Triticum aestivum
  Clone ID: PAT_TA_61416
gcctggtgaggtggtactggctaagaggagcacgagtcgccaccaccatgtaccagacgatgctgtcgaggtcggcattgtactgactgtcgatgacctacaggtacgtctttctttccctctctctctctttcaaatgtcaagctagattccctcttattttgcagattggaaatgtcccgaaagttaattgactgaaatgccatgtcttgcgaaatgctaatgccatgatgattagattgagcatagtactgttgtttttgaaaaatgttgttgtacatgtgttacttgcaaatttaactctagagcatctatttgggcgcggtttagcattgcagcattatggccagacttgcattgttctcaaaatgaaatgatggtctaatcctcagatgaaaatactctttgtctctcatttatgttaattgaatagttacttgatttgatgttggttaggatttgtgtggagcgagcaactattctgtttgaccatcactcatgtaaatgtattgcctgctatttctaatttttgtttgtcccattctgtaactacaacttgcacagtaagaacaatcagaatatgttgcatggtatggcattgattggccaactcattatcttctccaggctac

SEQ ID NO: 61417 - DNA, 604 bp, Triticum aestivum
  Clone ID: PAT_TA_61417
gcgccacgaagggggacgaccaggacgaggtctcggaggaggacgtccacaagatgccgtacctcaaggcggtggtcctcgagggcctccggaagcacccaccggcgcacttcgtgctgccgcacaaggcggcggcggacatggagatcggcggatacctgattcccaagggggcgacgatgaacttcatggtggccgagatgagcagggacgagcgggagtgggagaagccaacggagttcgtgccagagcggttcctgccaggcggcgcgggcgaagcggtggacgtgaccggcaaccgggagatcaagatgatgccgttcggcgtgggccggaggatctgcgccgggctgggcatcgccatgctccacctggagtacttcgtggccaacatggtgagggagttcgagtggcaggaggtcgccggcgaggaggtggacttcgccgagaagaacgagttcaccgtcgtcatgaagaagccgctgcgcccacgcctcgtgccacgaagggcctgagacaaaatccatctccatcagcaagtagtcaaaatcgaccagtagtccactcctatcgcttcggtcgttcttgtttttagtttactcca

SEQ ID NO: 61418 - DNA, 487 bp, Triticum aestivum
  Clone ID: PAT_TA_61418
cacttcgaacgccttcaaaccccgctccagtctccggtaaaacagacaaagctacaggaccgaacccgagcacaaagctggaggcactgcacgcccagcgcctcttcttggaccaatcgaattcctttatcccttccacttccgccgcgtggccacggccacagacgcgccggagcggcgccgccacctgccgagccgcccttcgcgagccttacagcattcacacggcgcaggacaggctcagcctgaagctggactggatcgacggccggtctccccggagcggacgtcgaggcggctccgtgtccgtggagaagctccgggccatcgcggacgcggcggcggaccgggccgagatgcgcgacatcatcggccggcatggcgacaactggaaccacctggtgctgcactccaccaattacctcacgctcgccgtgctacgacatggctgtgctcgcgcccgccgcgcccggcgtggacgcgctca

SEQ ID NO: 61419 - DNA, 133 bp, Triticum aestivum
  Clone ID: PAT_TA_61419
gtataatatgttttagagaccctccatttacagtgtaattttcccattttacagtgtaatatgtcctagagacagtgaattaatgtaatttgtgcaagaactactgtgtaatatggactagattttctcctgc

SEQ ID NO: 61420 - DNA, 595 bp, Triticum aestivum
  Clone ID: PAT_TA_61420
ccccgcgtccgctctttctctccttcctcccatggagtcggcctagttctgcccgttgagagcgctcatatatcctcgagacctccagatctgtggtctgttgcagtctctgcctcctcacaacaacaagcccctgcagatggacaccgccatgcaccccgccgccggcgacgacgacgtcctcgccgacctgctcaccgtcggcaccggcaccgacaccgagggcattatttgtggtatgccagacttcaagatgggtggaaagaggggcgatgaatctgcccctactgatgctggtgatgaagatggcgaagatgatgacggggacgaggatggcgacttcgcggagggcgaagaggaaatctcggaaggagaggagtatgacaaccccaaggccagtgacgccaagaagaaacaaataggcgagggtgaggagaatggcgaggatgatgaggaagaacaagaggagcaggaaggtggaggaggtgacgacgatgatgacgacgacgacgacgatgacaatgaggacgatgacgatgatgacgatgaagtcgctgctgaagacgatgaggatggagtagaagaagaagatgac

SEQ ID NO: 61421 - DNA, 371 bp, Triticum aestivum
  Clone ID: PAT_TA_61421
ccggggctccacatgaatgtcttcagggacctggcgtcgccggaggcctcgctgagggaggccgcggctgaggcgctggtggccgagctccgggacgtgcagagggcgtacgagaaggagaaggccgcgcgggaggagggggagggggaagagggggatcgcgacgacggcccttcgcagatgatggaggccgagaaggaggacgggttggataactgcgcgcccgccgtgcggtatgccatccggcggctcatccgcggtatctcttcctctagagaggttaggaatgctgtcctgagtctaggacagaacctacgttctgtgatgtaatggaatgattaaactgcagcgacacacttcaattaattgct

SEQ ID NO: 61422 - DNA, 594 bp, Triticum aestivum
  Clone ID: PAT_TA_61422
gggagaaggttctagtcagagagagagagagatagagagaggttgggagggaagaaggaggcggcggcgttcccgtctctgtcggggggtttccagctctctccggccggcggcacggcgcgacctcgtccgcggctgtcatgaaaagatacatttggtaggcaaagctcagcatgggttcaggaaatctggtgatgaagaaggtggtgaagcccagctcttttgatctcgacatacagctcgacaagagttggacggaggacgttacttgcccgatctgtctcgatttccctcacaacgcggtcttgctgaggtgcacatcttatgagaagggttgccggccgttcgtatgcgacaccgacaagtcccgttcgaactgcctcgagcggtttaagagtgcccatgggcagccggtgaacgtgaaggtctcggccgttaacatcgccccccgtgacagcatccatttcatctcttcaaacacaaacaaccacccggcttgcccgttgtgtagaggcgatgtcatcgggtgggctgtcatcggcgaggcgcgacagcacctcaaccagaagaaaagatgctgcgaagagagctgct

SEQ ID NO: 61423 - DNA, 357 bp, Triticum aestivum
  Clone ID: PAT_TA_61423
cttctgccggtattggaagttggtttgctctgctccaacgactcaccttgcgataggataaagatgagcgatgtggtcgttatgctaaaaaggattcaaatgaagtacactgcatggacaacggagacatcacagagtgcaacatcatgattgatcactcttgcttcgatatattaatgtatatccttttagaaaatggaacattgtattacccgttgtcttaccaattgacgtatactagtcatcaacccgcgcatccgcacgggctagtgattttgaaaacacgaaagtaaggaaacggaagaacttttcctgttaatattgtaagtgtttgaaatgtatgcgaacttcgaaggc

SEQ ID NO: 61424 - DNA, 615 bp, Triticum aestivum
  unsure (1)..(615): unsure at all n locations
  Clone ID: PAT_TA_61424
actccgggacgcggccatccaagctgagtcgagcagacgccttgctggaaggacgatgcgacctgctgtctactcgcagagggatcgacatcaccgaaaggagctatcatcagccttcggggatatagacaagcgaatatgcatctgcaaaattgctgccagtgcgcaccctgcttctcgcgagagcacaggncggatgaatcttcccggcacgactgacagcagcgatacacattgtgacggatataatgatcgattctggcttgttaaagggcgacctggagtcggataacgacggaaacgagctcttcctacatttccacgacgatagcgagactatgacagaagcggagtttgctcaagagattgcccagcgctaccacaacattgagaacctatggaaaacaatacaaggcagccaacgaacgactaagcagcagcaaggaatacgttaagcacgttgtcaaggagcagaggcgggctgataaggactcgggcgaccctggagttggcttcgattctcaaatagaagatgaagatctcatgacaggcatcatggcacatggctagaaagctaggttatcggccctgtcgtgtcttgaaacttgctggtga

SEQ ID NO: 61425 - DNA, 568 bp, Triticum aestivum
  Clone ID: PAT_TA_61425
cccagcgtccgcacctaatagatgaaatccccatgtgtttggtgggtatgggcccatttccatccctacccatccatcagccgccggccctcttccttcgatctgcgctgccggcacattcccgcccctcgagccgaatcgtgggcggggcactggtggcgacgctgcgccctggctacgcggcgtccaaggcagccgtggaggccatggtgtgggtcggcacgaaggagctcgggtgacggtgacctgtgacgcgtcgggccgtggctatggagctcttcttcacggggaaaagcgaggaggactcggggaggtcacaccgcgacggtggtcaggtttctctgcaccgctcctgcgttgatgctgggcaattttgactgaaatcagcgcttcttgtttgactggaatctgttaagcataacagtttgtgtacacctccagtagatggacatagtcagaaggtgggttcagtaactgatgtactgcagcgtctcagacacacgattgtttgcctgcacgttgtacctttgttctctgaatcagtgtaatcaagtgttcgtttgcattc

SEQ ID NO: 61426 - DNA, 522 bp, Triticum aestivum
  Clone ID: PAT_TA_61426
gcaataacctgggactttgtggctctctattgaacatttcatgtaaacatggttcaagtccgacaaccacatcagatgtgggaaaggaacatcatgatgaacttgaaaccatgtggatgtactgctcagtgatcgctggaacaatatttggtttctggatatggtttggcacattgtttttctggaagccctggagatgtgctttcttgagttgcatagatgccatgcaacagaaagttatgaggaagatgaaggatatctgaggtatagaaagctgtccaagtattgaatgataccacaccaaatgaagatgaagcaagatgtaagcgtcgtgataattatatctgtttctgttcccagtacgctcaagaattaccaacgttccagtggacatattttgtttcaaggttctagacaagtttgtggtgtagctttagtcaggctaatggtttgtgtctcgctcatgtttttgtaagcgtgtgttgtaaatcttataatatttctaaagcctattgtgcttga

SEQ ID NO: 61427 - DNA, 491 bp, Triticum aestivum
  Clone ID: PAT_TA_61427
cccacgcgtccgagctgagatagttgatccatcattgcactacaactattctgaaagtgaggttctcaactgtgtacacattggactattatgtgttcaagagagtccaagtgatagacccggcatctccaatgtgatcctcatgcttgttggaaggtctactaccttgcctgctccttccaggcctgcttttctatttaggttgaataatgagaaccatgtccatggtgatctcaatgacctactagatgactcgaacaaatcaaatccatcattcaataagttgacaatcacagaattcgaaccaagatagccctgaccctcaagtatgtagttagagaagggaaacaaggaacaccattctttatgtcaattcatcaggattgtgttgaaaaaacatttgtataaattgtatgactcgcaagataactttgaggagggataatgtaagaatctaattggtcaaataataagagttatgagttatgacc

SEQ ID NO: 61428 - DNA, 594 bp, Triticum aestivum
  unsure (1)..(594): unsure at all n locations
  Clone ID: PAT_TA_61428
cacgctcctaccggccgccgggnaagatctgcaaccggtacgcggcaacatgccatctcttctcttccggcttgtgcgagccttgttgaatttggtcaagcaaacattgtacccggccgcgaagcctggacgtggtgtccccgtccttggcggtagcgacgccggcttcaagaggccggcggtgctcacctgcccccggtacatcatctccgtgatctgtgaattcgccatgttgatctgcatcaccgggacgctgtgctactacttcacctacgacttgccacctgagttctccgtccacttgacgccgatcccgagcaacagcagcgtgggggctccggccgcgacgacgtccatcccccgggccttcgacgtcgtcctgcacgccagcaaccgccgcgctatcggggaggtgccaccaccacggggaggggagatggtgacgtacggcggctataccgtgagcgtcgggccacgcgcccgacttctgtgtgccgtggaagggggcgctcgaggtgccgttcgagctggcgtgggactgggacgacggcgtttacctgcccgagcacctgcgcggactcatcgcggcggcgg

SEQ ID NO: 61429 - DNA, 559 bp, Triticum aestivum
  Clone ID: PAT_TA_61429
cccacgcgtccgcccacgcgtccgcccacgcgtccgcccacgcgtccgacaacatccacgatgtccgccgtccgattcacccgcgctgccacgcgcgctaccgcccagcttcgcgctcccgcccagcgccgatttgccagcacacagaacgagttcatcaaggagcgccagcacatcaaggagcacgctgctggtaccactgaactctggaagaagatctccctctacggtgtcgccccctgccttatcgccgccggtgccaacgcctactggctctggagcgagcactgggagcactggtctcacatgcctcctctggaggagcgcaccgagtacccttaccagaacatccgtaccaagaactaccagtggggtaacggagacaagactctcttctggaacgacgaggtcaactaccacaacaaggataagacctcctaagtatgatctgttgatagttcatacgtcagacaattgctggaccacctttttatggactgctccctctggagatgcctcgtacatgttccctagactcgaattgaccgattgttgaagt

SEQ ID NO: 61430 - DNA, 306 bp, Triticum aestivum
  Clone ID: PAT_TA_61430
gtcggcgctggtgtacatgctgcagcacaagggcagcccgtggcggggcaaggtgttcctggagaacgactactacttccagggctactgggtggagatcgtggggcggctcggcgacatcgcggcgagtcggttgagttttgtctttgtgctgctgtgcgtggctgctcgctgtcgctggtgggtttagcaacgaaagtcatgtacttcagccgtggggttgagtacatttgatgtctgccgttatccattttcttgtaccaataaaaagttgcacagtaactgtcaaaaaaagttggacagtcc

SEQ ID NO: 61431 - DNA, 387 bp, Triticum aestivum
  Clone ID: PAT_TA_61431
cagcacccctgagagcgcagaaacaacatccagaacatcctcaagaccaacctgtcgatggccactcgccgaggtggtcatctgcaacacttccatggagttggagcccgacgctctggccctcctcccgaacgctctgcctctcggcccgctggtggcgcccacgccgaggccggtcagacacttcttgcccgaggacctcgcctggctcgacgaacagcccccggcttcgtcatctatgtggccttcggcagctccggcttgagaggcgagattctggaccatggttcggccgaactcatggtccacgccgtaggatcgcccagccttgttgcatgtggatgcgtgtaccatttgaattcaaaaagaaccgattaaggcccaatc

SEQ ID NO: 61432 - DNA, 608 bp, Triticum aestivum
  Clone ID: PAT_TA_61432
cgatacacaatcgcagtcgcagcctcatcatctgccacaagtgacccacacgcatctcgtttgccagcctctttgattgatccaccgatccctcgccgccgatgaccatggaggaggcgctcatctcgccggagctgcgcgacgtgctggccaaggtggccgtgttcctgctcgtgcaggggctggtgtacctcatcctcaccaactcctccgacgtcttctccaagagcaagaggctccggtccctcagcttccggcccatgcggtccatgagcgtgcgccgcgtgctggcgccgctctccgacatccccgtcggcaccgacgagaactcgccctcgcctttgctgtcttcgtcttcgtcgtggtcgtcgcgccgctggggtagccgcaaagaggattgagcagcttggaggttggagcggttactgagttctgacgccagatgggcagctatagcttggtgattctgaactgccgtgggtttgagatttgagaatggtagtatttgttaaactttcatgtgagctagatttagatggggtcttgtacatatgttcattaatttgaattgggaggatgaacaagtatttgaaaaatgttgaagaagc

SEQ ID NO: 61433 - DNA, 604 bp, Triticum aestivum
  Clone ID: PAT_TA_61433
cccagcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggtttttaaaaaaaaaattttttgtaccgggtgttggaaacgttaaattttttttttggggcccctaaattaaattttgggggcgggtttttaaaaggggggggggggaaaaaccgggggggtccccaatttaattgttttggaaaaaatcccctttttcccagggggggtttaagaaaaaaagcccccaccggtccccttttccaaaattgggccaacctgaatgggaaaggggacccccccttttgggggctttttaggggggggggggggggggtttcccccagggggaccctttttttttgaagggcccttaaccccccttttttggtttttttccttttttttttcgccaagttggggggtttttcccgggaatttttaaatgggggggcccttttaggggtccaattt

SEQ ID NO: 61434 - DNA, 607 bp, Triticum aestivum
  unsure (1)..(607): unsure at all n locations
  Clone ID: PAT_TA_61434
gggtttcctctgctgacctccgtcgtgcttccggccgctacttgcatctctccgccctccattcattccactcctctagcctatgagatatggcgagcacagcatgctttgtgattgtcagtaagaatgatatcccaatctatgatgctgaagttggatccgctccaaaaaaagaagatcaggcttatcagcatcagttcattttgcatgctgcattagatgttgttcaggaccttgcatgggctacaagtacaatgtttctgaagtcagtagatagattcaacgatcttgtggtgtctgtttatgtaactgctggtcatactagatttatgttgcttcatgattcacggagtgaagatggtataaaaagcttctttcaggaagttcacgaactttacatcaagatattccttaatccactctacttgcctggttctcgcatcacatcctctcatttcagtaccaaggtcaggtctcttgcaaggaaatacctgtagcatacactcaggtggaagaccatgtaagcgaccattgaatgaccagtagatcctgaaaatgagctagcactatgatgtgccaaaatggtgctcaacggnagagttttctt

SEQ ID NO: 61435 - DNA, 524 bp, Triticum aestivum
  Clone ID: PAT_TA_61435
ctactccctggggttgtctcctgcagatccgaactcaacggcgcaatgatcatcctaggaaggtcatggttgaggtgtttgaagtcaatgtcgaggagcacaaacttgtcagactgagttctgccacagccttccaggagcacgcagtgtttgttgggttgaatgaatccgtatgtttgcataccaaagattacaaggagctaagacccaaccatgtctattttgccacaccttggttgacacaggaagcaaattttggtctcaggggctggaaaggtgtagtgatttatgacctggaaaatcagacgtttgaagaagttcttcctgcatctaaatattctgcattttgtccccagcaagtttggttcattccaaatatctgaaagacggtacatctcgtcaggttgtggctgtcccgctaaaacgattaggtataggtactctattttatcttatatatgttggctcaacaaacattacagtgttgctagtgaccggattcagttcaatatatttttgtggcc

SEQ ID NO: 61436 - DNA, 596 bp, Triticum aestivum
  Clone ID: PAT_TA_61436
cggacgcgtgggatcagaagaaggaagcaaactcttcaggacattctgacagcgttcaaacctgactgatacctcgggatctccttctcccccaccacagcaaaagcaaatatcacaagagaaatcagaactcagagatcagttcagttgacagctgaaagggaaaggaaaagtaacatcgagatcgcttccattctccttctatttcgccatggtcgaatcagcatcttccccaatgctcagcatcgacgtggagttctctggcgggctggagatgctcttttcgaataaacgacagcacgctctgtcgattcccgcggtaggccaagatgggaaacccgccgacatcgcgtacttgataaactacctatgtcagaacgtcatggacgattctcgcaaggacctcttcgttctagacagccatcttcgaccgggcatcctagttctcatcaacgatgccgactgggagctcgaaggcgaggaggcctacgagatacagagcggtgacaacatcttgtttgtctcgactctgctggaggttagaatgctgtaaactactgtaatcaactctctttgtggcctccgcggaacagctg

SEQ ID NO: 61437 - DNA, 484 bp, Triticum aestivum
  Clone ID: PAT_TA_61437
cgttaccaaaagtcgcctccgccgactttgctggaagaccatcagccatcgcctagaccgacttcgctgaaggacatgtgctatttatgaaaaatgagcttctctactactggctggcagcccgtgatggtggttttagatatgaagctaaggatagcgtgcctcataattcattggatggccaattagatattggtggctgtaaatgacatgagtatttagctttaataaaatctactccctccgtcccataatataagaacatttttgcttgaaaaacgttcttgtattatgggatgaagggagtagatatgtactcttgtggatgaggctggtactaaatgtgcattgaatttaccagcattggttaatattggttttactgtcgacattgcatagtgagtttatataattgatacaagtgaagacatattttacaagaatgattatagatccaccaatgctggtgctagatctatcgctg

SEQ ID NO: 61438 - DNA, 600 bp, Triticum aestivum
  Clone ID: PAT_TA_61438
cgcacacaccaccgtgccggttacatgggaggaggccgcggcctggtcaccgggttctacgtctggggctgggagttcctcaccgcgctgctcctcttctccgccgccgtctcctgctagatacctctgcttcttgctcatatacatacatactccaaacttattagtattaggtagagagacagcgatcttttaagtgattaagccggcgccgttcctgaccaagacgcaccatatggtggaggagcgcgggacggacgaagtgatctcgtggagcgagcacgggcggtcgttcgtggtgtggaagccggtggagctggcccgcgacctcctcccgctccacttcaagcactgcaacgtctcctccttcgtccgccagctcaacacctacggtttccggaaagtggtgccggaccggtgggagttcgcaaacgagaacttccggcgaggcgagcaaagcctcctctccggcatccgtcgccgcaaggctacggggacgacgactccccagtcctccaaaacctgcggaaccggcgtaaacgtcgcgtttcctccgccgctgcccgctctgtctcccgcatctgtcagcacgttcgggac

SEQ ID NO: 61439 - DNA, 335 bp, Triticum aestivum
  Clone ID: PAT_TA_61439
tcgacgccttcatggctgtgaggcctcttcccaacatgtttggctgagcattgggtgggaagttcataccctttctgtgtggattttattgaattccaggagcaacatatgaagtttcaggatttagttgtaactattaatgtcaacctggccgctcaatcctgtatggcagccactgattttgcaaaatcagcatgtgatatgtttgttttcaagcttgctcgatcactgcaaagatttctatttattggaattagggaacacacacgtgttttttttgaaaccgaggcaaaagatttgcctcgtatattaattaagaggggagagagtacaac

SEQ ID NO: 61440 - DNA, 600 bp, Triticum aestivum
  Clone ID: PAT_TA_61440
cgtcccgtcgagccaatctgtcacggccatttacaacacataccgcgccacccaggtcgcttttcccggcgagaaggacgacgtccttcggcgggccgagcagtttggccgcgcattcctccaagagaggcgagcctccaacaaactcaacgacaagtgggtcatccccaaggatttgccaggcgaggtagaatacgcactggacttcccctggaaagcaagcttgccacgagtcgaaacaaggttctatctggagcaatatgggggcggcgatgacgtgtggattgggaaggtcctctatagaatgcctctcgtcaacaatgacctgtacctagaggcggcgaaagctgatttcaccaacttccagagaatgtgccgacttgagtggcatggcctgaaaaggtggtatgagaggaataatctggaaatgtatggtggtgtccgcaaatagcgcactcagagcttacttcttagcggcagcaaacatctttgagccgacccgagcagcagagcgcctggcatgggctcgcacggcgatgctcgctgaggctgtctcctcctacttccaacgcaacggttgcgctcccgagttgagggaac

SEQ ID NO: 61441 - DNA, 503 bp, Triticum aestivum
  Clone ID: PAT_TA_61441
aaggccggtggtgagaagtggaagtccctgagtgatgctgagaaggctccctacgctgccaaggccgagaagctcaaggccgagtacaccaagaagatcgacgcctacaacaatccacaggcaggagaggcgtccggcgacgagtgaagcggcgcgccaagcagcagcagcagggggagggggtctctggaacgtggccgttgccgctcattgctggtgtcaccgatcgatgatggatgttcgctgttagtttagccccttggtagtccctccctctctttcaggctgccgctgccgatggcgatgatagaaatggtagctctagtcccatctagtcgttatcctggatcggagtggtgaagttgctagtcccatgtaggctgtatggtcctgtgctcggaccgctgtcttctgttgcttcgtttttagcctgttgtgattcagtctctgtcgaatgtacctagtgtcgtgcccggggctgtttgtagaatcctacccagatc

SEQ ID NO: 61442 - DNA, 598 bp, Triticum aestivum
  Clone ID: PAT_TA_61442
tagcagtccagacgcgcgcaccacccaaaaaccctaatcccctcgcagccgccacagcccccggagcccgcccgcccgaacccgccgccatggccgacgacgcggcatcggccccgccgacggcgcagctggccgccgcctccatctcctccccgccctcctcggacctcgagccgccgacctcccgcacccgcatccgcgccatcctggacgccggcggacgccatggccggggagcgcgtggtcgtcggaggctgggtcaagaccggccgccagcagggcaagggcgagttcgccttcctcgaggtcaacgatgggtcctgccaggggaacctccaggtcatggtcgaaaaggacgtgcacccgctcgcgcagctcacccacacgggcacctccgtgctcgtcgagggcgtgctcaagaagccccccgcggaagccaagcagcgcatcgagttgaaggtggagcgggtcatcgagctcggggaggtggacgccgccgcctacccgctgcccaagaccaagatcacgctcgagacgctcagggacttcgtccacctgcgtgcacgcaccaacacgaagggcgcagttgctcggataa

SEQ ID NO: 61443 - DNA, 347 bp, Triticum aestivum
  Clone ID: PAT_TA_61443
acgcacgggacgtaggaagaagggacaggggatgctcgcagggaggcggtagctccttaggcatccatggtgccgtcggtgtgctctattcttggagaaagaaaggagaagggataggtcaggtgcgcggctgctggttgctgcggctccggtgaccacgggcgtaggagaagggacaggggatgctcgcagggaggcggtggcgtagatcgaactcaagatggttggacgtgttagatctcgtgctgctatcatgaaatattttgtctaaatagagtaatgatgtattctgttttgtcttggattagcaagtagtgatgtattctgtgtaaatatagtaattttgt

SEQ ID NO: 61444 - DNA, 565 bp, Triticum aestivum
  Clone ID: PAT_TA_61444
gcccccagcgagctcttgcctactatgagcacagagatctcggccatgggcgccatattagccagcggtaacgcctcgtcctccgacggaccgggtcatcaccggagagcgtggaccgtgtgtcgaacgaggacgcgctggttagatttggagaggatgagttggaggacactagcccgctcgccatcgagccgggcagctaccgcattccgtggccgtgccggagcctgtcgccgtgcccagggcgacggggcgaggtggagggcctgttgccgggcagggcgacgaggtgccggcggcgcaggagaagaaggacaagggggacaccaagatcgcggcgtgggatatcgcggtggtcgtcgagtgctactccgctttatcgcgaggaggtccatgtctacggcagcgatggcgaccaggcggagattgccagatcttgtgtcagccaggacgaagtgactctcagctggttgcatctgtctgctctgcgaatatttcacacctggccatgctctttctgtatgaatgctgatggcgtgatgtgatgcggacgagcaaacgaagc

SEQ ID NO: 61445 - DNA, 542 bp, Triticum aestivum
  Clone ID: PAT_TA_61445
cccacgcgtccgggcactcgctaagaacatacaggatggacgacagtcatgcgttccatagctatagctttcatggtgctttctatgatgtgttctaccttcccatcctgccatgcaggcactgaatctgttcataatgtggtttgtgagactctcaatccctgtgatagcccgaggtgcgaagacatgtgtaatcatataatgcatcaccgattcaggcactattgcaagacccataatgttcaaattccaaattgttgttgtatagaacaataatataattgcctgttctcctgcttgagccatgcaatattgaataagtttatttaataaattgatatcactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaaaaaccaaattttacgacccggggctgggaaggtaaaattttttttttagggcccccaaatttaatt

SEQ ID NO: 61446 - DNA, 769 bp, Triticum aestivum
  Clone ID: PAT_TA_61446
cccacgtgtccggtaccatctaggccccaattgcacttcagttgatttgtagtaactagaacgatcatgttgagcctacagagcccaaggattttcctcaggaacccagagctggaccttctcaagcgcgaactccgcgtgtgttgccctcgcagaatgctcagttgaggagcatggctgagcagattgtagtcaggcaggagcagatcgaagttgagcaacagcagatcctagcgcatctggggcagatccaagttgaacagcagcagatcctagcgcatcaggaggagatccaagttgagcagcagcagatcatagctgggcagcagcagcagaggcacctcttgactcggatcttagcctggctccaggaacattcagctcggaagactccaccagctgctccttgtgctgctggctcagctcacacagcgggtcttgagtgacatggtgcatttgcagagactttgatcatccattgtcactacatgtaagctatatgcatgtcagtttatcttgttaggcacttaagagcatctccaatagatggtccaaaatttggcggtccaaaaccggagatgtaaaatttggaccgccaaaaaatgcgttttggagctccgaaaaaagctcaactccaacagatggtccaaattgatggtccaaaagagcaactccaatagacggtccaaaatgaagatgtaaattcctgaaattcctgaaatttgttaagtccgagaattcgccagttttaaacatcacttagctgttt

SEQ ID NO: 61447 - DNA, 771 bp, Triticum aestivum
  unsure (1)..(771): unsure at all n locations
  Clone ID: PAT_TA_61447
cccacgcgtccgcttgaccaactgcgcgcacctcatcggccgcgcgcacgcccagtaaaccctaccctactcgccggcgacagaggttttcgcgagctcatgcgacaatggcgtcccgcctcgagtttgagaactcgtgcaaggtcggggtgttcgcgaggctcaccaacgcctactgcctcgtcctggccggtggggcggggaatttcaccagtgtgtttgaggccgagctcgcctacaccgtcccagtggtcaaggcatccatcggcggcatgaggatcctcgggacattgtgcgtgggcaacaagaacggccttcttctaccacacaccaccaacgaccaagagctccagcacctcaagaatagcctgcctgatgaggtggtcgtccagtgtcgacgagcggctctccgccctcggcaagtgcattgcttgcaacgaccacgtggctctcacaaacccagatctcaccagggaaaccgaggagatcatctcggacgttcttggggtggaagtgttcaggcagaccatcgcagggagcatcctggttggcagctcctgcgccttctccaacaaagtgggacttgttcaccacacacgtnggtggaggacctggacgagctgtcgacgctgctgcaggtgcccctcgtcgtcggcaccgttaaccgggggagcgagggcattgcggccgacatagtggtcaacgattgggcggccttttgcggttncgacaccatggggaccgagcttttagtggtggagagcgtcttca

SEQ ID NO: 61448 - DNA, 715 bp, Triticum aestivum
  Clone ID: PAT_TA_61448
cggctggaggacctcggccagccgttggtgccgccgtacccgtgcgtcgaggagttcctgggagacgccggtgacaccagggatgtgcttgccaagcctctgcttttcctgcaggtgacacaactcaagtgtggaggatttgttattgggcttcacatgtgccattgcattgctgatggttttggtatcctccaatttatcaaatccatagccgattttgcatgtggtgaactcatcccaaccactttgcccgtatggaaacgagataccttcacagcacgtatgccaccccctatcacgcatgtctacccagcatataaaacatttattcaggggttggactgcacgggagatgacgtgatgctatcaactcccccgcaaagcatggaagtgcaatatttattttttggaccgaaagaagtagcaattttaaggagccacctcccagaacacctttccaaatccaccacaacttttgagttgcttacgactgttatgtggcggtgtcgcacattggcacttggttatggatctagtcagaaagtgcgtatcatgtttactttaaatacacgtgggagaagcattaatggtgaaagcattgtcccacgtggttactatggaaatgcacatttttctcccatggtcgagatcaccgtcaatgagcttgttacaaagccctttgaacaagtacttgagctgatacacaaagtcaagt

SEQ ID NO: 61449 - DNA, 762 bp, Triticum aestivum
  unsure (1)..(762): unsure at all n locations
  Clone ID: PAT_TA_61449
ctatcataaagcttgttacttcccttctaaaatattgtgagtgtctgaagtgttaaagcacattactgctgtattttcttgttgatctctgaatttatttggctgtatagtagatctataatgtggtagagaagcttagtttttctgtctgtagagttctataattctggagtcctacaagcaacaaacaaagtatctattggaatcatatcttccagaagagacgtttaaaaacaagttagatacttagacgcaaaaatgtaaaaaatatgggatgcttgctcttgctattttttttcttgttcatatcgacatcaggtttgaattttagctgaagaacattttgtaatcatatatccaacgaagcttagactagataattgtatgctgtgcccttttgtttcgagacataatagtatgctgtaccgtgaatcttcatgctcacccaaaccattatttttatgcagttggaatgcagcgtatgaaagtttgcttggatcaaataaaccattccctcagcccatccctctacatgtaagatctaaatcagttcagttgatctgaaaaagatgatctaaatcagtttattttaacgttccttgtaaggcatgtggttaaacttagacgatgaatttgcaggagatggttgatttcctcgtggacatctgggagcaagaggggctgtatgactagcacagatgtgttcgtcgagaaaacatagctgtagttctgatgtgnaacgagggtgtggcctgtcatact

SEQ ID NO: 61450 - DNA, 478 bp, Triticum aestivum
  Clone ID: PAT_TA_61450
cctaacaaagatttgcttctgtagaatactttacaatacttccgcgatggctggagaggttggcaagtggggtagttccttcaaacgttcttgggctttaatcccactggtcgcccatggaatcatcgtggtcgtagtgggtctggcttactctttcatctcgtcgcacataaatgatgatgccgtgagcgccatggacgcgtcgctggcgcacgtcgccgccggcgtgcagcctctaatggaagccaaccgctccgccgccgtcgtcgcgcactctctgcagatccccagcaatgaatcatcttatttccgatacgtaattaaccaagaacctttgggttaattaaattatgcattttttctatgtaaaacgtgattagtttcatcacgtatatgcacttcctttttgaaccacaattatttccttactttaaataacaaatcttaattactagccgggccgacccggtaactggtt

SEQ ID NO: 61451 - DNA, 556 bp, Triticum aestivum
  Clone ID: PAT_TA_61451
tcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgatgtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcct

SEQ ID NO: 61452 - DNA, 768 bp, Triticum aestivum
  Clone ID: PAT_TA_61452
gaattaatggattaggttttagtacgcgtgggcccgccctcctcctcatgcggcgtacaccgcccacgtacgggcgtagagcgggccgtacagacacgcgcctcgctacgccgcggaggggttgtaccgaagaagaagtggaggatgatgtggttgtgtgcgtgcagagggcggccatgccgtgggcggcgcgcctcctgtccgtggcctgcgtctccgtggcggccaagatggaggagtactgcgcgccggcgctgtcggagctcgacgccggcggcggctacgagttctgcttcgcctccgtccgccggatggagctgctcgtgctgtccacgctcggctggcgcatggccgccgttacgccgttcgactacctcccttgcttctcctcccggctcgaccggcacgacggtcgcggcggcggcggccttgaccccgccggcgtcgccctcaagtccatcggctccatctgtgccacagccgaagccggcagtgtgctggattacatgccatctactgcggctgcagctgcaatcttggttgcatcatatgaagctctactgaccaaagaagcactggagtccaagatggacaatctatctccatcatgccccattgagaaggtttcttgcacaaactaaataaataaccattttgcatcacttttttttttgattttcaccgggggggagatttctccacctgaattgtattcatattgcctataaagctttgcagcctattgcaagataggttcaagtgaaccgg

SEQ ID NO: 61453 - DNA, 758 bp, Triticum aestivum
  Clone ID: PAT_TA_61453
attctctatcctgactctgctcctgcgatccccaaccccaacccaaggccaacagcaacagggaaatcatgagcgccatggtcgcgtcgtcgctcaaccctgaggccccgctcttcatcccggcagcgttccagcaggtggaggacttctcgccgcagtggtgggacctcgtcaagtccaccgcctggtttcgcgaccactggtaccaccagcaccagcagctcgacgatatggccgattccctcatcgccttcgaggccgaggacgccatcgacgacgacctcttgcacggcttcgccgtcgaggcttcgcagccgcagccgccagcggcactcaagactgacggggtgctcaaggcgctgagcctggcatccccaagcccaaaggtcggcaacgccctgcgtgtcttctcggagaagcctaggtacaccgagaagcccaccaagtacgctggcagcccgaggagcggtggcgcaccgcgtttcatccaccagcctcgctaggttgggatgtcaagcttcaagaatccaccaaatcctgcgccttgtgtcatgcagtgatgcattgctctggctgctgccgccgtctcatctttcaagtcttcttctagtactcgcgcctagtggtgtccgtttgtatattatattaagtagaaatgaaatgacccaagaaaaaggcaacaaaatgcaaccgatgtttagtgtgatttgccttggtagttatggtctgcacagtgtgttggacaagaatgtatagta

SEQ ID NO: 61454 - DNA, 224 bp, Triticum aestivum
  Clone ID: PAT_TA_61454
ccccgggctggcaacgtaaaagtttttttatggggcccccaaaattaaattcacgggccgtgttttaacaacgtcgggacgggaaaaaccttggggttccccaattaaatcgcttggaagaaaatccccttttccccagtgggggaaaaagcaaaaaggcccgccccgatcgcctttccaaaaagttgcccaccctgaagggaaaagggaaccccccttgtacg

SEQ ID NO: 61455 - DNA, 752 bp, Triticum aestivum
  unsure (1)..(752): unsure at all n locations
  Clone ID: PAT_TA_61455
cccacgcgtccggtgcaaagctgacaccacaccagcagcagcagcaatggcggccggagcaggaggagacgatctgaagctgctgggcatgtgggcgagcccggcggtcctgcgggttcgcctcgctctcagcatcaagggcgtcagcagctacgagtaccaagaggaggacttcgacaacaagagcgagctgctcctccgctccaaccccgtccacaagatggtgccggtgctgatccacgccggcaagcccgtctgcgagtcgacggtcatcatacagtacctcgacgaggcgttcgccggcgacggccgccccgccctcctcccggccgacccctacgagcgcgccgtcgcccgcttctgggccgcattcatcgacgacacgctgctgaaggccatgtaccaggcgtcgtggagcaagacggaggaggagaaagtggaggggaagaagaaggtggccgccgccttgaagaccctggacggagccctgcgggacgtcgccggagggaagccgttctttggaggcgacgcccccgggtacgtggacacggtgctcggcggcctcctcgcgtgggcgcgctccatgngacgtgatcaatggcgtcaagaccatcgaccccgtgacgatgccgctgctcgccgcgtggggcggaccgcttcggcgcgctggacgcgggtggaggcgggcacgccggnatgtgaacaggctgggtggagttcttcttgtccttgacaacgtaggctcatgctgg

SEQ ID NO: 61456 - DNA, 456 bp, Triticum aestivum
  Clone ID: PAT_TA_61456
ccccgcgtccggaagcacaccttcgcttccctcgctagagcctggaccctccgttgtggctagcctccgacagaggcggcggacagggtggcggctgtggaggtgtgatgtccccgccggagtttggaggggcgaggcgttgcccatgtagcagaaggcggaggggaacaagtagcacggagggaggccggccctcctgggggatcagagggttgcgagggggagaacccggcaagctgggaccaggcgtggcggcgtcacagcaaggagaaggggcgacggggaagttcgatgagcggcgttcaggaaggccacacgagaggatggctaggggcggcggccgagaggccaatggcacaagccgcaagtgcctggacgcttcgcctgaaggagtaggggcggcgcatgcggccggtcgctggatcccccgtcaaggaggttggctccttggaagct

SEQ ID NO: 61457 - DNA, 568 bp, Triticum aestivum
  unsure (1)..(568): unsure at all n locations
  Clone ID: PAT_TA_61457
tccacgcgtccgcgagtgcacgcacagaacgaaaatggcgcgcgtagcactggtgctcacaatttgcttcatgggtttctacccatccctcgcgtggtcctccaattccaaccacaccgacttcctctcgtgcctctcgacgaaaatccccagccagctcgtgctcacgccgagctcgcgctcgttcaagccgctcctggtgtcgtccatcaggaacgccaggttggtggcgccggcgacggcgagccccccgctctgcatcgtgacgcccacccaggcgtcgcacgtccaggccgtggtgcgctgcgggcgcagccaccgtgtgcccgtccgcgtgcgaagcggcgggcatgacaacgagggcctctcgtaccgatcggcgacccccaacggcgaggcgttcgcggtgatcgacctttccaagttcaacgccgtacgggtggacgcgcacgcggccaccgcgtggggtcgctctgggacgacgctcggggagctctactaccgcgttgccncggcggcgcccgggctgggcttcccggctggcgtgtgcccgtccgtcggcgtgggg

SEQ ID NO: 61458 - DNA, 549 bp, Triticum aestivum
  Clone ID: PAT_TA_61458
cccacgcgtccgagcgcgtcaaggtgtcgccaccgccgccgttcgcgtcggacaggtgggccgcgggcggcgcctcgtcctccgacgaggaggaggacaccaagaagaccaagaacaagaaggccgcggccggcaaggcggtgccggcgaggaagagcggcaaggccaagggcaaggacaagtacctcgttgcgccaccggcagaagctgaccacgagttcatgcccttaggcggcgcccccgacccgttcgccgacaacgacgcgctcccgccctcctcgttcgacccgttcgccgacgcgcgcgccgacgacgctgtcgggggcggcgccggggtcgacgaagcctacgtgcacctccgcgtgcagcagcgcaatggcaagaagacgctgaccacggtgcaggggctcagcgccagctacaactacgccaaggtgctgcgggacctcaagcgggagctctgctgcaacggcaccgtcgtcgaggacaaagagctcggcaacgtcatccagctgcagggcgaccaccgcaagcgcgtcgccggctttc

SEQ ID NO: 61459 - DNA, 254 bp, Triticum aestivum
  Clone ID: PAT_TA_61459
cccagcgtccgcaggaagtgatcgagtggttgtcgttcgtctaatcgaaggctgcctagcgaccggcccaaattgggccgatcgactggcgcctatcacccgccaatgccaaaactggccagcgttcatgaggcccagtagcacatgagttttttttttctatttcctacaaaacattcaatgcaccttcacaaacaaatatatgtacagtgggctctttcataaatcatatatactgatagcaaattgtattt

SEQ ID NO: 61460 - DNA, 620 bp, Triticum aestivum
  Clone ID: PAT_TA_61460
caagaatcgaaggacgccgcgacaacatcgctagaacagacaagaaaagatgcgactgacggccttacaacatccaggttcgtggctcacgctgtattccgaagccttctcggtacatggaaattggagcgtgatcttattagcaaattgccttcacacccaagtggtcacttcagcggcacggcacaatttctcctccgcgagaagacaactgatggtttgcgatgcgccggcaaccccagcgaagactccacaaacggagacgagctagtcatggagtacctctacatcgaagaaggcgagttcaagaccagtcaaggtttcggcttcaaagccacacgtcgctacgtatggcgttacaacgagctcaaagacgtgctaagcgtctggtttaccaagcccgatgacctcaagcgagcagactatctcttccacgatgtcgagtttacaaaaccaacggagaaagggtgggcggcgaaagcgggtcatttgtgcattgatgattattacgatgtcaagtacaactttgcgttccaggctgtgaatctgaaagagtggcagattgagtatacggtcaaggggccggagaaagactatacaattactggggaattatactc

SEQ ID NO: 61461 - DNA, 481 bp, Triticum aestivum
  unsure (1)..(481): unsure at all n locations
  Clone ID: PAT_TA_61461
gtgaccgcggcctcgggcggcgtcggcaccttcgccgtgcagctggcgagcctcgcggggcaccaccacgtcacggccacctgcggcgcgcgcaacctggacctcatccggagcctgggggccgacgaggcgctggactatgacaccccggagggcgccgcgctgcgcgggccgtccggcccgaagcacgacgcggtggtgcactgcggggaggggttcccgtggtcggccttcaagccggcgctggccgacgccggcggcgtggtggtggatctcaccccgcgcctcgcgtccgtcgccgtcgcggagctccattgggtgctcttctccaggaagaagctggtgccgctgatcgcgtctgccaaggaggaggacatggaggcgctgctgggcatggtgagtcangggaagctccgggtggtgatcgactcgcggtacccgctgnagcaggcgcacgaaggctgggctaagagcatgagcg

SEQ ID NO: 61462 - DNA, 196 bp, Triticum aestivum
  Clone ID: PAT_TA_61462
aattaataagaatacagatcagatagactaggatagagagatagtttttaggcctgtgtgcatacaagtgtcgatgaaaagttgtaaaagatgtacactgtttttttgtattgtatatgtagtgaaatttcacagatggccggatgtaacattgtttttgtctaataattctcgtgtttatggtctgttctgggat

SEQ ID NO: 61463 - DNA, 604 bp, Triticum aestivum
  Clone ID: PAT_TA_61463
ctttcggaaagccggggttggtttcgctttgagctttttatccggagcagccagccgccgggccgggacttctgttagcccaacccagatagctccgtccgtgtccgattcgccggggccgggcgtggatacctaggctaggcgccgccgatgtcggactgcagcacgggcacggactcgccgcgggccgactccgtcgacgagcagccgcccgccgacgccgagtcgcccggcggaggccagagcaagcgcgaccacccctcgccgtcgtcgccgctgccgccgcccaagcgcagccggagatctgtggagaagaaggtggtagtcggtgccgattccgagatggcggcgagcgggccaagaccaacggcgagggcccgccgccgccggactcgtgggcgtggcgcaagtacggccagaagcccatcaagggatccccctacccacgggggtactaccgctgcagcagctccaaggggtgcccggcgaggaagcaggtggagcgcagccgcgccgaccccaccgtgctgctcgtcacctactcctacgatcacaaccacccgtggccggcgcccaagagcggctggcaacccaacaagtcctc

SEQ ID NO: 61464 - DNA, 518 bp, Triticum aestivum
  unsure (1)..(518): unsure at all n locations
  Clone ID: PAT_TA_61464
cgagcgggcggtgcgggcggagccggcggacgcggaggcgctgagccggtacgcgacgttcctgtggagggcgcgggacgacgccgaggcggcggaggagacgttccagcaggccatcgcggccgaccccggcaacgcgcactacgccgccgcctacgcgcatttcctctggaacaccggcggcgaggacacgtgcttccccctcgactgacgcccgtgttcttgcgccgcccgcggtggatgccggcgcgaggcgagacgccgaaagcacggcaccatggccggactagtgggcggtggattggagctgggctaacacatgatgatccgtttacttattagattgagtaggagcgttcanggggcggtgaggcggtgatccgggagtccgtggcgccgtgtttcccgtcccgggaatacggcgaccggagcttttggccgggcagacgtgaggggcgaagtcccgatgagcttgccgggcatctccctggcatgcaatgggtgggtgtaagctggcg

SEQ ID NO: 61465 - DNA, 500 bp, Triticum aestivum
  Clone ID: PAT_TA_61465
taaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccggttttaaagaatccaagtttacgaacccgggcttgcaaagtaaaagtttttttttaggggccccaaaattaaattaatgggccggggtttaaaaacggggggacgggaaaaacccgggggttccccaattaaatcgccttgaaaaaaatccccttttcgccaggtggggtaaaaccaaaaaggccccccccgatcccccttcccaaaatttgcccaccctgaatgggaaagggaaccccccctttaccgggccattaaccccggggggggggggggttacccccagggggaccgttacatttgccagggccctaacgcccgcccctttggtttttttcccttccttttttgccacgttggcgggttttccc

SEQ ID NO: 61466 - DNA, 449 bp, Triticum aestivum
  unsure (1)..(449): unsure at all n locations
  Clone ID: PAT_TA_61466
tcgtccacgcgtccgcgactcgaccgctcccaccgtcgacgagcccagcgccgccgcccgccatggccgtggaggtccgccgcgcgacggcgccgcgcgggggcgcgcgccccgcggaggggaggggggcgcggntgcangccggggtctttttgttgctgccgattcgccacaccgaggtgggggggtgcgttttttttttcgcctcgcttgcctatcttatgcgccgctggcgggagaagattcgcttcttcacgccggttcccgttgtggggctttccgggatcttctccctctgcgggcctcgcggctcgctcctcttccctctccgcttttttcgggtcgccttttttccggccggcgtcttcccccgcggcggcgtgggcgcggactttcctctttttcttcgtcctgccgtggcccgcggccgggccccggccccccccccc

SEQ ID NO: 61467 - DNA, 468 bp, Triticum aestivum
  unsure (1)..(468): unsure at all n locations
  Clone ID: PAT_TA_61467
ataattncatcacctncgtcccgcccatnntccaattgccgagaagagaatccatccattgccgcatcgcaatatgcatcaacatcagggcatctctcatcgcgacggggaagcaggaactcctgggccgatgatgcctccgtccaaggacgaggaggaggaggagcctcctcgtaagcctccggtgtccacaacgtgcttcatattaggatttttcgccgcgctatgctgctgctgcttggttgacgagccgctcatgtgacacgggttgtcttgcgtgctgtctccgtgctttttgtacataatgcaggaaacaagctatctatctctggcccgtgaatgctttgctttcctactgaaattcggagaattctccttgcacacaagtgattgttggaactatgtagatcaggactattaaacaaattcaataatttctaggtggactttagcccgtattttttgcta

SEQ ID NO: 61468 - DNA, 579 bp, Triticum aestivum
  unsure (1)..(579): unsure at all n locations
  Clone ID: PAT_TA_61468
ctctcgcttcggttctgagtcccaccgggaggcgctcgcgcgaccggccggccagcttgaaatcaagaaattcccagccgcactagagggaaagcgcagctctagggccgccgcagcgccgtaccttagcgtcaccgcgggcgcctcaatcacgcctccacccccacccccacccccacctcaccccctcctcccgcctctcacgcgcgtcgccgttcccgttctatctcgctgggacatcgtgttcctgctgtcttcaccccgtcccagtctttggccattgaggttgggcttcccaaataatttgtctcttgctgcatttagctcatccgtccttggaaatggcagcaccgaagcccattactcgccttatttcccatgtcattcttgatttggatggtaccctcttaaacacagattgcattgtaagccaggtgctgaaaccatttcttgttaaaaatgggaaaaagtgggatagcaagaaagctcacaaatttgttggaaagacaccttatgaagctgcagctgttggtntagaagattacggactcccttactccaccgaaagagttccttctc

SEQ ID NO: 61469 - DNA, 619 bp, Triticum aestivum
  Clone ID: PAT_TA_61469
ccgccctcttctcggcagctctactgtaaatttgtactcgccagattcccaactgttggacacctcgaccgccgcaggcgctcggttggctcctgtccgtgcccggcgcttctggcagcgtcctcgaggtcgtcgtgccctactccagggcctccatggcgcagctgctcggcaagttgcccctgcaattcacaagcaagcaggccgcggaggacatggcactggccgcgttcaaccgtgccctgaagctttctgggccaggtctgtgcctctgtctacaagtaatgggtgttggatttactgggtcactcgctagcgcacgcccaaaacatggtgaccacaggttttatgtgtcaacgcgcacacaaaattgcctcaggacatcacatgtaacattgtcgaagggtttacggagcagagaggaagaagacaaggtctcaagctgttttgtgcttaaggcaatcgcagatgcatgcagaatttctgcaaccattcagtcagacgttcaagaacctgaaattccaaaagaaagtgtggaacaatttgatgaagaccaagagctccagcaagttattgatggtcaagtctgcatgaaagtttaccactttgctgatccaac

SEQ ID NO: 61470 - DNA, 616 bp, Triticum aestivum
  Clone ID: PAT_TA_61470
tgagattttgctaacaacttccttctgatcactaatctctggttttggtcagaatttgttgattgctcggttttattgtgttatgcaaggtgcttctaacaagttaaatggatgcactgatatgttggtgcttccacaatgtagaagttattcacatgttctttccagctgtatctgcataggtagccatcttgtagaatttgggtatgcattccactcttgttcttatccgaacatattcatatatagaaaaccaatattgtcagctacttgccctgaataatcccctatgctcttagaattatttcttatctttgtgatttattaggtaataacataattctaggacatatgattgttattgaaccttatgtcaattaagttcctggccaccacctttggtttcctctgattgatgcctgaaagcagatgtgacatcaattctccattttctgaatacagaacattaagaaacagactggagtgagggacaaggaacagacacttgatgtgcctgctgggaaggcaattacaaaggaattagtggtctgctgtcctccttagtcctttgaatgattcattttcttttggcatgcaataacatgactaatgctga

SEQ ID NO: 61471 - DNA, 346 bp, Triticum aestivum
  Clone ID: PAT_TA_61471
aacgactttcaaccatcctcaaagcaaagaaggttgtttgttccccacgtcgacaactcagacggcctcttgtgggctgcacaggtccgtttgattcctaattgctccttttttttctactctccctactcaatctgcattaacagtcctaacatttactacttcgaagcacttagtactctgtgccgcgggttaagccctacatctatgtatgtaggtgacatttttgaagtgtggcggggtggtctgggggtcggcctcgccccgtgctgctgttggtcttgtcgccccctgcgctgtctttgtctgttggtggcctttttggggtgcggtggggtggtctttg

SEQ ID NO: 61472 - DNA, 500 bp, Triticum aestivum
  Clone ID: PAT_TA_61472
cggacgcgtgggcagacgcgtgggttcgcccatcatgtcgatgttccgcgccaagaagctcgatctgggctgctttgttaacgtccgaaccctgcgcgatcacaccaaacgcaaggtctttgaggcccacgagacagagcgacaagctctccgatacatcatccgcaacacaaccctccctccccgagtccgcgccgaagcccagctccaattgacgcagatgcactgctacacccgacctacgcagatccgaaacagatgtatcatgggtggacagggacgaggtattctgagcgactttaagctatcacgatacaacttccgaatggaggccatggctggaaacttgcccggtgtcaagagagccagttggtaaagaccgagcttgggatgggacgaagagaagtgtacgactacgtgggtacttgggatcaggcgtctcaagatatcatagacatgactgtataatacaatgcaaaattcattggaacgctactttc

SEQ ID NO: 61473 - DNA, 413 bp, Triticum aestivum
  Clone ID: PAT_TA_61473
atatccctcaaccatctctaacaaccatccgtgggcggtgcaatcttttgtatccgtcggtcgctcccgacgaccgagaagagctagcgccgttgctcggcggagatcacgcgccggtcgcagaggcggagtagagaagagaggatggaccacgcggcggaggcgcagcggacggacctgatgacgatcacgcggcacgcgctgaacgagcaggggcggcacccggagtcccggggcgacttcaccatcctcctctcccatcgtcctcggctgcaagttcgtcgcctccgccgtcaacaaggccggcctcgccaagctcatcggcctcgccggcgagaccaacgtccagggggaggagcagaagaagctggacgtgctctccaacgaggtctttgtcaaggcgctcgtcagca

SEQ ID NO: 61474 - DNA, 713 bp, Triticum aestivum
  Clone ID: PAT_TA_61474
cccacgcgtccggatgaacagttcatgtgcagatgtcctcctttttgctgcacataggtggcagatgtccaaaccaagcttagtttccgagtcaaaggatgtcttcgatcagaaagcgagtaacaagtactggattgatgtgcaactacgatggggagactatgattcacatgacatagaacgttatacaagagcaaaatttatggactacacgacagataatatgtccatctacccttctccgactggagtgatgattggacttgatctagcttataatttgcactctgcttttggcaattggttccctgggtcaaagcccctcctccagcaagcaatgaacaagatcatgaagtcaaatcctgctctgtatgtgctgagggagagaataagaaagggacttcagttgtattcatctgaacccactgagccgtatctgtcttcacagaactatggagagatattcagcaatcaaatcatatggtttgtggatgacacgaatgtctaccgagttaccattcacaaaactttcgagggtaacctgaccaccaaacccatcaacggtgctatctttattttcaatccaagaaccgggcaactatttctgaaggtcatccacacaagtgtatgggcaggacaaaagcgtctagggcagctggccaagtggaaaactgccgaggaggttgctgcattagttcggtctctttctgtag

SEQ ID NO: 61475 - DNA, 419 bp, Triticum aestivum
  Clone ID: PAT_TA_61475
ctgccttcgggggtcaccggatcccgacgggatctagtcaagccctgctcgcatatgacggcggcggcgcggcggctgcaccccggcccccctcccccagtggctttaccccggccccctacctcaacatcagtaccctctgccgccccgaccaaattacatcctctgctgatatatgcgctggattagccgatgtgataagccgtcgttaccttgtttgccctccttattaccttgttgatattaccagttgctgtcgatttggccgtgacggctagcccaatctccgatctgtccttgactggtaatccctgggtctgatctcctcttcctccccctcagttgattgctgggcgtgatgtgcatcccatcctttgtgaggatggagcacgatgctgcggttgatttaagccccgcac

SEQ ID NO: 61476 - DNA, 724 bp, Triticum aestivum
  Clone ID: PAT_TA_61476
cccacgcgtccgtgatgagctgaagcggcgggtggagctggaccgcaggtccatggcgctcctctggaaggagctggaggaggagcggagcgcgtcggcggtggcgaccagccaggccatggccatgatcaccaggctgcaggaggagaaggcggccatgcggacggaggccgcgcagtaccgcagggtcatggaggagcagagcgcgtacgaccgggatgacgccgagcggctggccggcgtcgtgcgggagctcgaggccgaggtcgagggatacaaggccaggctcagggaccacgagatcgtcggagagatccgcgaccatatgcggctccttccgtgccagagagaaggcgaaaccggcggcgtgcccggagcggccggagaggaattctccggcggcggctccgaggacgacgagaacgcgcgcgcctggaagcagctgagggggctgacggacaggctccaccggctctcgaacaacagcagcgggagcgtccaagaaccggagcccaccgacgtcgaacaagaagaagagggcggcggcggcaaggaggaggacacgacggaagcttcggtggtcggcaagcgcgtgaggaacggcgacaacttcacgaaatggcagcatcttcagtccatcgagacgacgagcaagggctccactcacggccaccggcaccgaggagactacggcggcggcgagggcgacgacacggccgcgttg

SEQ ID NO: 61477 - DNA, 760 bp, Triticum aestivum
  unsure (1)..(760): unsure at all n locations
  Clone ID: PAT_TA_61477
cccacgcgtccggcggccgctcgcgatcagaacgtcggcggagtacgcacaggagctgcttcggcgcgccgagggggagcgagactggattgtcggcgtgcggcggcgcatccacgcccacccggagctcgcgttccaggagcaccgcaccagcgcactcgtccgcgaggagctcgaggggctagggatcaccgcctgcgccgttgccggcacaggcgtcgtcgccgacatcggctcgggcctgcccccgatcgtcgccctccgcgccgacatggatgccctgcccatccaggtccgttcccctcttctcttcccgtccgatgctacactgcgggctggcgcagggtgccctttccctccgatgctactccggtagtctggcgcggtgtgtgtgaccggtgtggttggtgctgaacggcagaattgtatcttctcggtactgtactactactngatcgtgcctgcttgattcatgtgatctcaatctcgtgactgtctcttgctctcggatagtatgccattgtttactggagggatcacattttgnttggttgtgcgcacttgggatggcaggaattggtagagtgggagcataagagcagagttgatggcgtaatgcccgcgtgtgggcatgatgcgcacacagcgatgctcctgggagcggcaaagctgctgcatcagcgcaaggatcagcttaggggaacggtgagactcctttttcaacctgctgaggaggggcggtgctggtgcatctcatatg

SEQ ID NO: 61478 - DNA, 565 bp, Triticum aestivum
  Clone ID: PAT_TA_61478
gttcggtaaaaaaaaaaaagttctttattttttttattgcgcccactacatataagcaagcatcgtgctagctaaaagtctaaactctaaaaaaatagggatattcgtttcacgaatcagcagtattttttctgtgcttctgtgcgaagcatacagaaaaaaattactaaaatactgcatatccctacgggatcagaaatcagtacacttcgttagggatatgaagctgctggtagaaaaaaagctattttttttttaccgctcgctttggatatataaagtataaatgtaatttaggtgcgccagcgtttcgctagctgctcctaaattatataagtatagaaagaaattattgtagaatttaagctacatattaaagagatttatttatataaataggcttgctagctgattgtatatatatgctggccgtatttcatagcaagctcgcttttaataggcaaccagtaatatgagcaattctttacctacaagcctataattatattaactctaagagaaatctaataataaacggagtgaattgaaatatcttattaacttc

SEQ ID NO: 61479 - DNA, 347 bp, Triticum aestivum
  Clone ID: PAT_TA_61479
atatcatcaatttcaggaagcttatgtagtttgtcattgattattgatgtcataacaaggatatgccatacacacgaagatactcctattaacacgagtgccatcagtatagtgaccttgtgcatcagaaaaaggacttggttaaagcataaggacgatgatcccgtttttgctctataggcctccccttcttcaaatgaagctccaaccttagcaagggtatggtagtagatgatgtgtctgttttgtttgtgtcgacagacaagcggttggttgattctgtatacacatcctgcaaactaagcttagcaaatagcaataaagctacaacaagtgtgttcactgtc

SEQ ID NO: 61480 - DNA, 453 bp, Triticum aestivum
  Clone ID: PAT_TA_61480
cacaggtgtaatgatgcatggttatggccttgtgaagaagctgtgtacagagttgcaggattttatgagaatgcacgacttttcatcaattgaagatttccgaggggcgtctctcccctacttcacgacgcacacggacctggtgcagcggcagaaggaggcgatcaagcagcgcaaggccatcaggatgggcctgcagtcggacaaggactggaccggcgacgggttcgtcaaggagaccgagagcatggtctccaactgatgccgcgactccgcctgatctctcggtctccaactgatgatgcaactcagtctgatccgatcccctcacgacgcccttactttccaccatacttccttccacttgtgattacacccggatttagaaacgaaacaaaaagaacagtgggaacctttgctgcacctcgttcaataaagcatgatgatggtacg

SEQ ID NO: 61481 - DNA, 721 bp, Triticum aestivum
  Clone ID: PAT_TA_61481
cgaggcagagcgtcgcggcggtggtgaagccgtcgttggatggcggtgccccggccacggcgtcgttccgtctccgtaacggcagcctcaactcggttcgcctccgccgggtgttcgacctgttcgacaagaacggcgacggtcagatcacggtcgacgagctggcgcaggcgctggattcgctcgggctcgtcgccgaccgcgagggcctggcctccactgtgggcgcgtacgtccccgagggcgcggcggggcttcggttccaggacttcgagtgcctccaccgtgagctgggtgacgcgctcttcggcgcgctggacgacgtgcccgaggacggcgaggccggcgcgggcggggacgaggaggagatgaaggaggcgttcaaggtgttcgacgtggacggcgacggcttcatctcggcaaccgagctgcaggaggtgctcaagaagctgggcctccccgagggcagcagcctcgccaccgtgcgccagatgatttgcaacgtcgaccgtaacagcgacggccgcgtcgactttggggagttcaagtgcatgatgaaggggatcacggtgttgggcgcgtgaccatcgaaaccaatcgtgtccgatcgcacgctgcaacaaaccgcacatcctctcgttcatgggtggcgatcagaatcggttcccgtcaatcaagtacaccatcttaaattggatgctaatgtacatgtgcttatatc

SEQ ID NO: 61482 - DNA, 398 bp, Triticum aestivum
  Clone ID: PAT_TA_61482
cggacgcgtgggcggacgcgtgggtgaggggcaaacaaaggatctgggtcatgcagagaaggactttgacgaacttaactacagggtcaagggggcaaacactcgaacacgtcgtctgcttgggagataggcaaaaagcagatactgttgtcgccggaggattcctacagcgctccttattttctgcagtttgctttcgtgggttggtaattcagatcattttgtgcatacgactctgatcaggatggttcactaggaggtgactgggcagttatcagggtttattgtgtatagaccgcggttcattttctaccttgcagttgtagtacatttgatatagacagtacatacacaagtctgtattcggttttcttgttttgcaatctatatgctacagg

SEQ ID NO: 61483 - DNA, 722 bp, Triticum aestivum
  Clone ID: PAT_TA_61483
gcggcttcaacagttactgcagcttcgatggcacccagaatcagacaacagtatgccaatgcccagaacattacgagttcttcgacaaggagagaaaatacaaaggttgcaggccagactttgaaccacaaagctgttacctggatgaggcagcagcggtggccaagtttgagatgactcccatcaatggtgctgactggcctctagccgactatgaggagtacagccccatagatgagaatgaatgccggacactctgtgtgattgattgcttctgtgccacagccgtcttccgtgcaagcacaaatacctgctggaagaaaaagctccctttatcaaatgggaatatggcggcagatgtagacaggacagttcttatcaaggtgccgaggagtaacaattcagagtcccagcttagcagcggctccaccaaatggaaggaagacaagaagtactggattcttgggagttccttgttttttgggggttctgtattggtaaacattctccttggcagtattctgctcttcggcacttactgcggtatctccacaacctccaagaagaaacttatgtcatcgcaatcatcgggtagttctatattgcccccaaagattttcacttacaatgagctggagaaggcaactagtgatttccgtgaggtgcttggcagtggtgcctctggtaccgtgtacaaaggacagctgcaagatgagcatgcg

SEQ ID NO: 61484 - DNA, 595 bp, Triticum aestivum
  unsure (1)..(595): unsure at all n locations
  Clone ID: PAT_TA_61484
cccacgcgtccgcaataatggaagcttcatctacccccgagcggtacctggcgccaacgctagccgcagcttcgttattggagagacacctttcccttactctaccgaatggttccagtacattatcttgaacaacaccaactggaagcctgaagacatcggccccgacgcctatcaggcgaccgaagaggtgaaccccttcaacgtccagacctgggagggcgatctgtccaagttccgcgaccgcggctccaagatcatccactggcacggtctccaggacggtctcatcagctccgacaactctatggattactacaaccacgtgtcgcgaaccatgggcatgagcaacaccgagcttgacaagttctaccgctacttccgtgtcagcggctgcggccactgctccggtggcgacggcgccaatcgcattggaaacaacctttctaacttgggcggcaaggatccaaagaacaacgtcctcttggctatcatcaagtgggttgaggaagggtgtagctnccnacactatcaccggcatgcgctttggcaatggagcttaccacgggcaggtttgacgacgaacgccggcact

SEQ ID NO: 61485 - DNA, 455 bp, Triticum aestivum
  unsure (1)..(455): unsure at all n locations
  Clone ID: PAT_TA_61485
cccacgcgtccgcccacgcgtccgcttgtgcccccgcacaagtacgttccttgggtggtggttgatggccagccgctgtacgacgattacgagaacttcgaagcttacgtctgcaaggcttacaagggccatcctcccaagatttgccaagggctgggccgtgactacccaatcgtacaacaggtggtggaggccggcaccggtgtcacctacaactccggcgatttcgagctggatgaaggggtcgaggacgagattaagatggtccagggtgatgacaattgatagattgtatatgtctcctttcggggctcctataccgatatacgtgaacatagggcagtttcatctttctgttcaggttaatggagatgaacaccagtaataaagtgacttatggtgatgtaaatttatgttcaagttaatatggagataaaaaaaaaaaaaaaaaanan

SEQ ID NO: 61486 - DNA, 352 bp, Triticum aestivum
  Clone ID: PAT_TA_61486
cccacgcgtccggacaatagcttcagttttctcagtaccaagtgcagaaaggatatgcagaggaacagcctccttgactgaacagcagaggatggagagattttatgcgtacaagtggtgaaactacagtacatgcaatatgtatttaccatataatattttttttgttagggaaattctactgtataagtgtttgttagcagtaagtatgcatagctgtcaaacccctagtttggccaactctttgccttattgtggaaaactcaaaatcttagtatgtgcagttgtacacaaagattgtaacctaccggcaaaagttaaacaaataataaagtatgacttgtgtgcattc

SEQ ID NO: 61487 - DNA, 605 bp, Triticum aestivum
  Clone ID: PAT_TA_61487
cactattcaaaatggcttctgttatggcatggggcgccggcgctgccgtcgcggcctttttgggtcgagctggtctggtcgcatggagacgctcacgaggtggtgttggagccatgggcaaggctttctacaagggtggttttgaggccaagatgaccaagaaggaggctactctgattctgtcgctcaacgagcgagccattaccaaggacaaggtccgcaaggcccaccgaaccctcatgcttctcaaccatcccgatcgaggcggcagcccttaccttgcgacaaaggtgaacgaggccaaggagttcctggacaagaacggttaaatcttatgaactcgacaaaacactcgttcgagttctcgatattcggatccgtcagaatcgatttatgagctttacaaaaaacataatcaacgactagggtctggcgtgggcatatggccgcgtgtgtatagtgtacactacttgttttcatagcgatggcgtttgttggggttaagaggaggctctttgggggcaggggatgggatatgccggcgtttagctatctgggcctgaatggcgtatgaatacagggccaatcgacccgttctttccttc

SEQ ID NO: 61488 - DNA, 710 bp, Triticum aestivum
  Clone ID: PAT_TA_61488
cgcacccgcgccgtcacgtccaggccccccacccccgacccgctgctcccatctccgccgccccaaagccctagccacctccaagctccctcgccgcgtcatcgccgcccttcacatggacggcccccgcgccgcgccccttcgctgcactcccgccgagacggacgcggtggcgacgacctcggaccagaccgagacggcggcggcggtcgaagccaccgagctgggcaacaacggggccccggccccggcggcggacgcccccgccgccagcatcgaggggctggacgggataaagatccggaggcgcccggtcacgggcccgtccgtgcaccacgtgggccccttccagttccgcctcgagaacgagggcaacacgccgcgcaacatcctcgagaagattgtctggaacaaggacgttgagatttggcagatgctgttcttctgattgccgccatcttacctgatcgtgatatcagttatatgctgaaaatatgcaaaatactcgggatggcagctctagttgaggtgcatgatgaaagggaaatcgaccgtgttatagggatagctggcattcagcttattggcatcaataaccgtaatcttgaaacttttgaagttgacatttcaaacccgaaaaagcttctggagggggaacggggacaacttattgcccagaagacataattgtcgtaggcgaatctggactg

SEQ ID NO: 61489 - DNA, 531 bp, Triticum aestivum
  Clone ID: PAT_TA_61489
ggaagtcctcctcccctctctcccgctgccacttggacggcgagctgctggagctttcctacctccggcctgcggaaggattcaaatagtggacgggctacaggcagtaaagatttggagagctggggacactgggatggcgtttgcggtctccgacgagctgctgggcacattcgtgccgattgcggtgtactggctctattcggggctgtacatcgtgatggacaggatggagattgacgactaccggctccaccccaaaggggaggaggaggtgaagaacgtcgtctccaagtggacggtcgtcaagggtgtccttgtgcagcaggggtttcagattgcggtctcacttctcctgttcacgatcattggtgatgacagcggtactgtgagaaagcagccttccgccctggtgatagcactgcaatttatcatcgcaatggttgttatggacacatggcagtactttatgcacagatacatgcacatcaacaaggtcttggtcaagcatatccactcgaagcatcacac

SEQ ID NO: 61490 - DNA, 381 bp, Triticum aestivum
  Clone ID: PAT_TA_61490
gctcctctctctctcttctcgttttacttcccaggagcaatccaagcgcgggggggcggggggcaggtggtgactggtgatgtggccggcaccgctgggcacgtagagtatatgctgaaagttttcccgctcgctcgtgttgcttgggaaggatggtgccgatggagatgcacggcagccaggttacagcacgcgcgaaagctcgacacacagcccgtggctcgtcccatgcgtaaacttgaccaacagaatgtacgcagctggctccaacacatgattgaatcgaatccgtaccaccatgtgcatgtgtgtgggatgttttttttagagtgaattcgggtttttactccctcttttgacaattataacactaattactcc

SEQ ID NO: 61491 - DNA, 730 bp, Triticum aestivum
  unsure (1)..(730): unsure at all n locations
  Clone ID: PAT_TA_61491
acctccaaacggttcatcctatttccaatttttttcagcttcagtgcaggtcttgtctctggttaattgttgtaggattatagctacgcctggttcaagcacaaacaattaatttgcataaagttgagcgctgcatacgcatatggacatggagagggtcacaatacacacggcagcatgtttcaccatagcattcgtggttctcaccacgatcatctccaagatcattgcaagaatcagaaccgttcatcttgtgcgcaaaggagaaagatcaccaattactctgcgcccaccacatgttgtgagtggagctcctctaatggcagccctgctcacacttgtgacgcccaagaagggtttacatgctgcaatccatgaactacacatgaagatgggaagtgtgttcacagtgaaccttttcgggctaaagaaggttacatttttggttgggccagaggtcactcctcatttcttcaagggatcgccatccgatatcgacttcggngatacagctaagatcattgtgcccgtcctcggtccaggagttctgtntggtgtggacatggctaccaggaatgagcagatcccgattttgtaccaaggcgatacagccggccgaggtttgcgaagagatgttcattccatggtttgcgaaggggaggactactttggcaaatggggacaaagggcacgggttgatttaaagcatgagcttggccacctaatcgtg

SEQ ID NO: 61492 - DNA, 522 bp, Triticum aestivum
  Clone ID: PAT_TA_61492
caaccaaatcccctcccttcctctccctcgtcccgacgagcaccagcggccggacatggacgcctcagccaccggagccggagcgaaggcgaagaagggcgcggccgggcgcaaggccggcggccccaggaagaagtcggtgacgcggtccgtcaaggctgggctccagttccccgtcggccgcatcgggcgctacctcaagaacggccgctacgcgaagcgcgtcggcactggagcccccgtctacctcgccgccgtcctggagtacctggccgcggagctgctggagctcgccgggaacgccgccaaggacaacaagaagtcccgcatcgtgcccaggcacctgctgctggccgtgaggaacgaccaggagctcgggaggctgctggccggcgtgaccatcgcgcacggcggcgtgctgcccaacatcaacccggtgctgctccccaagaagacggcggagaaggagcccaagtcgcccaagaaagctgccaagtcccccaagaaagccgacaagaaagc

SEQ ID NO: 61493 - DNA, 607 bp, Triticum aestivum
  unsure (1)..(607): unsure at all n locations
  Clone ID: PAT_TA_61493
gtgctggagatgctgcctgcttcgagctgttgctgttgctgcctacttcaagccctccaggaggcgatctggaccaagtggggaggctatctgcagcagtacctggagctgcatgggagggcgcggcgatctggacctggggctgccaatctgaagcggtaccccctccggcgagcagtacctcgatctgaagcagtactctctggagctggcgaggccttgggagggggacaacgatctgcagcagcaccccctccgacgaggcgagttggtgaggccccctccagcggcagggggctggattggcgcaggncgacaggggggtggccctgggagaggggcgaccctggcgacaggaagcaagcagcagcggcgactgggatggagaggatctgctcggcgaggaagacgacggcaatagcgattcaaattaggggcacttctgtactttcctcccttttcacctggtcgggacgttttttaaaacgtcatatatttcggaacggagggagtaatagttttggagcatcgatttattttgccactgttttcacgaatgtcatccgatgttgaaactttgcaagaaatcaaaatatttgtcaatgct

SEQ ID NO: 61494 - DNA, 552 bp, Triticum aestivum
  Clone ID: PAT_TA_61494
aaaaaaaaaaaaaaaaaaaaaaaaaaaaaaaaaaaaaaaaaaaaaaaaaaaaaaaaaaaaaaaaaagaaaaaaaaaaaaaaaaaaatgaaaaaactacgaaaaagagttgggcgtgccttttctctgtttccgattttttggtcggcgtttcctcccgttttttttttcgttacttttgttgggctttgcctttgttttggggctggggggttttcggccgttttgcttttggcacccgctcgggttggctcctttggtcctgcctccttcccatcctttttttatgggcatgggggaatcggcaaccggcccttgctcggatctttcttccgcggtgttggtcatggttgttgggcacttggaccgccctttgtccgggggctttaggcccgggcctgtgggcgttttccttttctttaacggttcttttgtcccctttcttaggctcgctttcttttggtttttccgtttcttttttggatgggggggcttgcttttccccgggggcccttttatttggggggctcctttttgggggttcctttttgggt

SEQ ID NO: 61495 - DNA, 407 bp, Triticum aestivum
  unsure (1)..(407): unsure at all n locations
  Clone ID: PAT_TA_61495
cttgaaggtcttaatctgtcatacaatcctcttagtcttcagataagaaatttcatggatctctccatgaaagtctttgtggtcgtcctcctgcttcttgtggccactgaggaccagggaccagtgcaagtagctttggcgagggactgcaagtcacagagctacaagttcaaggggatgtgcgtgcgcgatgacaattgtgcaagtgtttgcctgaccgagggtttccccagaggcaagtgcaagggctttgcatgttcctgccacaaggattgctagatggccctgatttgtctattgcatacatgcttttgtgtaataactactgaataaataatagtagatctatatctatgtatgtgtgtatgcaagcatatgcatttgtgactgatgcctnnnaaaaanaa

SEQ ID NO: 61496 - DNA, 581 bp, Triticum aestivum
  unsure (1)..(581): unsure at all n locations
  Clone ID: PAT_TA_61496
cggacgcgtgggctttatagcaagcagagggtctaggaagcacaggcaggatcaagatcaactactaaagcatccggcgagaatggttgcgacaaagacgggcgagctgagggcgctgttcttgtcactggaccgggacgcggacggcaggatctcggccgcggagctgcgggggtgcatgcgggcgacgctgggcgaagatgtgccggcggaagaagccgaagcgctggtggcgtcggtggacgctgacggcgacgggctgctgtgcgagtccgagttcctcgagctggcccagcaagcggcctggacgggcgcggacgaagagaacgacgagctgaggatccgggcgctaaaggaggcgttcgggatgtacgagatggaggggcaggggtgcatcacgccggccagccttgggcggatgctcggcaggctcggcgccgagcggggcgccggcgagtgtcgcgccatgatctgccggttcgatctcgacggcgacggcgtgctcagtttcgacgagttcaagatcatgatgagctanggatagctagaccttaccccggaccgaagcatataccactccg

SEQ ID NO: 61497 - DNA, 581 bp, Triticum aestivum
  unsure (1)..(581): unsure at all n locations
  Clone ID: PAT_TA_61497
cccacgnncgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttcttaaagaatcaaattttacttacccgggcatgcaaagaaaaagtttttttatagggcccccaaaattaaattaacgggccggggtttaaaaacggggggatgggaaaaaccctggggttacccaatttaatggctttgaaaaaaatcccctttttcccagttggggtaaaaacaaaaaggcccccaccaatcgcctttccaaaaatttgcccaccctaaatgggaaatggaaccccccctttagcgggcctttaaccccggggggggggggggttacccccaaggggaccgttaaatttgccagggcctaaaggcccccccttttggtttttttccctttttttttcgccaagttggcgggttttccccgggaagttttaaatggggggccccctttaaggtcccaattttagggtttttagggcccctctcccccc

SEQ ID NO: 61498 - DNA, 603 bp, Triticum aestivum
  unsure (1)..(603): unsure at all n locations
  Clone ID: PAT_TA_61498
gagcgccaaagcggagctcccggagccgccggacagaatccttttatgtatccttgcataaaaacatcttctgaattaaaatttcgagttgcacaagtgagcttgttctttaacaggttaagacgccacaacttctgcaactgctagcagggcaattattcccgtatctagttcactcaaggaataaatgtcagttgataactttgtaaatattcttcattagcaaggagtcattctgcgcctccacctgttaaagaacaagctcgccggcggcaacattcgaccgcacatctcagcggaaagagaattcagagatcgccggcggctaacgatgcgcgtgtggtggaatcatgccgctgatattatggcttggcgacagattgataaagttgggcaagccaccattacaagatgatatctaacttgagaagctatcgttgactcgttgttcaagccatcgttcactcgttgttcaacagggcgaggcttcatgattactgcggcaatgccagagaaccagagaagagttaagcctagcttcagtatggctccctaactgtaaaatttaatgcagntcacttgtgataatgatctttttctgta

SEQ ID NO: 61499 - DNA, 236 bp, Triticum aestivum
  Clone ID: PAT_TA_61499
aaagaaaccaaacttacataaaacggggccggccgactttataggatcccaatatttacgtcacgctaagcttgcatacactagtaccgtctgtttatacaagcgcacctaaatgggaataacctttggccgttactttatacaaacgtcgccgatctgaggaaataccctggtttttacccaatgttaatacgcacttgcagaggcactcccacctgttcgccacgttggcagta

SEQ ID NO: 61500 - DNA, 380 bp, Triticum aestivum
  Clone ID: PAT_TA_61500
ccgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccggttttgaaaaaacccaagttttacttcacccgggcaggcaaacgtaaaacctttttttatagggcccccaaatttaatttcaggggccggggtttaaaaacgggggaatgggaaaaacccgggggttaccaaattaaatcgctttgaaaaaaatccccttttcccaagtgggggaaaaaggaaaaaggcccgccccgatcgcctttccaaaaatttgccaaccctaaaggggaaagggaacccc

SEQ ID NO: 61501 - DNA, 418 bp, Triticum aestivum
  Clone ID: PAT_TA_61501
ctccggcgagcctctgaaggcggcaggaggagatggtttacttgtgagaggttccacgcggaaagcccgatccaggcgcgcacgatcgtaaagaccagtagagcccagcggcacaccgtgaaaagcggagtccggtcacaagcaatgtaccaaatttgtatggtcatgcttgttaggattatgcataccatccgatgcatacctcctacttctgcggacctacaggatcgaggtctgcgctttcggataggagaacattctgttatgattaacttgcttaatcctattaaagatacatgaggtggataccatgatggaggttccctgcgtatgaagaagcccgtgggaccgggctgatctaaatttagtgccttgaagaatgcctccatcctctggtacgggcatgatgatgctctga

SEQ ID NO: 61502 - DNA, 150 bp, Triticum aestivum
  unsure (1)..(150): unsure at all n locations
  Clone ID: PAT_TA_61502
acgcgtccgctatatgtaaatgaaatgagatacaatgcactcaaagagtgtatctttctgcgttacattagatccattctggtcanntgtncgctgtnngatgacactctttgcattggcattggattctatttccatttgacatatgag

SEQ ID NO: 61503 - DNA, 579 bp, Triticum aestivum
  Clone ID: PAT_TA_61503
cccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaacccaagtttacgtccccggccaggcaaggtaatagtttttttttggggcccccaaaattaatttcccgggccggggtttaacaccgtggggacgggaaaaccccgggggttccccaattaaatggctttgaaaaaaatccccttttccccagtgggggaaaaagcaaaaaggccccccccgatcgcctttccaaaaatttgcccaccctaaagggaaaagggacccccccctgtaccggcccataaagcccggggggggggggggttccccccagggggaccgttaccttggccagggccttagcgcccgctcttttcgtttttttcccttcttttctggccaggttggcgggttttccccgtaaagctttaaatggggggcccctttaagggtcccaattaagggtttaacggcccctcgcccccaaaa

SEQ ID NO: 61504 - DNA, 491 bp, Triticum aestivum
  Clone ID: PAT_TA_61504
gctagttctagatcgcgagcggcccgccctttttttttttttttttttttttttttttttttttttttttttttttttttttttttttttttttttttttttcaaggaaggggaaccaaaacccgcctaaaaggcccaacctggaaaaaaaaaaaggccaccaaaatggcaaagaaaaggcagggttcccccctccacaacccaaaaaagtttgggaaaagggggggacccccaacccggtaaacctcggaaaggggggcccccttggttggaaaaccgacaccattttttgttgccaggggacaaccaccaaatttacccctccaaaaggagaaaaaacggccccccccctgtttttttttgttaaaaaaaccaacctttgggggaaatcccttttggaaaccccaaacccccttcctttagggggaagagtttttttccccaggcaagcagtttttaaaaaacgggggggtggtgttcccccttggggg

SEQ ID NO: 61505 - DNA, 610 bp, Triticum aestivum
  unsure (1)..(610): unsure at all n locations
  Clone ID: PAT_TA_61505
cgcgttatcaacataaaatgtctgccaactcagccgagaacatagtccgggtctagtcgaggtagcctctgcctcggcgagcaaccctgttcaaatcatcttgacgcctccgacgccgataataccttcaggtccagctgctattgaccgccgtagcgaagacacaaacaaggaggttcaccgcctacctgatgtatctgaggagaaggaagttgtagcgaagaccgacttctctgatgagaagcaggtttataacgaacatgatgctcacgatgagaagcaagtctacacctcggatatagggaaggaggtttatgacgttggggtagagaaaaaggtccaaaacttgaagctccacgatggacatgatgagaaacaaatattcgaccccagtctcggcgtgcatgatactgagaaagaggctctctacatccaaaacctacacgatgcagaccagcgaaggcacagcaactcaacagaatccaccgaaacatctcaatcacaagccaagaccaaaccattctgctacaagcgccatgntcggcaagttcaatgaagcaatcgacaagaagaagaaagattggacgaccttcagcaacaactctagtac

SEQ ID NO: 61506 - DNA, 234 bp, Triticum aestivum
  Clone ID: PAT_TA_61506
ggcgccagtggtgcagagagttaaataattttctccagatgggcccattgtaaaatgtccaaactgcccctgccctactcagtccatcccaacggggtacatctctcaccgagcacgcgggaagacctgaggcggagatggagctccggcggaggtggccgtggctctgccccgctggccttgttgctcacccagcccggaaaacctgggcctctcccagcacggtgctggggc

SEQ ID NO: 61507 - DNA, 616 bp, Triticum aestivum
  Clone ID: PAT_TA_61507
cggacgcgtgggcgcaggataaacctagcatcatggtcgccatggacgccggcgctgcacctgcgccgctggttggtcctctccgacaccgtccgggccctcctgcactgcatcaccctcctaccgcgcctactagacctacaggcccctctccccccttctcctcctaaagctagagatttcaggtcgcttgggcgtggaatagaaaaccagatggatttcttttggtgttcatggagaggcagatctggctttacttttgtcttctcatgtgtgttgttcttcaattttgcaggaagtgctcatgtatcaaattccatttgttactcaacctgtagtggattccatttgctgaagatatcttccattgtcaccagtgcatccttctatctggccttcacggatcagtggtgctgctgtgtgaatttgtgccgctgtgtcgaattgggcggaggcttccctgtcaagaagaagagaagcgttgggcacttcagtgcaggcaagggtggttgcccatgtcctggaggctaagatgttggcttttgtagcagcagattccctatgtatctatcaagatgggatattcaggtcgctctgcgtagtgggtgcctcatca

SEQ ID NO: 61508 - DNA, 667 bp, Triticum aestivum
  Clone ID: PAT_TA_61508
cccacgcgtccgcccacgcgtccgcggacgcgtgggcggacgcgtgggcgcgcgcgcccgccctaacttcgtcctcatcgacgcgcggagaatgctttttacaacaaaggcatggaatgcacaacttgctggagctgcagcaattctcgttgtggatagcaaggacgagcctttgatcacaatggacaacccagaagatactggcacgaagcacttagaaaatatcactattccatcagtgctgataacaaagaaactgggcgaggaccttaagaaatctgctgaaaatggtgacatggttagtgtcctcctggattggagggaatcccttccccatcctgatgagcgtgtagagtatgaattctggacaaacagtaatgatgaatgcggccctaaatgtgatatgcaaatggattttgtgaagagcttcagaggaaccgcacaagttcttgagcagaagggttacacacagttcactcctcattatattacatggtattgcccggaagcttttaccgtgagcaagcaatgcaaatcccagtgcataaatcatgggagatattgtgcaccggacccagagcaggatttcagcaaaggatatgatgggaaggatgtcgtggtccagaatttacatcaagtctgtgtattcaagggtgccaatgacact

SEQ ID NO: 61509 - DNA, 593 bp, Triticum aestivum
  unsure (1)..(593): unsure at all n locations
  Clone ID: PAT_TA_61509
tgagatatacaactttgcatttgcttgggctagggaaaagggtcagaaatcccttccactggagacagctattggaatgtggaggttgctgtttgctgaaaggcattggcccttaatcgatcactggtgtcagtttctccaggtcaggcataacaaagccatctctagggacacatggtctcagctgttggaatttgttaagacaattgatccacagttatccaattatgacgaagaaggtgcttggccctacctaattgatgaatttgtggagtacctaaccgagaatggatgcgttcagcgtaacaagtgaaccattcgaggctgcattctgacttggatatcatgatttggtggtacaaacatganttcatgtcgatcaatagaatatttatctttggatgtcggcattgttccagctgcccttcacaaagcagatgatgtcgtttggtggaatctacttgcgcagggggtgatttcactggctaggattgcaaactatctatctggnttgnatatttgggctgcacctatctgctacagcatacccaaatagttattttgttttactgctgaatgggcgatgggtctat

SEQ ID NO: 61510 - DNA, 595 bp, Triticum aestivum
  unsure (1)..(595): unsure at all n locations
  Clone ID: PAT_TA_61510
gtacgccgggacggcgcaccgtctacgtaactccctctgcagctggtccggctcgagttcgccggcgtcgagtgcgcggcgcagcagctgagcagggacagaaggcgtacgtgcaccggctgtacgtggaggcgttcgagcagcggcacagcctccaggaggccgagcccctgccggccgccatgctcctccacgccagcagcagcagcaacagcctcccaatgctgcagaacgcagcgccggccgccccaccgccgcttccggcgacgccgctctggttcccggggaaccaggagctggacctccagatcgtcgacgatctctccggcggccagggcaactttggcttccagatgtttcagagcaacttcggctaaagatgcaggaggagcagagcttcagctgtgtacattaaccaatgctgctactactactaccactactgtctattatctactctatttcagaatgtgnggtgagttcagaatagnntcaatttcagtcacaccaagggtgtaaggcaacttaggtgaactttgggcggcccctcgccgctcgncgaaggatgcgcttaagcatccgcgggcggcgacag

SEQ ID NO: 61511 - DNA, 198 bp, Triticum aestivum
  Clone ID: PAT_TA_61511
ccacgcgtccggtctgtgtccatgtctgtaccttgcgcacacactgtgtgtgcatatatatttatgcgacatgtatgcatgcgtccgtatgcgtgagtgaactgtcaactctttgctgtactctagtgtagccgatgtgtacgtgtgatgtgcctgacctacttgttcaggcaattaatgaatagtaattattttcct

SEQ ID NO: 61512 - DNA, 684 bp, Triticum aestivum
  unsure (1)..(684): unsure at all n locations
  Clone ID: PAT_TA_61512
cccacgcgtccgctaccatatcgctggtcatgaggttcctcacgatacagcggccgatattggctgctgtggctggcctcgcccggccggcctttacccccgttgctcccctgggtgtgcaattggccaattccctcgtccaaggtcaaagatttgcctcggtcaagtcacagggagcatacaagaaaaagcccaagaggggtattcccaagaagttgggtgccaagcgaacaggagatcaattcgtcattcctggcaacatcctgtacaagcagcgaggtacactttggtggcctggcgagaactgcatcatggngccgagatcacacaattcactcaatggctaccggctacgtcaagtattaccgcgatcccgcacgacaccccgaccgcaagtaccatcggcgttgtgttcgacaagaacgacaccctgccatatccccagcacgccgagcgcaagcgaaagctcggaatganccgttttccccatcaaagaagccgccgccaaacctgagatctcgccttcaggaattcccttccaggtcacccgtatcgaggcccggtgagcccgacagattactcaagctgcgcaaggatttacagttaccgcgaggacactgnggcgatcggaaagctggcgangacgactggtctaaagacgaagcgattcagacacgaaagcat

SEQ ID NO: 61513 - DNA, 729 bp, Triticum aestivum
  unsure (1)..(729): unsure at all n locations
  Clone ID: PAT_TA_61513
ccacatggacgcgccggccgcctgcgagatcgagcgcctgccggaggacctcctggtgcacgtgatatcgctcacgtcgcctgcggacgccatccacgccaccgccgtgtcccgggccttccacgccgccgctgactcggacaccgtctggtcccgcctcctgccgcgcgacctcccgcagttcgccaagagggagctcctccgcaagccgccttaaatatcttcttttgtactccctctttaaactaatatgaaagcgttgtgaagtttttatattagtttacagagagaatacgtacgttgcagcgcatgcagctggacaaggccaccggcgccaagtgcttcacgttttcggccagcgcgctacacatcacccaagctaatgatgcacacgcgcccttgatacgttgtagggttcagtggccgggttacagcaaaagagggcaaaaggttctcacaagcagctgacatcggccatgttaacatactcgagatatgtgccaagatacggagaaacatgctctctcaaaacacacctacgtggcatacatgggtgttcaagctaggacccagatttacagctttgatttcccgtttcaagaagcctcatttggagttgctgggagacagtcgacccggcaggtttgcctgcaggctatttcgagnacggtgatggnnnccgatgttccacctcggaacacatcgtgccaagttcttacagtatatata

SEQ ID NO: 61514 - DNA, 699 bp, Triticum aestivum
  unsure (1)..(699): unsure at all n locations
  Clone ID: PAT_TA_61514
cacgacgatactgcggcctgtgtctgcgtggaataaaccagagccacgcagcgggtcggctcctccacccccatccccatctggcgaacggcggcgcctgtgctgctccggcgagatttccaccaatggcctcagctcaacgggatgtgtgctgcgccctggccgtggaacagttacgtctttccagtggcgtcacgggatttcatgagtgtcccaaacgtcgcgtttggcgccggcggtggtgcacaggcaggcgtggaggctgcagcgggcgaggtgtgctctgaagccaccagtggctggacaacggaggataaggatcggcagggctcctgaggagagggagatgaatcccaacaggaaaacatcgctacaatggtctgtgcgtgcttatgcagagaagggtgatggtccagttgtgaaaacagcgccgaagtttatcaaacgtggtgttgttgggcacaaccagaactatcttttatgcccttccctgaattgttgnttggtctactatgtaaactgcatgttaaatcatggggctgttagtttacgtaaccgctagttcaaaactgtggcgttgatatcatgccactacttagctttggtaggcaggaaactcattcanatgtgttgtggctgttgtaactacacatgcctgcattntgtttctggtgggcttcagntatatgctctttcgcc

SEQ ID NO: 61515 - DNA, 245 bp, Triticum aestivum
  Clone ID: PAT_TA_61515
atcgagagagtcttgctccgtatctgccctctcctgtagggtagagcatccatcacgtgaagttcacggacaaacatgtctccggtgaaggtgttctggcattcgatgttgacaaacgtcgcacttgtgctgttcttcctggaagactgagcgtgacgaattttttttgcgtgcctcatctgtggggggggaggatgaaggtgcttcttcggctgttgggtgagtcgttgccgggtttccttttt

SEQ ID NO: 61516 - DNA, 652 bp, Triticum aestivum
  Clone ID: PAT_TA_61516
cccaaacccgccttctatcttttatttatacttttgaaactcctcaattcaagattgtggagcacaaatctcatactttcaacgaaatggcccaaaagtgtccatcaaggttgtggaaaggagtttacggaccccgatgagaagtgcgagtaccaccccggtccgcctgttttccacgagggacagaaaggatggaagtgctgtaagcctcgagtattgacctttgatgagtttatggaaattccgccatgcacgacaggcactcattcaaccaccgacaagcctcctcagctagaggagaagccccagcaggacgatgctgccctcgcccagaaaattgatgcgttgaacgctgcgactccttctcgtgcaccaattcccactgctcagcatgctcccaccccgcctcccccagctcctgaatcggaggacgatgatcccagtctcgagattgccgatggtgttggttgcaagagaagagcatgcggcgcaacctacaagaagagtagctcgcgagataatgaggagtgtgttcaccacccaggagtgccaatctttcacgagggaagcaagggctattcctgctgcaagagagggtactggagtttgaccagttcatgaagattgagggttgcaagaccaaggacaagca

SEQ ID NO: 61517 - DNA, 682 bp, Triticum aestivum
  unsure (1)..(682): unsure at all n locations
  Clone ID: PAT_TA_61517
aaatcccttccctcttgcccggccgtgggcaaaaaggcccccgtccggccttctcgcgccctccttctagcagcgtcataacagaggacaaaaatataagtagggtatttacggattcatgcccactccatgatgaacagggctgttggcttggtcgcagcatatcgcacttgacatagcaattcagtgcttactgttcgaatacagtgctggactcacttgaaagctataaatagaaattgtaaatttgttgctttgtggagaggctgtcccaaatgtatttgatggcaagatggaccttggtggcggcatgtccctgaaaggcattccaaatgatgttgaagttgggttccttacccttctggaatcactaaatttgtgcaaggttggtcagtacctaaagtgcccgaaatggcctatatgggtggtgnnggaagtgaaagtcactacactgtccttttcgccctaaatcccaacgtccaagaggagaatgagctggaagagcgggaatccaaaattaggagggcatttgatgcacaagaccaaagtggaggtggaggctntattgcggtggagggattccagcaagttctgagggacaccgacataacatttccttctgacaagctcgacgatctctgtatgcgggcgttatagtatggagtgaggtctggcaggcact

SEQ ID NO: 61518 - DNA, 663 bp, Triticum aestivum
  Clone ID: PAT_TA_61518
ctgttgacggtgctgatgacacacaggacccacctctattcaagatacaccgcagagtgagatattaccatactagttacggtgatgcaacacctcatggtcgtacctagagtactcacgtgacccatgctaccatatgaactaatgaacagggatttgccatcatgacaactctggaggagctggaggacctataccgccgagacagagacgacaacattagagatggcagactacaacagccagaagaagcctaccggtggagacgccgacaggagagacgcctgacagaggaggacgaagatatccttgatgaggaggacctcaggcttgcacacaagacattgatactcgcaagcgactgatcgagaacgactctcgaatgatgaagagcgagctatctaggatatcgcatgagaaggctgacatgtggcgaacagatagaggaaaacttggacaagatcgccaacgatagacagctcccatacctcgatggaaacggtggtgagctgctcgatctcgatccaactgccgaatcgtcagaggagggcgccaacattgatttggacgcgacccgagttggacagtctgccgttattaagacatcgacccgccaaacactcttcctccccttgattgatcctcgtggacgccgacacgctg

SEQ ID NO: 61519 - DNA, 660 bp, Triticum aestivum
  unsure (1)..(660): unsure at all n locations
  Clone ID: PAT_TA_61519
cttccctttctcccgggcagagtaaaaggaaaaggcaaaaaggcgaaggggaatccgcgcgcaccggatccgcggcagccagcaccggcatcctcgccgtcgcgtcatcccgtcgatcggcatggcggacggggactcggcggcggcctacgcgtcgccgcggtcgccgctgcccccggagacgccatccacgcagaagcggcggcagcggggcctcgtctcgcgggtctggaagggcatcttcggccgccggnaggacgtcgagaagctgctccaggcgctctccaaggaggaggaggccctccgctcccgcgtccaccgccgcgcccgcgcctcccgcgcctccgcccacaacgtcctcgccctcgcatccgccctcgagatcgcggctgttggatatgcgattatgactaccagatccccagacatcccctggcagatgagggcagcccgtgtgctgcccatgtttttggttcctgctttagctgctctcatctactcagctattacaagcattgcgaaattccttgataatagagatcaacatactcttgaaaagcttcgtgctgaaaggcaggccaagattgatgagctgaaagagaagacaaattactacactacccagcaacttatacagagatatgatcttgaccctgctgc

SEQ ID NO: 61520 - DNA, 757 bp, Triticum aestivum
  unsure (1)..(757): unsure at all n locations
  Clone ID: PAT_TA_61520
tatcattcctcacaacaaccagttacgaggtcatctcccatctcaaatttgacaattaaaaagacgcaactcactaaaccaacttcttggccactagaaattccatctcagagacaaactaggcacccaggcctacagttactgcaacttctacccagcgcattcgctagctacgcaaacatgcttctcatcggtctcacaggctcgattgccacgggcaaatcgacagtctcatcaatgctatcctcacagccatatgacctgccaatcatagacgcagacattctggcccgcaaggtcgtggaacctggaactcgtggctatcaagccattgtgaaacactttggacctacaacgccagagctacttgtggagccctcagataaaatgccagaagatggacccgatggaaagggcagacctctcaacaggccagctctaggacgancgtgtgtttggcgatagcgaggaaaggaagaaggaccgttcagtactcaaccatattgtacacccagccgtacggtgggnaaatgttcaaatctgtagtcggatacttacttccgtggccactggggcagttgtgctcgatataccactgctctttgaaagtggcctcgacaactttgtgggtgtcnccgggcttgctgtttgccgtccgcgacccagncatccagatgcagcgcctgcgaggncgggatcctcacctcagcgcagaagatgcagagaacagagtgcgcagccagaccgatgtgcggga

SEQ ID NO: 61521 - DNA, 527 bp, Triticum aestivum
  Clone ID: PAT_TA_61521
cggacgcgtgggctagttctagatcgcgagcggctgccctttttttttttttttttttctctagaaagcacgacatacatttttctccgaatagttcaaacataacagacactacatcacaaactcagtaacatatgtttgaaacacacaacttagtatttctcccaaaacgagagagaagttattacactcagccgtccaaccatatgtgaacacatcatgcatcaccggatccaacaattctcattttgagatcataagctttggcaaacaattcctctctgttgtccttgaaaagaagataccgtgagctgaaccaaaccgtgtatccgaggcccaccatctccagtattcttgggagcaaggggatggagtcaattgctgaaacaacagcggacaaaacccatccggcaaagaaagcaccggtgccatatatgacatatgtggccatctccttcaagcccaacttgttggcagccacctcgtctcgggcgatgtccaccgccaccaagttgtgcccgaacggc

SEQ ID NO: 61522 - DNA, 662 bp, Triticum aestivum
  unsure (1)..(662): unsure at all n locations
  Clone ID: PAT_TA_61522
ataaaagaaggatgtccagagccattgttatcttgtacctaccaattaaattggtccagatgcctcctttgttataatgaattgtcttccgaccaactgatttacactatggtatctttttttaaattggtgactcactaactaagcaaacccaagaaaataaaacttgccaagcctcaaagccaagtttttcttctttgatttacctacaaaacgagctaatgcaatgttgctgctaggtgctaaaggccacatattgggcaggagctttcgtatggcatgcaagtgctagaggctacatattgctggaaggtgctcacttcaccttaggacaactcactccaagaagaattaaaacagagaccaggcaaacagcggcaacgccggataggctgctctcgcaccagactcccttncagggtagttgcccacgggcacgcacttctggtcgtttattcttacttgtgattctgctttgttgtgacgggctcgatccatgttgcggcccattattatttttttgtttaaaatgtgaaggaaccgtctttgctttgcttttggcacacctgattccacttcttttggttgttgcttggaccagtttactatgtactggacatattataacaatggttgggaatctgatataatctttctatgtt

SEQ ID NO: 61523 - DNA, 278 bp, Triticum aestivum
  unsure (1)..(278): unsure at all n locations
  Clone ID: PAT_TA_61523
gtgggggtcgttggactgtcatgttgggggggagagtactgagcgaatcaataatatgtttttacttggataataatcttgaggctgatacgatacgccgcttttttattggtttttatgaaagtcaatgaagactttttggttgtatgacttgcaaattaaagatttctcttaatttctttggagggggggggtggcatgnatgaactgtatctgtttggaacttatttgcttggagtggggctggtatttttgtcgtccttgtgcgtggagttagt

SEQ ID NO: 61524 - DNA, 133 bp, Triticum aestivum
  Clone ID: PAT_TA_61524
gaagtagtacttactaatagaaaaaccaaaacctgtgatgctcttgtgcctttttcgtcttttccctcactgctcgtagcggtttaatttgtagcttgagagcaatgtcaataaagattctcggggtaggaag

SEQ ID NO: 61525 - DNA, 498 bp, Triticum aestivum
  unsure (1)..(498): unsure at all n locations
  Clone ID: PAT_TA_61525
cccacgcgtccgccccacttcctcctcctcctcctcccacgagaggagagatccttggtctgctgcccgccgagccgagcgtgggaggccgcgaagatgctcgacatccagaagcggcgcgtccagcttctgctcttcgtcgccggcgtgctcgccctcagcatgacagctgagaagtgcagggaacttgtcggaaaggaggctgcatcaaagagtgggcagttcacattcatgaactgtttcgatatggggtcgggcagccttgcatgcgcagggaaggagggggtgaagctgtatgtgaacaacctgcgaagcgcacacatagaaaccgtgcggcagcgagcccttgagaaagcgttggctgatgctttgacagaaggcttgagtcctgctgaggcagccaagcaagctcagaagatcggggcaaaagcgacgaaggtggccgcttgtcnagcgacgaggatattggggccgcttctttcccgtggctgggactcc

SEQ ID NO: 61526 - DNA, 483 bp, Triticum aestivum
  Clone ID: PAT_TA_61526
cggacgcgtgggcggacgcgtgggcggacgcgtggggtcaagaacatcgaggtcgaccgcttgaggctgtccttcacgacggcgaaaaactctacgctggtccccgttgattccggttctgatgaagagagtgacgaagatcaaggctgttcggacatcgacgacactgtaaacagtataggtggacaaatgaccgtcgataagcctatggacgaagggttagatcgcatctgtagtggtctgcatgctattcccaggaaaaataaagcaagatcggccaagaaaagatcccataagctcagctctaggaagttctacaaaatattcagctgaggggcctttttattggagtgtataagggatctcgaggactggctgaattccgatagcctcctctttggtcaaagtgtacaatttggatttctttgctgattctccatactttggaaaatttgtacgcgtccatgtataacttctgatctt

SEQ ID NO: 61527 - DNA, 629 bp, Triticum aestivum
  Clone ID: PAT_TA_61527
cccacgcgtccgcccacgcgtccggtcggatctctcgtcgtcgtcgtcttcctcgccggcgttgagcgtgtggtcgaaccccatcggttggctcgtgcatgtgctgctacggaagctggacgcgaaggccgggagctaccgggaaccggcgctgagctacttgttcctggcgaacaacacgcactacgtggccaagaaggtgggcggcggcacgaagctggagcggatcctcggggaggagtgggcggaggcgcaaatggccaaagcgcgcgggtacgttgacgtgtacgtgcgcgcggcgtgggggagcaaggtgcttctcggcggcgcggtggaagaggcggtggtgcaaatggtggcgatgcaagagaagtgggtggcggcagacgacgagatgggggaggcgctgagagcggcggccaaggaggccgtggtgcccatgtacaggctcttctaccggcggcagggcgctgtggccagactgacgccgggggaacgtgatcaccatgatagacgggctgttcggcgggcggaatgcgggagcaggtgacgagagcgtcgccgcagctggtcgccggcggtcgtcacagcagcagcagcagcagcaagaggttccggtcgaaatcaaa

SEQ ID NO: 61528 - DNA, 657 bp, Triticum aestivum
  unsure (1)..(657): unsure at all n locations
  Clone ID: PAT_TA_61528
atagtgcttccaactactactgatgtacatgtcacagtttgaaggattaatatcacagtcatcactagagcgaagaactgcatccaagtattttatattcttgttcttcaatgtatttttggggagcatcgttacaggatctgctttggagcagcttgatacctaccttcatgcgtcagctaatgacataccaaggatcattggtgtagccataccaatgaaggcaacatttttcataacatacgtaatggttgatggttgggctggtgtatctcttgaaatattgagaataagggcatttgtgctataccacctgaaaaactttttcttggtcaagacggagaaggacagagaagaggcaatggatccgggcagcatctgtttttactggtctgagcctcgaatacagctatatttcttgcttggtcttgtgtatgctgcagtgacaccgctcttgctaccttttatactggtattctttgcgctgggataccgttgtctaccgccaccagatcataaatgtctaccatcaacggtacgagagtggggccgcagntctggcccaacgtgcatctacgcataatcgtagccttgatcgcatcgcagctgcttctccttgggctcttgagccaaaaggtttgggaggaggcgacgcca

SEQ ID NO: 61529 - DNA, 223 bp, Triticum aestivum
  Clone ID: PAT_TA_61529
acgagaaaaactccatgtctgatcccagcgccagcagcacggcctcttcttctccgacttcttcatctacgtcgccccggctcaccaccggcgtcgtcaactttctggcccgtcgtgcggtgaccacgcagcagaaccaccacctaccagcagccgaagcattcccgctgcactcgccgggctcctccaccggctccgccgactccgcgccctggcaccaccg

SEQ ID NO: 61530 - DNA, 647 bp, Triticum aestivum
  Clone ID: PAT_TA_61530
gtctgcgcaaggacggcacaaggcggctcaccgtgacgcgacgtcctcgccggcggatcgtggacggatgggctgggcggcgacgttggtgttcgcactcgcggcgtgttggcgggggcgctcgcggtggcgttcgcggcgccgttgtggtgacgctcgtggctgtgttggtgggtgcgctcgcggtggcgttcgcggcgccgttgtggtgacgctcgtggctgtgttggtgggtgcgctcgcggtggcgttcgcggcgccgttgttggtgacgctcgtcgctgtgttggtggtgccgctcgcggcggctgctgcaacgagcaaatcgaaatggccactgagtatgcaaatggccctgactttcgtgggatttagcaggagatttgcgggcattttcgtagccctgttcttagagtgtgtacagaaggattggacgctgggagttggtttctaatttgttcgtcagagggttgtgaatctccttggatatttgaaatgggttgatgatgaatggaaaggaagatctaggactgttattcacaaagcctgcggaagaaatcatgaatttgaagaatgcattgctggagaaggacaagcgagttgaaggatagcaaggctaaagtcacaatgaggcagaatataaaaag

SEQ ID NO: 61531 - DNA, 692 bp, Triticum aestivum
  unsure (1)..(692): unsure at all n locations
  Clone ID: PAT_TA_61531
cgaacgtctaatcgcctcacccacacagaaaaggcaaaaggaaacaaaaacctcctagaacttccggggagttgccccagagatttccggcggaacctcgcttcaggatggcacccacggcgacggcgacggcgacggcggcggagcagagccagcagcacaccaagaaggcggtcggtctggcggcgctcgacgcctccggccacctctccccgctcgccatcacccgaaggagcaccggagacgacgatgtcgtgataaagattctgtattgcgggatctgccactctgacctgcacagcatcaagaacgactggaagaacgccaagtaccccatgatccctgggcacgagatcgccggcgaggtcaccgaggccggcaagaatgtgaccaagttcaaggccggcgaccgcgtcggcgtcgggtgcatggtgaactcatgccagtcctgcgagagctgcgacaagggcttcgagaaccactgcccgggcatgatcttcacctacaactcggtcgaccgtgacggcaccctcacctacggcggctactccagtatggtgggntggtgcacgagcctttcgtggtccgggttccctgacgccatgccgctggacaagggcgcgcccctgctgtgcgccggcatcaccgtgtacagccccatgaagtatcacgggcttgaacgttcccgggat

SEQ ID NO: 61532 - DNA, 340 bp, Triticum aestivum
  Clone ID: PAT_TA_61532
gccacgcccacctcactgagatatgggcggtgggtgtcgctcctacacgagaaatttttggtgtgtgacttgtacgagccaaagctgtgggtgttcagaatcacgcaatcaggtgaagagagcgactattggaacaaatgggatgcacttcgtgcattgatctattactttgattacatgcgggaaggccaagagacggacgcttggatgtgatcattcttggagtggcttattaagaaggtctatgaagtttgctaccgatcatgtgaatgcccttcaaacctcacttttgaagagaaatggtcagttcttctacatgatcctggtgacatctgtgttt

SEQ ID NO: 61533 - DNA, 501 bp, Triticum aestivum
  Clone ID: PAT_TA_61533
cggacgcgtgggcggacgcgtgggcggacgcgtgggctccaacctatagtactggacttgctgttacaaaactttggttggcctgttttcgattaaattcacttcactaaaatggacactcgaagacactgctcccgtggtggagtatacgagttttgtttcctgaaaattgcaattctgctacttgcaattctaccttctgttttacttttgtttttcttattgagaagtcattctgggtggatagccaagcacgaggaaatgctgctgtggatgatggtgcggtgccgctgtatgatcgagaatttacattgggttcaactcctatgggtgattcatcaaatgctgaaggcaagaaagataaggatgattctcgctgtttcaactgtggttcgtatagccatgctcttaaggattgcccaaagcctcgtgaccatgttgcaattagcaatgcccgcaagcagcacaacttgaaaaggaacctatctaatgttggtaatc

SEQ ID NO: 61534 - DNA, 513 bp, Triticum aestivum
  Clone ID: PAT_TA_61534
gaaaaaaggattggggcgccgtgacggcgttcgtgcgccggcccgaaatttcttgtgtcttgtgtctttttctacctctagccgagagtgagagaggactgcggttccaacagcgctcgatgctaggtgacagagggctcgggggagaagtggcaggaggtcctggatgacggggtgctcaccatggtcctgaagacgatgtagaggaggagaggcagctcaagagctgtggccgtggagctccgcggcagctgtcagacaggcgttgacgggaaggggctcggggtagcggagcttgacgctgatatgtcccgagagtcgtcggcggggtagcgaaggcgaggaaggtcgagcgaaagtctgaggcgtcgccgcgttgaggaatttgacgacgacgacctccgacgcaggcaaggaagtcgacttgcgggagtaggctacggtgctccgatccgattcgtcacgtgaggcaacgctgcggtgtacggcgaagcagttcggcacggtggtatg

SEQ ID NO: 61535 - DNA, 617 bp, Triticum aestivum
  unsure (1)..(617): unsure at all n locations
  Clone ID: PAT_TA_61535
ggcaaggccaccacactgagatatggtcgatgggtgttgatcctagcgagaaatttttggtgtctcacttggacgatccagagctgtgggtgtttagaatcaggcaatcagctgaagagagtgaagattggaacaaatgggatgcacttcgtcattgatctattactttgattagatgcgggaagggcaagaagacggaggcttggatgtgatcatttttggagtgggttattaagaagttctatgaagtttgctacagataatgtgaatgcccttcagacatcacttttgaagagaaatgttcagttcttctagatgatcctgctgacaattggtgtttcaactcggatggcgaaacctcaacttcagagtaaaattacacctgctgataattcacttgcagatttatatgttttagtttttaactgctctcgcggnttaaaatatatctaatacttctattgagtttttataatccactattgtacgatatgttntttgtggacaagtttatttttgngagcctaagaaatgcaaaggacaaggatgtgttaaacttttgcttgtcagttcctctccgttttaaaaaatactaataggaaagcatttctactcaa

SEQ ID NO: 61536 - DNA, 367 bp, Triticum aestivum
  Clone ID: PAT_TA_61536
acctggtgtaccagtacacgctgctcgtctacgggttcgggctggcgccggcgagggagatcacgctggtggacaaggtgaagcacggggagtacttcatggaggccgcctggccgctcggcgaggccatcgaggccgtcgcgcccaagaagcgcatccaacatgatccacccgtcaacgttgcatgatcgctagcttgtactatgatccaagcagcgccgcagctccatgctttagcttccgtacgtagtccttgtctcgcgtggagaataatgagtgaaggaaaccaccgcttatccgtagtgatgtttgttctccaggatttcaagtttactcatctatttataatgggaaaacttttggcagc

SEQ ID NO: 61537 - DNA, 213 bp, Triticum aestivum
  unsure (1)..(213): unsure at all n locations
  Clone ID: PAT_TA_61537
cccaagcctgcgctcacgccgccgggagcacccgaggcggagctacggcgaagcactcctggagcgccgggacgaggnnnggcccgcgatcgacccggcccgccccgcagaccgagagcccattgctcgccctcgccttattgccgatggccgcggagctgtcggtggcgagggagtggagcgctactgcgggtgttagcggggaactcttgg

SEQ ID NO: 61538 - DNA, 188 bp, Triticum aestivum
  Clone ID: PAT_TA_61538
cagagttctttgagaacttgggggagaatcgagtactctcctcaacattgagaaatatcttagtatgtactacatcattcacagaatctgaggagaataggctgaatagcaggccttgatatgcagcccttctatctttttacaacagcaactgtaatctggatttcatccaacgaaaacaattagcc

SEQ ID NO: 61539 - DNA, 242 bp, Triticum aestivum
  unsure (1)..(242): unsure at all n locations
  Clone ID: PAT_TA_61539
ctccggtctgctcgtcgaccgcctcgcgctttctcatgtcagggagcggcggttgccgctcgtcctggccctggcggcggcggtggtaggagtactcacggatgcgtcaacacgagcggaagcagaactgaaagcaagttataaaaatgaaacgagccaaacaaagaaagaggaaaaaagaagagagaaaaaaaacagacaacaaaaaataataaaaatntnnaagaaaaaaaacaataact

SEQ ID NO: 61540 - DNA, 263 bp, Triticum aestivum
  Clone ID: PAT_TA_61540
gatggtatatggatggatgtgtggatgtgtgtgtacatattctaaacaactttattatgcctcagcgtttcctcactgttacatcgaacggaaaacaggaagcttaatcatcgtgtggatagactggcagttatccaaggtcaatccaaacgaactcggaatgtgtgctgggcatatatatggatagactgtagtccgtagggacagggactatagtaaggtagctactacatatctatcaggaaatattgcaactctttagc

SEQ ID NO: 61541 - DNA, 664 bp, Triticum aestivum
  unsure (1)..(664): unsure at all n locations
  Clone ID: PAT_TA_61541
gttaagtgtccttacctccttcctgtgttttctatgtgcggcgctgaggacggttctaatttacgatgctacatgatatatatatgtgagacactaaccagctagcaggtagtatacatacactcatgagctcacaaccctctttgccgagacatattgaggccaaataacaacatggacttaacaagtcttaccgcagtgtggtgggccgtggctcttcttttatcaccgtgttagtcaccaagatttcaagagcaagattcaccaccgttgatctacatcgtacaacaggtcaacttcctcccctggtgaatggagttgctctcctcaaactattacctacccttttcaacaagggtctaccggcaatgatgaatgatctatatgtcaaatatggcagtgtattcatgggttactttgcaaaatggggagatgaaggcatagttgatctaaagcttgagttcgagaagttactcatgttgatctcaagcaggtgtttgctcggaaaagaggttcgggagaacatgttcgatgaagtctacacactatttcacgagattgaagacaatggtgtgactttgatcagcttcttgttccatatctncatctccagcaaaccggcagcgagatagagcgcgcataaagctaacacaaatcctttctg

SEQ ID NO: 61542 - DNA, 602 bp, Triticum aestivum
  Clone ID: PAT_TA_61542
ggcctgtgatatcttgtggttgttggcgggctcccatctagcaccatctgctggtctacaaagagtcaggaggcgcatgtgaatgtttaatcaaccccatgagcagagcagatttgttattcagaacatagtgctgtcaaacatatcactatgacaattgggacggaaggagacctgattattgcttagggcttcatctttggcaaatgctatcttatggatgtacccgctttcacatttgtgttcagactacaaacaaaggccacacagtagttgttgttgctgattgtttttcttcttccgcaaaagatgttgtttaagatttaataatgtcggagttgagagagatatgagaacaactatcaggtcaaagtaagcaccacttgctatgcaagcgatgtacggcggtggcgatcgccactgagcgtgcacggtgcaaaagaagggggagcggctgtcggattttgttgaagcgaaaaattggtttttgatgcattcaaaaatcaataatcatcagcgggcacgaaatttacaagaccgaccagtggatggggactatctccatacttgatctttctatttgacactgcataacatattat

SEQ ID NO: 61543 - DNA, 518 bp, Triticum aestivum
  unsure (1)..(518): unsure at all n locations
  Clone ID: PAT_TA_61543
ccacgcgtccggaaaacaaaaaatggcgactttcgcagctccggtatcctccatggatgcagctgcagccctttgccttgtgcttattctatccaccacgactacctctcttgtctatgcacaagaaaccacaacggtgggtgcatcacagatgagaggggtgcactgctgtctttcagagctggcatcagaagcgatccacagaacctattttcctcttggaatggccaagattgctgcncagtggagtggtgtcaggtgcagcaacaggacaggccatgtcgtcaagcttgacgtccgcaacgatctcttctttgacgatatctatcgtaactggtacagtgaaaattctcatgggatgcgtgggaacataagttcttccttagttgctttgcatcatttggagtatctagatctgagtggaaactatctcggtggagtggatgtgcccatacccagattcttgggctccctccaaagcttgagatatctcaacctatcctgcatggattttcatg

SEQ ID NO: 61544 - DNA, 325 bp, Triticum aestivum
  unsure (1)..(325): unsure at all n locations
  Clone ID: PAT_TA_61544
accanaaaaatccatgtctgatcccagcgccagcagcacgggctcttcttctccgactgcctgatctacgtcgccccggctgaccaccggcgtcgacaactttctggcccgtcgtgcggggaccacgcaagagaaccaccccctaccagcagccgaagcattcccgttgcactcggcgggctactccaccggctacggcgactccgcgccctggcaccagcgggccccggccacgccggcacctgatcttccgttcgacaccatggacgccgacgagatgctcctggtagacatgctctcccagcaccacgaggtccaagacgcc

SEQ ID NO: 61545 - DNA, 274 bp, Triticum aestivum
  Clone ID: PAT_TA_61545
cggacgcgtgggcgacgccggccggtggccgctatcatgacctctgcaggagaggccatggccggggagcggtcgcgccgtccctttttctctcgaccaaatcgctatcgacagaacaaatgatcgaactatctctttgcattagatgaagtgctatatatagcactggaacatgcgtttacaaagggggtgtcggttcagacataaccgacccaacggttggaaaagtaaccgccaaaggttaatacaagcagggattaatcccttaattact

SEQ ID NO: 61546 - DNA, 280 bp, Triticum aestivum
  Clone ID: PAT_TA_61546
agacgcgaagagcattaagtgaaggtatgatgcggtatagttagctgcgatcagatagaagaatctctatattaaaaaattttagactacctaattaataaaaaaaaaactgtaagcaacatgaagacttacttagaacaatatcaacccttgcactaaggggaggagctttatctattgcccaccctaacatgcgggacgtgacgaaaggataacttctacttatggcaccgaaaggctattacacgggcgatggttcatcaacgcgggcgtgggaaca

SEQ ID NO: 61547 - DNA, 768 bp, Triticum aestivum
  Clone ID: PAT_TA_61547
aattccccttctctcgctccccccgtcccgtgatggcagcaccggcgcccggcgccggcgccgtcgaggtttccatgggtttcacttcacggattggcgttcgtgtcacgcaggacgccaaggcgaaggcgttggtggccgcgaagatcaaggaaggggaggacaaggtgcggatgataggacagtacgcggtgcggacggaccgcgcgatcgacgcgctggagaaaaaggtgcaggacctcgaggcggtgatggatctcgagctgatgctcggccagtactgcgccgacctctcggacatgcacaaggcgcgccactactaccgtgccgtctcgctctcggagaaagaggagctgtccctccgccaaatcgacgacttcgccgccgccaccatcgccgagtatgaggccagcgtcggccccgtcccggccttcgacaaccacctcagcctgttcagcaaagacatcccactggagttccccgaacccttagctccccctcccgcttcttcggctccggcttcggcttctcaccacgagtgagttctcgctccttgcacctgcattcatggtcactatgcgattgcaaactaattagtctacgaccatttcagaatttcagagtagtatgcctagaacaggcctgtatgtttgcccggttttaactcacaagatgaagtaatgatgtatgcataatttgcagattttatctccttggaacttttttatgtatccgattgtagtaatcaatttacgggtttagattttg

SEQ ID NO: 61548 - DNA, 246 bp, Triticum aestivum
  Clone ID: PAT_TA_61548
cctcgctcccacccttcatgccgcgcgacctcgccgccgcgagatccccgcggccgttgcgctcctgcgcactcgccgctcccccgtggtcgccgtgccgctcgccccgtccggtctccgccaccaccgccgcagcgtcgccatggccgccggcgccgcgccctcaaccattcccggctgcgattcgcttcccaagggttctgatctatttttccggacaattctcttaaacatgcaaaaagatta

SEQ ID NO: 61549 - DNA, 495 bp, Triticum aestivum
  unsure (1)..(495): unsure at all n locations
  Clone ID: PAT_TA_61549
cgcagtgcgagctcgccaggacgcgggcgcagctcgccatcgtccccgcgcacggtgcgcagctgcagggttccacggctgctcttccgccacagcgagacgacggccaccgcgtccccgtcacgcagatgcaaggccaagggcagggagaggcagacgacggccaccgcgtcgccgtcacgcagatgcaggggaaggaagagggggtgccgttgcttgacccggacgacggccagcgcgtncccgtcgcgcagatgcaggggcaggggggagaggcggtgacgctgcttgacccggacgcgttccggaactcgacgggctctgagctctgaccgatcaagcgcgtacgtacgtgcatccacgctggggggaaatgccacggcgatcgatggcggcattgggctttttaccagtgagaagtgataattgatgaaccttttatttgaaaggcgtgtgcatgtattggtgggattgaataaatgtacagacatcttg

SEQ ID NO: 61550 - DNA, 331 bp, Triticum aestivum
  Clone ID: PAT_TA_61550
ccccgcgtccggttcttgaggctctagatgaggcaaataaacttattgaagaagggaggcggttcaagaaatttggattcaagccccttcccagattgttgatccattgcctcagatcaagacgtttggtttggagaccatgctgagtcagctctatgatctgtttgagaagggcgactcgaacataattggtgtgtggggtaaggaggtgttggcaagacgacgcttctacatgttttcaacaatgatcttgaaaagaaggcccatgattatcaggttgttatctttattgaagtatccacttcatgaggggtctgacacagtggagata

SEQ ID NO: 61551 - DNA, 268 bp, Triticum aestivum
  unsure (1)..(268): unsure at all n locations
  Clone ID: PAT_TA_61551
caaaagccgcaggctaggccgaggcgagcacctgcgccggagctgcggtgacgccgatctggccggacgtgctggggctggcgctgcctttggcgagcccgatgtcgtagttggcggtgaggtcggcctggtacagcccgaacgaccgctccgacactggcccgggcttgaggtcctcgtcgtagagcgcgaagaggtacgtgtccaccgacctgccaggcgtccgcggtgtgcccacctgcgacctgaggtgcgccncgaggttgcc

SEQ ID NO: 61552 - DNA, 526 bp, Triticum aestivum
  Clone ID: PAT_TA_61552
ccaggtcataaacccaagtcggactcgccttcctcctcgccactactcctctcctctcctccgcgcatcgcaccggggtcaacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgatctttgcaagggtggacatgagctgagcaagacactggaaacgctggtgcacgtg

SEQ ID NO: 61553 - DNA, 515 bp, Triticum aestivum
  unsure (1)..(515): unsure at all n locations
  Clone ID: PAT_TA_61553
gttggaggccacactgcaataccaatctagccagcagaaagcactttcccctttgccttctccaagagcatctgcacaagatgattcattccaggagtctcagtccagaagaataaacttacttggaccgttttcactgagctggcgggataagaacaagggaaagcagaacaatgctagtgactgcacagatgccaagcttacagacgctcatgagcaaagggaagaagcacccagcatagatgatgagaaacatggagaaacacaaaaaccggatggggaatggacagtagaatcacccagaggaaatgacaagggcggagtcgcccaagaaagacagaattcctattatcaccaatgatatgaatgggcggcatggaccggtgcaagaaatacaattggattgataggtaccagctcatcctttacaggacatggtcaccactgcggtnggaaggtcttgctgaggcaacactggatggcttcaaggtttgacaacaatggattctttatct

SEQ ID NO: 61554 - DNA, 483 bp, Triticum aestivum
  unsure (1)..(483): unsure at all n locations
  Clone ID: PAT_TA_61554
ctttttcccgccaaatgtcacacttgcagaaatagcttcatcagagttttctgtttcatatgtcatagtatgcttgcttacgacaaccagaaaacatgagggacaaagcctaaaaaccatgatcaaattaaaattcaaggagaatcttcgactaaagaagaagtgcatttgaaaacttctcaaaatatccttactgatattacatacagaatacatcagaattgcagaaggcagtatcatcgatgaggatgaacaagtcaaaatcggcgatatcaccggttcggcacatctttttaaattcatccacctttcagttcacctgctataatgtgtgaatatactgtcatcactgctacttagtcaccaccagcgcagcccctgcatccacagtgagcacactctatgacctgntctttcctcagatgcttaagactacagacacatgtggttgcaatggtgtgatgtcgtgtcaagatgcagtgc

SEQ ID NO: 61555 - DNA, 311 bp, Triticum aestivum
  Clone ID: PAT_TA_61555
ccgggcatggattcaagctttgataatctgtcccgggctgaagtccaggcttcgcattgggctttgtggcaagcttccgatgctgtgaaccagcatctcacaaaatggcttgacggtgttttgggtggtgctttggaggccaaggcatctctgtaggcaaaatttattggatatatatgctggcttatacatgaatatcaaaaaaagaaattaccatttgttgtcttatattaagcttacccaggaagttttgagtggctgcaggttcgcctatatgaaccatgcatgaagaacaagtctattcatgtttc

SEQ ID NO: 61556 - DNA, 667 bp, Triticum aestivum
  unsure (1)..(667): unsure at all n locations
  Clone ID: PAT_TA_61556
cagggtatggggcaaacacacaattcgttaacttcccaatacaccttttcataatggcgctcctgctgtcagatctttgtgcctcatgtctgcctacctaaacccagtacctggtttttctagcttcacaaaccttagaaagctcatgctcgactcggtgtctggagatatccagtgcatgttgttgccagcgtgctccatgcttgagtggcttagcatcgtgcgttgcaccctccacagcttgactacttcccaaccgttgcgccagttgcgatacctgtgtgtgcactactgcttcaatgtgcagaagcttgaggtgcaagctccgaaccttaataccttcatatttggcagcttggagacccacccagtgtcatttatcattgatggatgtctagagatacaggaggtgactatcaagttngccaatatggaggagtgacctttttgactacgccttcgcgaatcatggtatggcgaatgtgcccaagctctctgtggaacttgcaattgattccaaggtgcctgggatgtgcanaatgccctagtaagntttgtcaacctgaagcatcttatattgaccgntcgatgtacttgcanatgataagtatacaagtggcattcttcgnttggctggtcttttggaattaagcccagttttgaatcg

SEQ ID NO: 61557 - DNA, 622 bp, Triticum aestivum
  unsure (1)..(622): unsure at all n locations
  Clone ID: PAT_TA_61557
gttctagatcgcgagcctagaacactaacaaaatcacggcgagacacataatcaagggaggagcatactgaatttttttctctttttgttctcttttcggacgcgtgggcggacgcgtgggcggacgcgtgggcggacgcgtgggtaattacaggtacaagaaatggcatcatttatttgtggagctccaccgatttcaggtaatctcgagagtgttgctcttgtgaaaaatgggcacagngattgcggtgccaccattcttgttcatattcattttttaagggaaagccaatatattttgcctaaacccactctganttatctctgttgttgtncgatttcgctaaaactgactaaactaggtgtcntgatcttgtctatacatatagtgctataacccgaaacacaagctgaaccgagacctagccccgaacccttaccaccatgttgctagagggatggggtatctgaagttggtcatcatacatactccccttctgtcccataatgtaaagacgtttntttgacacttagtgtagtgctaaaaaacgtctaacattatgggacggagggagtacttaccaaggaccttaaatttccaggcttaggggaattctcaaca

SEQ ID NO: 61558 - DNA, 602 bp, Triticum aestivum
  Clone ID: PAT_TA_61558
ggaagctcttcgatctaaaaatggcttcagagggtacttccagcattttgaaatattccacaggatatatgaagacaagcctatcctagccaatcgattctccgtaataatttacacttgctttcatgactatcttcacttgtggccttccgcatcgttcaacatttaattttgatctctgatgcttgcacgagatgcaaaattctaggagcacagcatggatttcaaattgcttttcagatggtaagtaagtgcagatcccacactttgcttttcataataatctctctgacaatgtgttattctttgttgcgtgcaaagcatgggaccgtgtccatgacatcatatgtcacagggcaacaaacagcacaagacatcttatgagtggacattcgtgatggcgtcttaagagaactagcgatgtctgtgttacctgcttccctctgcgatgatcccatccagcaggcaggcgggactagcatggaccgggcgagtggcagcggcgaccgggaaggtggggtgatcaacttcagtgagctaggatacaattagatagccacagcccacagggacaaatttagtcctttcacgagcctacttat

SEQ ID NO: 61559 - DNA, 150 bp, Triticum aestivum
  Clone ID: PAT_TA_61559
cagcacgcaacgtggtcgagactcaacctagaacgagaaacctagaaaaaaaaaatcctgtcgatctagctttgcggcgcggcagcaaaccagccagcactcatggcggtggaggggataaccgagggcgtgaggggcctcaaggtggag

SEQ ID NO: 61560 - DNA, 491 bp, Triticum aestivum
  unsure (1)..(491): unsure at all n locations
  Clone ID: PAT_TA_61560
gggaacagcaacaacagcaacaacaacaacgacaaaccctgaagccacctggccatgaccacatgtccctctggcggtcagacatttttgcagggacgcgtcatgcaggtcattgcaaaagatacagatttgttcgagatcttattctgagtttttcggacaactaccagcgttgcatcgatatccaggtttcttgtgtctgtgtagagacccttgtttgtgcctgcagagccaagcatttaattttccgatgggtcaaggcgctaaagaaccactcgaacccacccacgttgttgtcgagacgagattcccatgggttttggtcttttggtgcagggttgtgaacgaatctgtcgatgcaataattccacttgcgacacttgatataaaccctaaaagagtcgcttgcccgcctttcttttctttttttttgnctttcttttcattcgtaatcggatcccggaaaggcaattcaagagcattctcgtttt

SEQ ID NO: 61561 - DNA, 593 bp, Triticum aestivum
  Clone ID: PAT_TA_61561
gtcagcaacttctcggccgccaagatggagcggctgctggcgctggccgcggtgccgccggccgtgaaccaggtggagctgaacgtggggtggaggcaggagaaggtgcgggaggtgtgcgcgaggcacggcgtggtcgtctccgcctactcgccgctgggcgcgtacggcgcctcctggggctcggacgccgtcatgcacagcggcgtcatgcaccacgtcgccgccgccaaagccaagaccgtggcccaggtggcgttgaggtgggtgtacgagcagggcgtgtgctttgtggccaggagcttcaacaaggagaggctcaagcaaaacatggacatctttgttgattgggagctgagcgatgaggacaaggccatgatcgccacgataccgcagaaaagggcgtgccagggggactactttgtgtcgcccgacggaccttacaaatcactcgaggagctgtgggacggcgagatgtgaatgtacccaaatatttctagtacaagttctatcaacaacaagtattgcctcgctcgtccatgccgggggcggggggaccttacaaatcactcgaggagctgggggatgttgag

SEQ ID NO: 61562 - DNA, 628 bp, Triticum aestivum
  Clone ID: PAT_TA_61562
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataattaaaaaaaaaaaaaaaaaaagggggggcccctttttaaggaacccctttttcttcccccccctttgccgcttttttttttttttttttttccccttatttttttttttgggccgggtttttaccccttggggtttggaaaacccctggtttcccccattttaatccctttggaccaattccccttttttcccttgggggaataaaaaaaaggcccccccccggtcccctttcccaaaagttgcccccccttgggggggtttgggccccccctttttggggcttttttaccggggggggggggggggttcccccctggggtcccttttttttttccggggcccttttcccccgtttttttatttttttcccttttttttttccccagtttggggtttttccccgggggttttttaatggggggcccctttttggggtcccatttaggggttttggggcccttgcccccaaaaattttttttggggggg

SEQ ID NO: 61563 - DNA, 688 bp, Triticum aestivum
  unsure (1)..(688): unsure at all n locations
  Clone ID: PAT_TA_61563
tgggcaccagccgtccgggaccgagaccgagaccgcgccctgccccgccgtgtccgctgccgcgccgccgccatgccgccgtccgtccgcacggtctccatccccttcgccgacctcaaggagcggggcagggacctgagcggcaagatcgaggaggggctcggccccgacgggctcggcatcatctccatttccggcgtgccggatttcccagctctaaggagaacgctcctgcacttggcgccgaaagttgcaaaccttcctgaagatgtgaagaaaggacttgaggacccggacagcaggtataatttcggctggagccatgggaaagagaaacttgaatctgggaaactcgacacattcaaaggctcctactatgccaacccaattttggatgtccctactgctgatgatgtccttgtaagtaggtatccatcgtactgccgaccaaatatctggccagctgatcatctgcctgagcttgaaatagcatttaaagctcttggaaagctaatgtttggaagttggctttgatgttggctcgtcatttgtgatctctacggaatgagacgcttaactttccaagtgaaattccttaccccaagagttgattccaccaaacggagcgcttacgtttggnagagtactcagagagactggtgaacaagtattaccaagaaagacgtga

SEQ ID NO: 61564 - DNA, 682 bp, Triticum aestivum
  Clone ID: PAT_TA_61564
aacatggctcgtggccttctcaccatctgcgtcagcgcccttttggccgtcgccggcgcagtcacgcccgccgacacggtcttttacaatggaaacatctacaccatgaacccttccaacgacatggtcaccgccatggccgtgcgcggaggcaagatcgagtatgctggagacaagaagaccgtgcactcgtacattggaaagaagacaaaggttattgacctcgagggccgcatggtcatgcccggactggtggattctcacatgcatctcatttcgggaggtctcttccttctaaagtgcgatttgagttatcaaactttgacgattgcacaagtcctggagcacatccagggctgtatcgatggcgaaaccggcaagggtgatgatgattggattgaggtcgtcaacatggactacgcgggtcttgtgtcgaagagcggaaacgttggaaaggcgcagctcgacaagctcagcacaaagcgacctgtcattatccgctcaagcgattaccacactatcctcgccaactcccgcgcgcttgaactctccaggattgatgctagcaccaaggatcccgcagaggcaagattgtccgtcttcggggaagtcaagagcctgctggtcccctccaagatggcgcttctagccttcttgctggcccccctctccactgatgctg

SEQ ID NO: 61565 - DNA, 618 bp, Triticum aestivum
  unsure (1)..(618): unsure at all n locations
  Clone ID: PAT_TA_61565
cccacgcgtccgcccacgcgtccgtgatctgcgcatcccgaacggcacctacgcgctcaccgcgcaggactgcatccagtgccactgcagttcaaacaccttccagctaaactgcaccgccctgcaaggcaagaaggggtgcccggcagtgccggtgtgcagcggagggctcaagcttggggacacaagcggcaccggttgcgaatccaagatgtgcgcttacagtggttattccaacagctcttcactcagcatacagaccactcctctcaaaaaccagacagcaccagcatgcgagaaaggaggatcttcgaggtcggtgttcgcggggtccatgtggaggatatctgccatctccttccacatggtgttgatattggtatgcttcctttgataccgaagatgccaactctagctggtatatatatcttgaaaaaaggactcacgatagtacatcaatttgtcgatcgatgtgattgttgttgtaacttgaaattccgatgaccnggtttgttgagctttttgtttttgactattcttctagagaatgagtggcgctagctgcgtgaataaagcaatcatatgtgtaaggtttgcatctggaagtgaattgtactc

SEQ ID NO: 61566 - DNA, 748 bp, Triticum aestivum
  unsure (1)..(748): unsure at all n locations
  Clone ID: PAT_TA_61566
gcccccgccaagaccgtcctcgtcgacaacaccagctctcaagatgtcgctgagctgtaccctcttgctctgagccgaggcatcagtatcgttacacccaacaagaaggccttctcaggatcatacaagctgtggcaagacatcttctcagctgccgagtcatcgggcgcccgtgtctaccacgagtcatccgtcggtgctggtcttcccgtcatctccaccttgaaggatctcgttgagactggcgacaaggttactaagatcgagggtgttttcagcggcaccatgtctttcctcttcaactcctttgctcctactgagggccagggaggtaagtggtctgaggaggtcaagaaggccaagtctctgggttacaccgagcctgatccccgagatgacctcaacggntctcgacgttgcccgtaagctgaccattcttgctcgtctggctggcatccccgttgagtctcccacctctttccccgtgcagagccttatccccaaggagctcgagtctgtttccagcggcgacgaattccttgagaagctccctgcctttgactcgcaaatggaggagaccaaggctgctgctgagaagccggcaaggttgtccgattcgttggagcatcgatgctgcctccaagcagtcaaggttggcctanagcaantttgatcgctcgcaccccattgctgctctggaagggtagcgataacattatcagcttctataccgagagatacggaagca

SEQ ID NO: 61567 - DNA, 720 bp, Triticum aestivum
  Clone ID: PAT_TA_61567
cggacgcgtgggcaagaacctgcaatccaggataccagagacatgccgccgagggggaggaagcactggtgcaagcactgcaagaggagcttcccttccggggcctcactcggaggcccatggcggtccacaggagccggcgcaagaaacaaccgagcggcgccccgagcatcgccggcgagaggtacggcctccgggagaggtgccagaagacgtcgtggctgctggattccgcttccagtgacgacgatcggtgggcgttgttccccaagactgaatgccagttgtgcttcaggtcctttgcctcccctgatgccctgtcgatgcacatgaggatgcacaagcgccgcaggaagatggctgtggagcaccaggcatcggtaggcgatggtgaccacaatgttcctctctctgctgctccggtgatgaagaggaagaggtcgaggaggatggttatggacactgttccttccacggtgatgaagtcatatgggatggaggaggtcgatgccgcacggattcttgtgtcgctttcaggagataatggcatgtgctcagcttctgttgattgtggtgaaggtggtgtgatggacgtcaacgcggcattggcgttcgacacgctcatgacagagatgggggctgagttcttctgatcatcatggagatgacagagttggagataaatgagtgatggagccagagccttctagtagctctatg

SEQ ID NO: 61568 - DNA, 672 bp, Triticum aestivum
  unsure (1)..(672): unsure at all n locations
  Clone ID: PAT_TA_61568
cgaaggtttgtgatactgcatcctgcatacctgcatctttttttcatccaagcactgtccactgactttgagcacttgtcacactgaagttaacctctcttgcagcgttgcatcatttggcgaagtgcttctgaactgctgatattgaaattaggcctgagctcaagtatttcggacaaaggccttggttttcttagttcaaagtgtggaaagctcattgaacttgacctctatcggtaatttgatctccttgtttgttctttataggcttccagccatcttccatgcacaataataacttgcatattatctttctatcctaaagctgcagttctatcaccgatgatgggctggcagccttaaccaacggctgcaagaaaattaagctgctgaacctttgttactgcaacaagataactgatagtggtttgagccacctgggcgctctggaggagctcacaaaccttgaactgagatgcctggtccgcattacaggcatcggaatttcttcggttgtactggctgtaaaagcctggtagaacttgacttgaagcgctgctattctgtcgatgattctggcctatgggctcttgctcgatatgctctaaaccttagacagcttaccatatcatacntgccaagttactggccttaggcttgtgccacctgctt

SEQ ID NO: 61569 - DNA, 733 bp, Triticum aestivum
  Clone ID: PAT_TA_61569
gatttggtgaatactgctcgtcgttgggctttggatatctgtgagctcagaaagccatggatcaaaagcctttacaagaccgacaaactggaaccccttggtgaggctagggagattctcaagtttgcaagggctcaagctcgaaagcaggctgcaaatcttgaacacccacttgtttgtattgatgtcattgaagaaggtataatttcaggccctcgagctgggctctggaaggaagcaaacgcattccagagccttcttttctcggatacatgtaaaagcttacttcatgtattcttctctcagcgtgcaacatcaaaggttcctggtgctacagacttgggtttgatgcctaggaaaataactaaagtcgccattctaggtggtgggcttatgggttctggaattgctactgcaatgatactgagtaactatcctgtgctactgaaagaagtaaacgagaaatttctgaatgctggaattgacaggatcaaagccaatttgcagagccgtgtgaggaaaggaaaaatgacagaggagagatatgagaaggctttgtctcttgtcactggtgcccttggttatgaaaagttcaaagaagtggacttagttatcgaggcggttattgagaatgtgaagttgaagcagcaaatatttgcggacttgggagaagtactgcccttcccattgcatccttgctaccaacacatctccaattgatcttaatctaatt

SEQ ID NO: 61570 - DNA, 775 bp, Triticum aestivum
  unsure (1)..(775): unsure at all n locations
  Clone ID: PAT_TA_61570
aattgtgcaacacatacctattattgcagtaacggcttatgctcgaccggaacagattgagagtgcaaaggccgcaggaatcgacgatgtcatttccaagcctttccggattcctgagcttttgcccaagatcgaagagcttgttggcaaatacaagaatctttcagtgtccagctgatgctgaagacagcttgtcctgccgattgactcacctgataccctggccaaaatactcttggctttatgaacatgacgaatctttcgacctcgatggccatgttggtcttacctttcgatataatatcttgactaccatatacaacattttattcaattattcggctatgcgtggcatttgcttcatatccgcacggcgttttttaggaggaaagagaaccattgacggtttcggatggccagccatccaagtttatttaaatgtagaacatggcagcgattttctgtttgggctcttatgcgcgagtgatttttcccgcaaagagcagggcatacggtgataaaaaagaacattcagtagagagggaatatatgagcatttgtacgagcgcgatagaggtatacacaacgntaccggcgttgttgagggctgatgtgatgggtgctgtttttccgatatctttggacacagacagacatggnatcagttaaccacctgcctttgtgttgtcgagatggtcacaactatcgtgtacatatatcccagacagatcgatctgtcttttgancagcgtatagctacccagntgntacatag

SEQ ID NO: 61571 - DNA, 797 bp, Triticum aestivum
  unsure (1)..(797): unsure at all n locations
  Clone ID: PAT_TA_61571
aaggggctgaagctttttcagtgccccaaagacttggctcaggaacattacaaggatctgaaggagagacctttctttcccaatttaatcgactacataacttctggtcctgtagtctgcatggcctgggagggtgatggtgttgttgcgtcagctcgcaaactgatcggagctactaacccccttcaagctgagccagggaccataaggggtgatcttgcagttcaaacaggaaggaatgtcgtccacggaagtgacagccctgataacggcaagcgagaaatcggtaagttttgccaatggcggatctagcgggggtggcaccccctacaaaaatgcaaaataatatgtatactatatttaatattaattcggtaacaacttagagctatttcagactatttaggctaaattatactattttagcttaagttatttaaattttgtaccgacgtgtntgaagtttggcacccctagtacttagaatctcggtccttcagtgagttttgcagcaatttggtgcactgccggttgctattcagttgattcagcatttgtatggttacagntgtgaatgttagcttgaagggaagcttggttcgcagcaattgagtgcaccgctatttgcagcaattcttgacaataaaaaacttatngttcttgtcctatctgtaggattaatggntcaaagagggtgagcttgctcaatggnaatcagttcaaacaccctggctataagaagtgatctttgcatatcactgcaagaaccatgatccatacttatttggtcaacttga

SEQ ID NO: 61572 - DNA, 164 bp, Triticum aestivum
  Clone ID: PAT_TA_61572
cttctggttatcagcaaagctttcatgttggatggtgttttgatctgtgaacttttgtttggacatcagtggacatggttttgaaaattctttggttgacgtatgcacgaccttgagattttaacctgtctttccttattattaaaataaaaactgttttgctc

SEQ ID NO: 61573 - DNA, 367 bp, Triticum aestivum
  Clone ID: PAT_TA_61573
aaaatgccaaccgtgtattcatgttgttgtgtactcctcatgatgttatatggtgacgcggatttttcgaaccggtcggcaggcgttctacaaacaacttctgatgtgttaaggaaacagaaatacccagcatatgcggacactaaactttggttaatacacatagtaccatgtcaatatggcattgacatagcagagcagattctttattacagcacacattgtttcccattgatacccggtgcacaaatcgttgcaccacctagcaatcgtttgatcaactgtaattgtgtgtaaaatttgtaaatcagcaacattgttcatattggtgctatattgtgtgcagttattataaaaatgaatcatg

SEQ ID NO: 61574 - DNA, 765 bp, Triticum aestivum
  unsure (1)..(765): unsure at all n locations
  Clone ID: PAT_TA_61574
cgtgttcttgtttcgaggcttaatgatatgctctgcccggtggcctccaggatcagcctcgactcatgaagaacacccaaggaatcggagtggtcactgaagatcgtggactcgcatccgccattgctggaagtttgaacttcgagagggcagagggatcccgtatgagaagaccaccgatgtgatcatagatagcaggagggatgtacgactgttaggcccgaagagcatggtgacattgctcatcgttgacagtgagcggctcagccctcgtcatgcaaatagccaacaccatcatcatcagcgagtagctgctgtagtacctgcacctggtgaggttggtggtgcgctactacatgcctctacaacaagacacggtggcatgctaaatggagctttgagcagcagcacatcgtggggagaggacgaatgtggtggtctgggagcctcgggctccactacatctgccgctagaagcagcaacagaacgcgttgttcgactgtgccagccttggcagtgatctcgatgattgcatggagtggaagactttgcagtgtagcaaggttgctcaggagctgctgaagggaaacaaccctggatgtcacaggctgaaggaggaggtcttacacatcttcttggttcaggacttgagaaataaggtgaagaaaaaggaaaagacctgctaatctttcccttcccgttggnatgtcgtcgaatggttgatggcaggnggaactcactcgacgtatcngagctactgtata

SEQ ID NO: 61575 - DNA, 778 bp, Triticum aestivum
  unsure (1)..(778): unsure at all n locations
  Clone ID: PAT_TA_61575
gggaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattggttgatctctgcctagatcgtatcaggaagctttcagacaactgcactggtctgcagggattccttgtcttcaacgctgttggaggtggaactggctctggccttggttcgcttctcctgggagcgtctctctgttgacatggaaagaagtccaagcttggttcacagtttacccatctccccaggtctcacttctggtggtgagcctacaacagtggcctggtcaccactcactccttgaccnacccgatgtctctatcctttcttgacatgagccatctatgacatctgccgccgctcctttgacattgagcgcccacatacacca

SEQ ID NO: 61576 - DNA, 648 bp, Triticum aestivum
  unsure (1)..(648): unsure at all n locations
  Clone ID: PAT_TA_61576
cccacgcgtccgcccacgcgtccgcccacgcgtccgcccacgcgtccgccaatcagccctggactacctggagatgcagccggacctgtcagcattggtccgtggagcgcacactttccggtgccccaacctcggcctcaccagctgggtgcgcctgccgatccacgacgccgatttcggctgggggcggccggtgttcatgggccctggcggcatcgcgtacgaggggctggcgttcgtcctcccgagcgcgaccaaggacggcagcctctccatcgccatctcgttgcaggcggagcacatggagaagttcaggaagctgatccttgatgtgtagatagaccgcattttagagagaagttttacagggcaacaagcttcaggttgcgccgaacgtttttctggggtatatatgcctgaagtttcaaatgaacatacaccggagtttatatggtggacanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggatcaaagtttacgaccccgggcttgcaaggaaatagtttttttttaggg

SEQ ID NO: 61577 - DNA, 666 bp, Triticum aestivum
  unsure (1)..(666): unsure at all n locations
  Clone ID: PAT_TA_61577
cccacgcgtccgcccacgcgtccggaattctccatgatgttgctctttcctgagggcacaactacaaacggggattatctccttccattcaagacaggggcctttcttgcaagagcaccagttcaacctgtcattttaagatacccttacaagagattcagtccagcatgggactccatggatggggcacgccatgtatttctgctcctttgtcagtttgtgaatcatctagaggttgtgcatttgcctgtgtactatccttctgagcaagaaaaggatgatccgaagctctacgcagataatgtacggaaattaatggcagtggagggaaacttgattctttcagatcttgggttagcggagaagcgagtgtaccatgcagccctgaatggtaataatagtctgcctcgtgccttacacaagaaagatgattgaaatgtattaccattgggattagtatactgacagtctgagtgtctttgcttgtaacaataaataaaagtgnggtgtgttacatggcatccatcctcatgtttgagagggagcgttgtgaatattacccccgatgtttcactgtagaaaacaagcactaactgtttgtggtacagcgaatatgtgagcaataaatgtacacaacgggctttcatacacctcttcctaagttcc

SEQ ID NO: 61578 - DNA, 688 bp, Triticum aestivum
  unsure (1)..(688): unsure at all n locations
  Clone ID: PAT_TA_61578
cccacgcgtccgcaaaaaaagtcgacatgagaactcagacaatgaggctcaggtgcgacctcccggcacacaactctgtgcggtacacaagtcgaaaccaagtcaagatgaaaactccgacaacgaagctcatgtttgacctcccggcacacaactccgtgccggacaagtacatcatgccggcggagaaacgccctcgccgccacgagctagtggatgacggcctctcagttgctctccccgtcgtcgatcttaagaaaggccgtccacaagtcgcccgcgatatcttggaggccggcaaggagtttggcttcttccaggtggtgaaccacggtgtaggggaagacgtggtccagggcttcagggaagtggcagcggagttcttgaggttgccggaggaggccaagctggagtactactccgaggaccagagcaaggctttccgggtaatctccggctgtatcacttcccacaagctgatgaacgaatggccaacacagccagaaatatttaggggagcgtcttgccaactactcggtagcggtgcaggacntggcgtgggaagctcctcaggctcatcgccgaggagctcggcctggatgaccacaatttcttcaagggtgacctcaccggcggcgagacactngatgaatgtgcactactacccactgtgccctgacccgacctg

SEQ ID NO: 61579 - DNA, 743 bp, Triticum aestivum
  unsure (1)..(743): unsure at all n locations
  Clone ID: PAT_TA_61579
ctcccccaccctcgtcgtgctcgccgccagcccgggacagcgccgccccagctcgccgggaggacagcaagcaatggagccgggcctcctccccgtccccgtccccgcggcgcgcgtgtagggttcgcggctcctccttgctcctccggccctcccctgcaagaggtgtcttgatccgcgaggatggcgatgacggcctacagcaaccaggcgcaggcgatgatgagggactacctgctggccgacccgctcgtcccctacacctccgtgctcatcggcgtcttcctctgcaagatggcttacgatctcacacggatactgagctcattctacttcaagggctattcttctttgacaaaaatacagcgtgttgaatggaacaacaggnggtatgtccagtgcacatgcgatcttcatcgcagcagtatcagtatatcttgttgcatctacggatcttttctcagatcaacttaatgggcctattaattcccgcaatttcgatcatctccacctctgattaanggnnttttctgtgggttacttcatcactgatcttgcaatgatcttcttggnttgtttccttcccttggtggaatggaaatatgtactccatcatactctttctctggttgcaatagcttacacaatgttgtcaggggagggggcaagtttacacgtacatgattcttatttcagaacaaccacccctgaaatcaacatgagaatggttccttgacaccgct

SEQ ID NO: 61580 - DNA, 774 bp, Triticum aestivum
  unsure (1)..(774): unsure at all n locations
  Clone ID: PAT_TA_61580
cccacgcgtccgacgaagcctgcctcctgcgccactcgaacgtgagcttcttcggcgtcgccgacatgtcatggctgaccggcttatgcaacgcggtgaacgcgacgcagcccgagttgttcaagacgcagctgggcgcgctgatgaacaacctcagcagcagggcggcgtcgtccccgcgactgttcgcggccgacacggtcgacttgacgcccttcacgaagatctacggcatgtcccagtgcacgcgcgacctcgccggcgacgactgcaaccgctgcctcgccgtagccgtctcgtacatcccgaaattttgcgacgggagggagggaggacgggtcgccacccggagctgctccatccggtacgaattgtatcctttctacaacgcccaggccgccgaggcggcgatgtccccgccggcaccgccgccgccagcagtaaacggcagcgatcactccggccctgcagaacgcgctggaaacgacgacgccacagccaagatagccctgttcgtctcgattccagttgctgccgtgctgttgggtggtgttgacagttgctttctatctgtgcaagaggaagaacaagaaaccacgcgaacatgtgcttttatccagcgccgagagtgaggatagaacagacatgagaagctcagagtctctcctgtacgatctgagcactctaagggcggccactgacaacttctccgaagaaaaaagctcggngagggcgggtttgggccggtctacaaggcactctgcaggatgggca

SEQ ID NO: 61581 - DNA, 316 bp, Triticum aestivum
  Clone ID: PAT_TA_61581
cccacgcgtccgacacgcgtgcggacaaaatagggacacgcgaatcaagggaggcaaggactctgccagcgtacagcgtgaccctgacaggcttactctcctccagccggatacagcccacggacgtcaccgacatggacacctggggcatcttcaccggaagcgccggcagccacctagaccatgcgtgcgagtggaacagaaacacctgctttgagaagcccgagccaacaacatgagcggcttactgagcatggacagctgcaacttttgaagcgaacattgagaggatgatgctctgaacttggatgacaac

SEQ ID NO: 61582 - DNA, 792 bp, Triticum aestivum
  unsure (1)..(792): unsure at all n locations
  Clone ID: PAT_TA_61582
aacagatgctattgcgtctattctcgggattcctgccagtcaagtacagcacaagagcttctatgagtgcattcgagaaagctgcctcgatgacgctgtcagatgtctcgagagtgcaaaggcgaatgactccattgcttacttgcgtttctggtccagagatccacgacgaccagaagacttcgaagacgaagaaagtgtcgccgacggagagttgacaatcgatgcagagaatggcgacgtggctgtcgggagtgaggaaccgtcccattacttcagcaacaaccacaccagcagcccaagccccgaccagaccagatctggtgaaggcttgatggcccccagccgtcaacgacgcgctgacagccgccgatctagtgattccgagggagggtggtgtcaagctggatggtgctatggaccttgactcacgttccaactcgacttccaaccgatgttctggctcttccatgaaggcagagccggatgtggaaatgcaggatnggcgttttctctgcaggggaaacatcgggagaatcgcgcactacaagctccaatgccnttgnnggtctacttcccgtaactcacaggnctggaggatatcaaactcctcctactcccccatctccacagccagttgggtggtaacaccccacgagcgagcaggnaacgccagtcgtccagcgccacagctggcaccttctgttgaattggaggcccggttgtgtcttgcacttctgacggcccttgtcgttatcccttcgtcgagcacgaccccagattcccgatgcc

SEQ ID NO: 61583 - DNA, 378 bp, Triticum aestivum
  Clone ID: PAT_TA_61583
cccacgcgtccggcagattttacatatgattactgatgtattgagaacattcaaactttgaggaaaaaaacaagctcggcagaatccgcggacgtgagccaggccctttgccaggatattagcaaacactgccagttaacaagtgctacagccccggtcgacgatgaactataacagcacgtgttagctccccgtatttactcgacaaagaaaagcagatgaatgcctgagaagcgtcaaagaagaagctccagtaggatatgaggctgtgatgtcttagcgtctgcatttttacacactcgcattgttgtcttaaagagggacttgcagattttcacatatgattactgatgtattgagaacattcaaactttgagg

SEQ ID NO: 61584 - DNA, 668 bp, Triticum aestivum
  Clone ID: PAT_TA_61584
cccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgaaaaaaaaaaaaaaaggggggccctttttaaagatcccaattttacttcccgtgctttccaactttttattttttttttggggccccttaatttaatttctttgcccgctttttaaaaccgtgggatttggaaaacccttgggttacccaattttattccttttgaaaaaattccctttttccccatttgggtaaaaacaaaaaagccccccccaattcccttttccaaaaatttgccccccttaattggaaattggacccccccttttacggcccttttaacccggggggttggggggtttccccccagggtaccctttacttttccaagccccttacccccctttcttttcttttttttcctttttttttcccccattttcccggtttttcccctaaaatttttaattgggggcttctttttaggttcccatttaaggtttttacggcccttcaccccaaaaaattttttttggggggatgtttcccttaggggcccttccccttataaaacgttttttcc

SEQ ID NO: 61585 - DNA, 396 bp, Triticum aestivum
  Clone ID: PAT_TA_61585
cccacgcgttcgcccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggacccaagttaacgaacccgggcttgcaaggtaaaactttttttatagggcccccaaaattaaattcacgggccggggtttaacaacgtcggaacgggaaaaaccctggggtacccaaattaaatcgctttgaaaaaaatccccttttccccagttggggaaaaaccaaaaaggcccgaaccaatcgcctttccaaaaatttgcccaccctaaagggcaaagggaacccc

SEQ ID NO: 61586 - DNA, 514 bp, Triticum aestivum
  Clone ID: PAT_TA_61586
ctctccggtccggagatggccgcgctcgccgccagagcaagctgggcgctggccttcgccagcggcgttgcgtcacccccgcggcgcaagaacggggccggggtgcccggcgccaaaggcaagcgacggaaggcggcggctcgtgtgtcgccgctagttgtcgcggatgagatcgccggaacagacggtggatcggatcatcaccatgtgtacggcaagtacggcggcgatgagccagcggcgaaggcgtggaagagaagtagttcaggtggaagccgcagcagcattcgccatcttggccgtgcatctggcaccccaacactgagctccattttggaggccgatgatttctgagcaacccggtattgattcagcggttcgattcttaggagtggttagcaacttttcttgattaccatgcattagtttagttcagttatttcgaccagtatgttgagttgctcgaccggtgtatatactgcatacgagttatatacacaccatgcttgtttct

SEQ ID NO: 61587 - DNA, 530 bp, Triticum aestivum
  Clone ID: PAT_TA_61587
gcttattttggaactccatcaatgaatttcaagctcctgttcatgttcctgaacctgatgcgaacattttatccactaaagcctcagatgcaaacattgtagaagatctagttcctgaacctgaagtgtatatgagggctctcatgtaacactttgcaaacttctattctaggatttagttgcttcgttttgtattaaaagggagataccagtgcctagtatggatgagaaatataccagcaaggggttacccaaggagttcccgcaaaatggttagttgcttccatcactacaaagttgaaatattcaatgaggttcttgacagaaaacatagctgagatgaaatcaccggtttagtgaaacttcaacaaggttattgatatgcattgctagtctagatccaagaagactcatttggcagatttaatcatgagaacctacttgagcttgcatctatgtactcagtcgagttcgatccagaaaaacaatatcatttggatggtcaactcaagatatacattgatatgatg

SEQ ID NO: 61588 - DNA, 782 bp, Triticum aestivum
  unsure (1)..(782): unsure at all n locations
  Clone ID: PAT_TA_61588
ctcaccggaggtattcaggattacaaatttggcagatgctgttgcttgcaaaccctaggcctggttcctggacttggtcggcctcctcgggggatgtagctgcgctccggtgtcgactcctcgaccaatgacgctccatcccaaccccaccaatcttcaccgctgcttgacgacatggagctgaacaccgctgcaaccatggtggcgccccctctgaccaagggattgcgacgccagcaaagcaaaggaagatccgcaacaaaactcaaaaaaattgagatatctcatatattggcaaagctaatgcctgagagggagctatcaaacaagcatgctttatatttgggacgtgcaggctggaaggatcattggtaattgatcctatcaaaggaaggtgcgatctccagcctgaaggaatggctggttgattcagctataggaagcaatcctgttctgcaattgattgctggaatcgtatttatgcaagagcaagactacacacgaggctgtcaagcacacacacacacaacggaagaactctggacatttcatcatcttctgacactggaagaggatgcactaagttataaagtaataaagtaaaacatggatttcacttacttgagaanaagatctggccatcacattgacactggctacgtaccagactaaagttcaacaaatgaatcattcatcatcttctgatcatggtctntgccgtttatgatgccaattttgggagataccgtttgttcaactacatactaatgcagtacgccgcg

SEQ ID NO: 61589 - DNA, 376 bp, Triticum aestivum
  Clone ID: PAT_TA_61589
gagcacgcctagcactgtctcactccctccatggccaggtccatgaacaccttccatacagcagtggtactctcggtgcttcttttcatctgctttgctaaccacgggcaatgcagaaacttggagcaagtcatggaaaacggcagcaaggtccacttaccatacgggctctgccaacctagaacctgcgtagatatgccggattgttactgctgttcgatagacaacacctgccacccttcgagtgaaacatgcattaaagcttgtcaaagctctttctctacacgtgttttccgcagccctcccatctaatctttacatgcattgcatggcttaattctggaataatgtgtaatttttattgctcggttgctcc

SEQ ID NO: 61590 - DNA, 742 bp, Triticum aestivum
  unsure (1)..(742): unsure at all n locations
  Clone ID: PAT_TA_61590
cagaggccaatggttatgataacttggcgagtgctgatggtgcaccggtgaccctcaacgggaagaaagcgtatggcgttttcatctctcctggaactgggtaccgtaacaaccatgtcagcggttccgctacaggtgatcagccagagggtatgtacgccgtcctcgatggtacacactacaacggaggttgctgcttcgattatggcaatgccgaaatcagcagcaaagatacaggcaatggccacatggaagccatttactttggcgacaacactgtctggggatccggttctggtaaaggaccttggatcatggcagatctcgaaaatggtctcttttcgggcaagaacccaaagaacaacgctgcagacccgtccatcaatgacagattcatcagtgcagtcgtcaagggcaagcctggtacatggtcaatccgaggaggaaatgctgcttctggcggtctgtctacattctacaacggcgcatatcccgacggaggatacaacccaatgaagaaggaaggcgccatcatcttgggcatcggcggcgacaatagtgttggtgcgcaaggtaccttttacgagggagttatgacgtctggttatccttccgacgccactgagaatgctgtgcaggctgatatcgtggctgcaaaaatgccacgacgtcaatgacaagtggcactgcactctcanttggatcatctgtatcactcaaggtcacacatcaggttatacag

SEQ ID NO: 61591 - DNA, 369 bp, Triticum aestivum
  Clone ID: PAT_TA_61591
cggacgcgtgggcggacgcgtgggtttgacgaccgatgaatgcttgattactctttatacttttgacactcgtttggtcctcggttgaggctgagcgtgttccggaaagaagacttgacatgcaaacaagtcagctttgggatggtgttttctgggatgaacacgaatgggcaatagaggaggtgaacgggatttgttgactttgcttttgtaaccggaaattttggaatcggggaaagatgttaaggaaatacgtagtgtttatgctcttgctaagtttgtactacagataggcaagcaatagagcatcatcgggttacctgtatatataggctcagagatgaaatgaatagtcttatcatcttgatg

SEQ ID NO: 61592 - DNA, 684 bp, Triticum aestivum
  unsure (1)..(684): unsure at all n locations
  Clone ID: PAT_TA_61592
gcctactggtgcgtgcgtgtgtgttgtgggcttgtcgcgtgcatccgctggtgggtgcatgggtgcctcctgctggcaaaaacatacactctgtacaaaagaacgttaaaacatacacccagaaatacatgatgttctagatgtattctgggtggtccggcaccgctgcgtctagcggtccaacctcgccgcccgaggccgttcaccgtcgcttcattcttgtttttatttgtgtaaattcccatcgagcaggtctgacttattgtttctctaaagcggccaaatcccggcgaacctctcctccagctccacttcgaggcgccgtcagtccacaggagcatgggcggtgtgctcatcaccaaaaaagagtgcttggaaacttaaaattctgtacacattcgggaaacagaagttgtagcttctttcaaagttcaaaacaaaaaatatattcagttcaacttgttctagcaaaccatgtgcgagacaccatagaatgaaaatgttgnttgcgttgccaggtctccaattggttcaactacagataagttacatccgttcgactacatatattacactangttcaactgagtgcgtcacaccaattggacctaagttttaacatatgtatnttagaanaaactgntagattnttgatgatgncaagcttagttcctttntctattt

SEQ ID NO: 61593 - DNA, 718 bp, Triticum aestivum
  unsure (1)..(718): unsure at all n locations
  Clone ID: PAT_TA_61593
cgcaaaccccggcccacctgaagcggtgcaacgcatgaaggacttatactttgctgttatgaggttaaggaaggacaagaataaaaagtatgtaccaaacgacttatactttgctgttatgaggttaaggaaggacaagaataaaaaggatgaggtgctgtttgagaatgcgttttgcaaagcaactgtcaagcagtttgctgagtttttcagagttggtggcatgctgaacactgcggttgctgctgtaggaatttttcttcttcattcgaaataccaaaattcttctaagatggtggctccatttcatatttcgcaatctatctggaaggggtcctttgataataggcacttgatcagatttttctctgcctatgccgatgagccgctggataagaaggatattgtactctttggtgtctttgaccctccagctaccagggaaggtgcggggcactattgtgtagttgcgctaaacattaagncatcgtcgttttgagctgcttgattcttggcaccttcccggtactgagagtggcataagggtcataaacaggatggcgaagaacattaagcagctttggaggaatggctcgtctgagcgcaagagaaagatgtttggatccggcaaacattgaccattttccgtttgcaacatgccgttgtgccccagcaggataacccgtatacatctttttgcttcttttcttttgagctc

SEQ ID NO: 61594 - DNA, 702 bp, Triticum aestivum
  unsure (1)..(702): unsure at all n locations
  Clone ID: PAT_TA_61594
cacaaactgtgcttcttagggagagttataataaaggatgtttgcttgagccaaaccctgtttatagcgtgcgaaggaagatgctagatctgattttggctggatgtcgtggcattgttcaaactgaaaatgccatctcgcttgttgaggaggatagccagggaagcagtcagaatcacacatgccaggtggataacatgaattccatgtcagagtctgaaagtgactcctctgtagagccattttcttgaggagccttgctgtggcacgggcgagattaggattcgatgaaataatgcagtaatgggagaacctgaagcgttcagcagacaacaaacaagcttgtatatttatcgcagatactgtggacgaaattagcgcctgtgcgcaatccattgacacatttttctgtaacagcaacccacttcttcaaactgatcatggatttcttcttggttgtaaatttatcgcagatactgtggaggtgggacgtttgcttctttcaccatctcgcagcaggttcttcctaggcttgggttaactggatcccggcctttgtggacagcgtctattgcgctgtaagtagtgtttctctgctcttgaagaaggggcatggnctgtagagagtagagactagtgggcagaatatgcataccacttgaggacttgcatctttggtgngaatgatgcctctgggtcttt

SEQ ID NO: 61595 - DNA, 652 bp, Triticum aestivum
  unsure (1)..(652): unsure at all n locations
  Clone ID: PAT_TA_61595
attctaagttgttaccaaaaatttgccatggaaaatttgtagattggtttttttaagttgacatcgaaaggttgccatggcaaattgtagagagaaataatttgaagttagttattagaaaagttcccatggcaattttaagatgttaaaaacatggcaacatttagatgttcaaaaacattccaacttgccaaggcaacgttttgttgaaaaacatggcaacttaagatgtttaaaaacatgacaaacttgccatggcaacttaagatgttcaaaaatatggcaaacatacggatgttcaaaaacatgttaaacttgccatgtcattttaaaatgttcagaaccatttgcaaacttgccacgacaaactaaagatgtgcaaaaacatggcaaactttttttattaagttcgtacataaatatggcaaacatggcaaactactttaactaagatgttcaaaaacatggcaaacttgccatggcaacttaagagcttccaaatcatggcaacctaatatgctgaaaaataatggcaaacttgccatggcaactaaaatcactatttgtttatagnttgnggtttttttcccacgacaacttatatagccatgggtaaactaactttttaaatccatggccattttaaattaac

SEQ ID NO: 61596 - DNA, 421 bp, Triticum aestivum
  Clone ID: PAT_TA_61596
aaagactactcatccctgctgtacctgtgttctttgtggtttcaaggaaatccgccttctattcgaagttcaaggctgggaattggtctttgccgtagagctgcagtttattagtacttcagttcaccatatctggaagaggctaagggtgctatgggcatgatcaggaaacagaagctggcaattattgctcgccgtatggtcctagaagttatactacttcagagaagattagatgtgcttaattagcacctgtgtgaaagtcactgcttggttgatggctcaggagtgcgttactagtgggagaagcaactgaatatgaactttcatgtgaattatagttgtgggcatgattgaactttttgggatttggcattgtcatgttttctgttctgtatgccccaaatactgattttgatgc

SEQ ID NO: 61597 - DNA, 403 bp, Triticum aestivum
  Clone ID: PAT_TA_61597
catactcctaaaccctagcgcctccgccccttccggcccaaacgcgttagccatggcgacaaaagccgccgccgccgaccccgccgccgccgccgctccccccgccgccgcagcccccgccgctccagcccccgcggtttccctcgacgagaccaaggcgaagaatgtcctccgccaggtggagttctacttcagcgacagcaacctcccccgcgacggtttcctgcggaagaccgtcgaggagagcgaggatggattggtgagcttggctctcatctgctccttcgcgaagatgaggtcgcaccttggcctagatgccgccgtgaaggaggacggcgttccagagacgacagtgcttgcggtcgccaaggtgctgcgttgttccgtgggccttcgtgtgttc

SEQ ID NO: 61598 - DNA, 507 bp, Triticum aestivum
  unsure (1)..(507): unsure at all n locations
  Clone ID: PAT_TA_61598
cggctcgataatgctctcttggtgttcagacggttcatctccgaagggatcgagttgcgctctcctgtaacgaaggatgaaattgtttctgaggtggcgaggcaactcaacgtcaacatttacccagacaatttacacctggtgtcaccattgtcatccctcggagaatttgaggtgccacttcgcttaccgagggatataccacgcccagaaggcaagctacaatggactctcaaggtcaagatcaggagaccctaagcactttcggtgggcgatctttgctctccttccaaggtgctgaatggtaccaaaaggccatttcagccttcggatgaagagacacgctgaaatagaccgtcaaactcaaccttttccctttacaatttgcttgggccatcgtctcgggcggggcgatatgatcgggccttttgttcctacnaaaaaacgttgagaaatagtgaataatttgcctggagtagggggcctagtgttggtggtgctgcttgg

SEQ ID NO: 61599 - DNA, 362 bp, Triticum aestivum
  Clone ID: PAT_TA_61599
caggcaggcaagaaagggaggtggatggatggaaacacagctgaaaaagcaccagccttttcttactgcttataatcatcatcatcatcactaggacagaaaccaaaaattaccacaccacagagagattactgtatatgattatggccctgctctactatttctaccacactagacttgagttttgtgataaatggtttgaggtaataccaggcaatgcgccagtggtcagctagctagagtaataagcaattgccacttggtaatcagggtttgggatagcttgggctttcttcatctggaaatatggagtgctgggagaagaagaccggttggtaaaaaaaaaaaaaaaaaagggcggg

SEQ ID NO: 61600 - DNA, 329 bp, Triticum aestivum
  Clone ID: PAT_TA_61600
ggccaccggcgccgtgggcgcgtggctcggagcgggggacggggttccgcgcgtggtggcgaggctgctctggggggcgctctgggccatgtacgtctgcgtgcttctgtgcatgatgctcgctatggcgttcacggcagggggggtcttggtggggaaagtggtggaggagcccgttcaggtgacagagaacctgaatttcgattacaccaagccgagccctgtggcatttgtgccggtggggcggttggtgccgccgcaacagcggatgcagcttcgagtgttgctgaccctgcccgagtccgattacaacaggaggcttgaggttt

SEQ ID NO: 61601 - DNA, 580 bp, Triticum aestivum
  Clone ID: PAT_TA_61601
gatctgaatcctttaacccatctggccctcgacaggccctccgtcccccttccgctggcgccgacccgccgccgcccccttccgcaacgccagtggcgctcccccacaagttggtcctcgccgccggacgaggtcaccgtctgctggccgctcccttcggatcctaggctcgccctctccggatcaaaggtactagtgagctttcgccatgtcgaggctgcgggcgctctggcaagcttccgtgaacgctaccaagcgagctgttgtatggaattcagaagatttatttccaccaagtgaaagatacatcttcaatttcaattcaaaagatgaggtgaagaagtggcacttgtactcggattcagagtatggaggtttatcatccgcatcactggagataactgatagtgtttctggtggagatacttcatcaacaggtgtcttttctggcaacctctccttggatatgtccgagggatcaccatggaggatcaggcggagtgggttctgcggaatgcgatcaaagaagtttgatggttacatcgatcttgattcgtatgataccatagcaatgaagctc

SEQ ID NO: 61602 - DNA, 388 bp, Triticum aestivum
  Clone ID: PAT_TA_61602
cccacgcgtccgcccacgcgtccgcccacgcgtccgcccattctgcgtagctttcaggggatagaaatctgcaccttctccccccttgcctgttccttgtctggcctggtttcggaagaagaaaactaggtttcttgttcttggtgagacatagtgagaggctcatcttgttccttgggaattttgtgttgtcatgggtaactgctggtttaaagggagtccgtacttcaacagggtttcgtccaatgcaacaaagtcagaatctccaaaattgcagagcccgtcggagaggaccgagaaggacgatagcctgctgccctccaacccacatgaaggggaggcactgcgcaacgattcggcttggaagaaccctctgatagcattcacg

SEQ ID NO: 61603 - DNA, 458 bp, Triticum aestivum
  Clone ID: PAT_TA_61603
cggacgcgtgggcggacgcgtgggttctgctcccctcgccgtcaagcagcacggccaccccaccagccagctccgcccctgcttctccaaagcacatcgggtcaaatcaggtgtgccatcggctgaatcggctgccggagtagccccggccggctggagaacctgcagcggctagctagccagccttgttgttagacaatggattgctcgttctattcctagtggaggctatttttggcgtatgcgacaaccaagtcggaggtgacggatgcaccttccggacatcatcagagcctacaatggggaagagggtgatggcagccaaactgaagttgagggagagactgttgctagaacaagtttaggcacactatgattttagtttctatggtttggaaacatgtgtaatcgaatggaaaactagcattgaatggtggcaggaaataaatatattttat

SEQ ID NO: 61604 - DNA, 512 bp, Triticum aestivum
  Clone ID: PAT_TA_61604
agcgggataagaaaagggtcaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgttttaaagaatcaaattttacttacccttgcttgcaaagtaataatttttttttaggggcacctaaattaaattcattggccgggtttttaaaacgtcggaattggaaaaaccttggggttaccaaatttaattgctttgaaaaaaatccccttttttcaagttggggaaataaaaaaaaggccccaaccaattgccttttcaaaattttcccaccctaaatgggaaatggaaccccccttttatcgggcaattaaacccgggggtggggggggttacccccaaagtgacctttatttttttaaggcccttaaagcccgccctttttgtttttttccctttttttttccccaagtttggcggtttttcccgt

SEQ ID NO: 61605 - DNA, 606 bp, Triticum aestivum
  Clone ID: PAT_TA_61605
gttgcttggaagttacaaggcgttcagaggcggcaaccaaacctacacacatacacatgggatccttgggccctgccgtgagcgtgagcatggccaaggccagcggcggcacggcggccgtcggcggccagcagccggagcgcggcacgttcagctgcggcttccggatgccgctgcactacccgcggtacaggaaggcggactacgaggcgatgccggagtggcgcgtcgactgcctgctccgagagtacggcctccccgtcgccggcgacgtcgaggacaagaggaggttcgccatgggcgccttcctctggcccagccagtattgactctccttcttacatctcgccactcggagcagaggccggtcagcgagccagcgcctggcagagactgatcagcagtggcagcagcatcaacatcacgtccccatgtatgaagaagacgagatctcgtgacaatattacatattcttatcgtatcatctaatcgtatctccaatcccccatagagaatatatatcatgtttcttggagtatatgtaagcagtggaagagggggttgtttctgatattcatacgtgaaatgtagggctttctatgtact

SEQ ID NO: 61606 - DNA, 579 bp, Triticum aestivum
  Clone ID: PAT_TA_61606
cgtcgatcatgcacatgcacgcgctgctgccccgccttgctctcctctgcctcgccgcccagcaaaccggtctgctgccggtggccatggcgcgaaccaacctgaccgtgggagacgccctgacgccgcccgggtacatcaccagcccgtccggcggcttcgccttcggcttccgcgccctcgactccgacccgaccaagttcatcctcgccacgtggttccgcctcggggacgacggcagctcctcccagccgcagtctgtagtgtggtttgcgaaaaagacgaccatgggcgacacgccgatcgccaccaacgagtccgtcctcagcgtcacggccgacggccacctcacgctcaccgacggcagcggccaggagctgtggagggccccgacccccagcatgcaacgcgggtccgtgctcgcgctgagcgactctggcaatgctcggttcctcggcggcgacggggacaccgtgctctgggagagcttccggacccgacggacacgctgctgcccgggcagcccctggcttcggtggcagggtccccgctcggggggtatcttttcttcaagcgcgc

SEQ ID NO: 61607 - DNA, 466 bp, Triticum aestivum
  unsure (1)..(466): unsure at all n locations
  Clone ID: PAT_TA_61607
caaatcccaccctcccctgccatagctccgccgtccgtacatcgcacccacccacccatccccatgggcgccgccgacgagcaccctcagcatcagccgtctccggcgccggagggggaggcgaagaggacgctggtgttcacgtacggcacgctgaagcggggcttctccaaccactgcctgctgcaggacctggcgcgcgcgggggacgcggccttcgtggccgccgccgcgacggccgaacccctcccgctcgtctgcgggccctaccgcgtncccttcctcctcaacctgcccggcgagcacggctgccagcgcgttcgcggggagctctactccgtcacgccgcacggcctcgcccggctggacgagctggagggcgtnttgcgggcccactacgagcgcctccccgtcttcgtcgttgtcgatgggggggaaagtgcattggtgtaggtggttgtttttt

SEQ ID NO: 61608 - DNA, 533 bp, Triticum aestivum
  Clone ID: PAT_TA_61608
cccacacgcacgcaccgtcgcctcccgctccacatctcgctcgctcgccgcggaagccgcctgctagggttcgatccccgccatggacgccgcctcgctcatgggcccctcctccgccgacgcgcccaccgacggggagcaccggatgggcaccaccatcgtgggcgtctgctacgacggcggcgtcgtgctcgccgccgactccaggaccagcaccggaatgtatgtggcaaaccgtgcttcggacaagattagtcagctgactgataatgtctacgtctgccgctctggatctgctgctgacacacaagttatttcggattatgttcgttattttctccaccagcacacaatccagcttgggcaaccagctaccgtgaaagttgcatccaacttagttaggttattggcctatcagaacaagagcatgttgcaagctggaatgatagttggtggatgggacaaatacgaaggagggcaaatttactcggtccctcttggtgggacgaatctgaggcagccattcccaattg

SEQ ID NO: 61609 - DNA, 542 bp, Triticum aestivum
  Clone ID: PAT_TA_61609
aaaaaacccgcaggcagccccaactttttagctaaaacaaaaaatctttacaagggctaaaacaggccttagtcccccaaaaggggcacaacccccgaaaaaccaaggggggatcaagcccggggccccaacggccagggggtttttaaagggttaaattgggggggccccccccccaaacccaaaaagggaaacctcccaggctttgtttattggaggatcgggggaccctagcccgttgcccagttttgctccacgacctaaaaaaccttggggggggcccccccctggttcccggtgaacattcggggggcttaaaagttcgcaggaaaattcgggttcgggccccccagcagggacgggatagaggccaatattgccgcaacatcaaatatggggccccacgggttttgggggaaacccaagcagaggcccccctcggcaaaaagggggggggggacaatccttgggcaaaaacaaacaggggggggctggggggggtcttctcctgggaattgggggggccccttggaccgcccccc

SEQ ID NO: 61610 - DNA, 174 bp, Triticum aestivum
  Clone ID: PAT_TA_61610
cggaacgcgtgggcccgtgatgttaccctgagactgcggaatgcgcaaggcaagggcaagcacagagtgggcacaccccttggaagacatatgtgaatgtgcctgtgctgccaagagaggatctgcggacagcactgaggttacggacgtgaaagaccgaaactgtcctgtatg

SEQ ID NO: 61611 - DNA, 276 bp, Triticum aestivum
  Clone ID: PAT_TA_61611
cccacgcgtccggcggagaaggcggaggggctcaaggccgcgctggagaaggacgggcacgccgtcacgggccccttcgtgctctcccgctacaacccgccgtggacgctcccgccgctgcgcaccaacgaggtcatgttccccgtcgagtgatcgatcgtccggccagccggccgccttatgtatgcagctaccgtgtgctagtatctcattagctttgtagcctttccattctgtttaagcacaataaataatcgaatggtctgctgaatgttg

SEQ ID NO: 61612 - DNA, 529 bp, Triticum aestivum
  Clone ID: PAT_TA_61612
ctcgagaagctccggctgccggtgatcaccgtctcgcccatgccctccccgacgagcacgatgttggtcttcttcttcttccacgtccacgttctcgtagtacacccctcgcttcacgtagatgacgtacttcctccggctgtggttgggcgcgcgcgccaccgcctcgccgcacagaccggtacctgccgctcccgtcccgagccaccaccacgtccacgcgcattgccttcttccctccggaccggccccgggcgcgcgcgagctccccttcgacgccgccggcgacgtccatcacccacggcggcagctccgaaccggcgccggacgccgccgtgtcgttcttgccgcgctggcgcagcggcatgatgctgcgcagccgcttgtgcatggcgagcaggttgctcaccagctgcgtcagctgtgccacggacgcctcgacgcgacgcagcaggcggccgtcggtgccccggaagccctccgtgcacgtgtcctggttgtccatggcggcgctgttgcaggcgtgcta

SEQ ID NO: 61613 - DNA, 587 bp, Triticum aestivum
  Clone ID: PAT_TA_61613
cccacgcgtccgcccacgcgtccggagtgacagtatcgttagtacctatccaacgaccaagagcgagacgagagtgagtgacaccgcctatcggttgcaaatggccgtcaaggtcgtcgccgggaagaccactgctgctcagcccaagagcgtgggccggcggctgtggcgcctggcgcgcaccgtcgtctaccttctgcgccgcggcgtgctgtcgtccgggcgcaagctcgccatggacctccaccgcagcagggacgccagcaaggccctcggcggcttcgtcaacttccaccgccgcgcggcggctcgcactcgctcctcctctgtcgcggtgaagcgccgcgacgacgaaacccccggctgttacaacagctacgacgcggccgacatcgccagggtgttcgagatgctcaacgacggcgggcacctcttcgacgacgaggacggggggcccgcggtggggacgccctctcccgccgcgtgggcgtcgccggccttcgggcgcagcagcgcggcttcgggccagccgcgcgtcaccgactcgccgttcatggggggcgagcaccagcggtggtctggatagc

SEQ ID NO: 61614 - DNA, 232 bp, Triticum aestivum
  Clone ID: PAT_TA_61614
gccgaggagacctcgatggaggcaccggcgggcgcaagaatgcaagaacaaaccacgcggcgcggccggccaaatctacgccaccaggcgtgcgagggcctcgccgcagatggattggacgcccacctactcggcctgcctcgatgccacgccgcggaacccaaaatgagcgacaatctcatggaaaacgggaacgctcttcgccagcgccccatgaccaccggcttggagg

SEQ ID NO: 61615 - DNA, 577 bp, Triticum aestivum
  unsure (1)..(577): unsure at all n locations
  Clone ID: PAT_TA_61615
gcggcggcggcggttcaccatgtcggcagggagcgagcgctcgaacgcggcctacgcgaccccggcggccgtgctggcggacttctcgcgcggatccggcccgtccgtctccggcagcgtcagcgtcagcggcagcgggaggagccaggcggagggcggggcgaggaagaagcccccgttccgcctcgcggcggacgacaccaagcccgtgctccgcgacccgatctcgcgttccgaccccatggagaccgagcaggccgtgctgcgcctgccgcccttcccctgaagcccagccgcgtcgtcatggatggtacacccctccgcccctctgttagcagtatcttgtaattttcctctgtgctgcacctgcacacaggctctgtattttgggaatccactggtagccaactattgggctactgacctcatgagtgatcagatcagggttgcgagggatgtgtcaaatgattaggcagncttcagatttttggtcaagcatgtcatctgagaaataagtactgtagcatgtggtgcctttggcctctgattttgtacacactgtaggccgcttaaatgt

SEQ ID NO: 61616 - DNA, 511 bp, Triticum aestivum
  Clone ID: PAT_TA_61616
tgaaaggttggcgaccatgatgtcaaccaattacaaattcaacaaaattcatcatcaccacaagaccttgttattgattctgtgctagaggtgagggaaatgaggaatattacgggtggatctgtttcaagaccgaaccagcaaaggactagaactgaacacccacaccgctcaaaaaaaaggcgttcttcttccatcaaggctgcttccaaagtagtcttaaagacttcaacatatcccaacaagcggaatgttgcgtatggtactattgggagtactgatccaagaactaaggctggtggtattgagttaggtgctgaatttgctcttgtgcgcatagacgaacctattcttgataatgaggagttggtaagggaaggttctgattgcaagacaattggcgaggctttcacttcaagatacttaattggctggccttcagcttttattcgagagaaggatggctgatttgctgttgaattcttggatcaagaagccaataaaatctgaa

SEQ ID NO: 61617 - DNA, 189 bp, Triticum aestivum
  Clone ID: PAT_TA_61617
tcgccccagacaaccaccagtccaccgtcgtcgacgagccccggtccgcgcatggagctgttcgtgcacgccaaggcggtgcgggtgaagagccggtacgacaagttcctgttctcgttctaggacgagctgtacgacacgcaggaccgtgaacggtttctaccatagcgcgcgctggacggtggaggc

SEQ ID NO: 61618 - DNA, 527 bp, Triticum aestivum
  Clone ID: PAT_TA_61618
cccacgcgtccgcccactgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgttttttagggattcaatttttattccggggggtttgaaaatattttttttttttttggggcccttaaatttaattttttgggggggtttttaaaaaggggggattgggaaaaacttggggttccccaatttttttggtttggaaaaatttccttttttcccagttggggtaataaaaaaaagggccccaccgattggtttttcaaaaattttgccacctttattgggaaatggaacccccttttttaggggcttttaagggggggggtgtggggggtttcccccaaggggaccttttatttttgcaggggctttaagcccggttttttggtttttttccctttttttt

SEQ ID NO: 61619 - DNA, 574 bp, Triticum aestivum
  Clone ID: PAT_TA_61619
ttttgtttttttttttttttttttttttttttttttttttttttttttcaagggaccggaaaaagggacattttttaattaaagcccaggaggaaaaaaaagggttggtaagggatttcttttaataaaacccccccaagtaagtaacagaaaaaagaaaggggaagaaaccctggaaggggggcggcctggaaggaaacggggaaaaagggaataaaaggaacggcaaacaaacccaagtaaaaagggttttggtaaaaaaaattcccgggggggtcaaaagtggaggtttaaataactcccccccccccgcccaaaaaaagggaagggaagcaaaggtgggccaaccccccaaaaaaaaaaagaagggaggggccccaaaccctcccccaaggggggggggggggacccgaagtggaaacctttttttcacgccaaccaaaagtttaacggggtccgcggctttaatgccggggggggggggccccaaaaaaatgtcccccccaaagggcccccccaagggaggaacctggaacccgtaaacaccctgggggggagaactctgggggaaacc

SEQ ID NO: 61620 - DNA, 802 bp, Triticum aestivum
  unsure (1)..(802): unsure at all n locations
  Clone ID: PAT_TA_61620
gcttcttaattcttgcttgattagattgatacatctcctctctttatatagagaggtttacttgactcccaagcaaggcttacttgacccctaagcaagtgacccttatctctaattaaccctaagactaacgggctataccgccagcccaggccattaggcccattacgtactctaacactacaccccacctggacatgcagcttgtcctcgagctgcagcctaaccaacttataaccatgactcaacgcaacacagacctaacacctaaaaacaagcctttaacatctcagcttggnttanactctcccccccgcccggactgggatgatttattttggacctcttaacaaaaagtggataccatccgcacgtcggacgtgcacgtgtaatgccacctggatcccatggacaccatctggacaaaaggagtgcatgtgtatggccacctggaagtggtcgcaagagcgaccagcagaggcgccctcgcggcggccggtggcggaatgcagtggtgctacgcagtgcgcttctgtcggtgacaccatgccttctccccgccggacggctgttggtcggcactgcacatagaagagtggagggctgtcgatggagaatggcgaggaggggtgcgcctccccaaccgtcgatgtcgcagactttgagggcgctgtccgtggggaaaacaacatgcccaagatccccgacgcagtggacgagatcgaggtcctttgcgcagcgaagcgcaactgggaggagcggcagctgcagaccacgcaactcccgcacacgccgacgcgct

SEQ ID NO: 61621 - DNA, 242 bp, Triticum aestivum
  Clone ID: PAT_TA_61621
ccgagtgcggcgctcgtttcctagcagccttttttttttttttttttgaccgaacaagctagtcgccgctcacatgtaaggagtatgtacagatgggtacatattacagaccgcaacgcccgcgtacgtccgtcgtctcctccggacgtccagattttcgtccgccacgggtacaaaatgggatagtagtatgaatacaagatttcagacgttcagggggattggtgatttatatttttttt

SEQ ID NO: 61622 - DNA, 549 bp, Triticum aestivum
  Clone ID: PAT_TA_61622
ttccaaaaggggtttttttttttttttttcccctattactagatcatcatcaccatcaatataagataagctgaacaagaacagttacatgaatcaatcaaactacagaaatacaacataaaaactgtttctgctcctacactggaacttgcctatgcaaagatgatgccatactccttaatggtgtcgatgacaatcccgagcttcccctcgatcctctcgttcttcttgggctcgtacgccatggcgaagacgtcggcgtccatggacctctcggctatgaggcgaccgatggtccggcaggcgttgtcgtcgatgagggacggtattttgttcctgaccccctcggcgttggtggtggcgacggcgatgaccttgctggtgccccggtgaatgaccttggcgtgcaccaagcgcttggagaacaacacgttgagcaggaacgggcgcatgaacatgaccgtgcgctgcttccaccacttgcggatcgggcatcttgtgcaacttcccgcacgaccgaacagatcaccccaccccggaaaaacaaat

SEQ ID NO: 61623 - DNA, 472 bp, Triticum aestivum
  unsure (1)..(472): unsure at all n locations
  Clone ID: PAT_TA_61623
gattcttgcctatttcattcatccatccatccatcaaaacttacatgatttattcgtgtgaacacatgatttacatttcaggaaggcaacctacgtgtgccttgttgaaatatctaagcttggtttccacatggccagtcttagcaaggccagaccatggagtagtagtgtacatcttctgtgcttcatcagccagctccaggaagagccagggacacaaacgtccacgggccttaggcgagcacagggctccgtccggacgacgatggctgtaggttggcggcaaacttcctcgccttttgttcataatgccccccctcctcgagcgaaggncttgtcaccagctcgttgcggtgcgcgtcacacgtcatctccaccaccttgaagatgtccaggtagctgatcttttcatcgatgaacagctccaccgccttctcattagcagcactcaaaactcccgtcatggtgcccc

SEQ ID NO: 61624 - DNA, 853 bp, Triticum aestivum
  unsure (1)..(853): unsure at all n locations
  Clone ID: PAT_TA_61624
gtcatgaatacctatttgttcacatttttcacggatcacaagtcgaattaacaaaatgaacaagaacaagatagcaacttacaaaacaaataagaaactgaacgaaaaccaatttcatccgcccaaaaaaggaatcctggacttcatcggagcatggtggaagtggggatctgggtgctgcggtggtgaccgccgtgggaatttgaaaaaacaaattgtctacaactctctcatcggcgcaagaaaaatgtaaatttcgttccagctccctcgttggcatttgcacaaacacttagtggttagtantagaagcacttacctgacgctatttgaagaacacaccagagagagagggagggagggagacagagtgtgtgtaatcaggggagagttcaggtggagcagggcaggaagatggcaccgatgcaggaggtcatcggtgaacagcctgcacggggagcggcggcgggttgtgcagctcgtgctccccccgagctgtcctgaccctgtgcccacgtccaagttggcggatggacgtggtcgcctgcggtggcagctgacgatggtggtgggtggttactgcatctggagtggggaggagctcgaagggatggggcgcgccaaaacacacgcggcaaaatcccgtaagaaaggcgggcaagtcacctcgaagataggataggtctggcaacaatatgtggtgtaaaagttgtttgcttaactgtctgtcgccctaatgtcccgctcttcttccccccctcccccccccccccccccccccccctcccccccccctccataccacatcctcccccccccaccccccagtncctaccccccccccccccccccc

SEQ ID NO: 61625 - DNA, 314 bp, Triticum aestivum
  Clone ID: PAT_TA_61625
ttcatagagggcttttttttttttttttttctttttttttttttttttttacgggcacttgcacatgatcaatcaagtgtgtggcacacaacctcaacttttttctaacaacaatatagtttatttcacaacatttctcctcccgaaaacagcattcgtaaagaaaaccaaggacgcatcgccatcgccaaccattgacacataaacgaacgatggtccaaatatcagcgattgttcatcatggatcatcctctaccttcgtccttgctcttgcgcctgcttggagtcagagtcccccgagcaatcaacatgag

SEQ ID NO: 61626 - DNA, 516 bp, Triticum aestivum
  Clone ID: PAT_TA_61626
aaactataattcactggataatagagaaattcgtccagagcagaaaaaaaaacatggcacgccgaatctggcagggccaaaaggagggtgggcgctggaggctcacccagcgggccttggcccatctacagaggaggccttgggcgcactgggcctggcgcaacggagggggccgctggaccgaaacagcggtggcccaggcgcgggcgctgtgcgagtcaacgcgaggcaggggcgcggtcgagacgaagcagaggatgcagggggcgacggtcgcggccggacttggcgacggcggtgttcttgttgtgctctccggccagggcggacgaaggagccggatccagggacgagggcgcggtcgacgggccaacgcggggtcgagcggcgctcgatgcagagacgatgcagcggctggcatccatggcgacggagtatctgggagagggattagagagaggggaagccgaagaagaggacgggaggaggaggcaaggtgctggcctacgagtcaac

SEQ ID NO: 61627 - DNA, 344 bp, Triticum aestivum
  unsure (1)..(344): unsure at all n locations
  Clone ID: PAT_TA_61627
cggggggaaactgaggtgggattattattattgtgcaataggcgcgtaaattttgttccaaaatgatggacgcatgacacactttatgtacaactcactcacgtatacgtgcatactaagtacaccggacgcgccaacctttgcatgccgtggcgcgtgcgcacgcacaccaaaaatcgagaagaaaaaaccgcgactggacttgattagttgacgcgaacgtccatccacggngtnnnttatcatctcatcgagatgctgattaattctcggcggggacgtcgggggcggctctcttgactgccgtgttggtgtttggggcagctggctgccgtcggagtcga

SEQ ID NO: 61628 - DNA, 377 bp, Triticum aestivum
  unsure (1)..(377): unsure at all n locations
  Clone ID: PAT_TA_61628
accgagcgaagccagcanncaaacacgacaagaaaaaggacaggacgnccancaacaacggcacccgccaagaacgaccgggcgaggaacgagcacggacgcagagacgacgaacgagaaaagaaggcgaaggaggacaggccggggaacaagaccacgagggggcagacagacaggccgaagcagaggaagnacagccccacgccccgccagccggcgaagatttttttttttcccccagcagcccctggggtggagcgcctgcacctcgccgctggggaagacgcggaaaaacagaaaagcgatcttgtacctggagcggaggcggctgacgagggcgaggcaccgctccccgcggacgaccctgaggaggatgg

SEQ ID NO: 61629 - DNA, 481 bp, Triticum aestivum
  unsure (1)..(481): unsure at all n locations
  Clone ID: PAT_TA_61629
tttctaggggcctttttttttttttttttttttaagcagtacaccttttatttatatggccgtatatctacgtacgccttttattgattcgcggtgcgacgtatagaggcttcatggacagaaggtgatctggtagttattattgccactgcaggcgtgtgtggcgacgtcgttggggtgttggtaggcttgcggcggcgggcagctggggtccctgcactggagcgcgtcgccggtgctgcacgagaagtccatggcanaggnttgnnnaagcccggtccgaattccacccgagaaatgttccttagaaaaccctttggggtgctgcccccccccaaggggaacccccgcttttggtggttttgccccccccccaaagggaaaaagtaatttggccccccccaatacccccggtttgggagactccccccccaccccccccccttgtgaggggggcccccccggggggggggggcccccc

SEQ ID NO: 61630 - DNA, 282 bp, Triticum aestivum
  unsure (1)..(282): unsure at all n locations
  Clone ID: PAT_TA_61630
cagagaaaccggccnagcngngggcccacacagcttcnccnaagggcaaacgcggacggacaccaggcgggncaacaccaacaaacgacgggaaaaacgagcgacggcagcnacaaaggcnacgnacgaacggncccccccccggacgggannngganncgggggcgnnaaaaccnaaggcaggcacgcaggcacgcagcgagagggcggcnggggnncacnggcagcggcccaggccgcggccgaagaggcggaagaggnngaaggcggagactttttttt

SEQ ID NO: 61631 - DNA, 362 bp, Triticum aestivum
  unsure (1)..(362): unsure at all n locations
  Clone ID: PAT_TA_61631
tgcggccgctcgttcccanagggggggnnnnnnnnnnnnnnaaccagangaggcgccanannaacacgagaagcggaggcacgaggaaggacagaacaggccgaacacacgcgacaggggcanacagaacaacggaacacgaacggggggaaaaggagaggcagcgcgcgcgcccgcgagcgcaggcggcggcgggagaagacacgcaggggggaggngaacaggaggagaaggagccagcaagcccgacccccccanccncgagcccgcccccgccggccggcccccggggcgccggcccagaagcagccgcagcaggagcagccgcacgcggcgttttttttgntatccccccccccccc

SEQ ID NO: 61632 - DNA, 560 bp, Triticum aestivum
  unsure (1)..(560): unsure at all n locations
  Clone ID: PAT_TA_61632
ttccaaggggcggnnnnnnnnnnnanaaccagaaagaggcgggancccannnancaaaccagagaggggaacaggggagggcanccagaagaaaacaaggagggaaacanaaggaggagcagacaacnacagaggcagaaacagcaagcgggaaccaagggcagcggacacagggcggaaacagagccaaggcgcgccccccgcggaggcggcgggcgagccggacgcccaagggcaagaaggggacgcgcngggcggggagggcgcacagggaggagcccccgaacagccccaccaggaacgccacggcggccaccaggatttggtatttcccaaggccgggccccggaggnaggnnnngaagnnnggggggancccccggacacggcgcaggcgaggagcccgcggacgagcagccccgagccccccgggaaccggcggaacccacggagcgcgacggaacccgggcggaagcggcggggcccccagacgccgccgggggccggcgccgacaagcgcgccgccacggaggcgagcagcaaccagggcgcccagccgcc

SEQ ID NO: 61633 - DNA, 303 bp, Triticum aestivum
  unsure (1)..(303): unsure at all n locations
  Clone ID: PAT_TA_61633
aaagagggnnccaaaaaanggcaccaaagaacaccaggcnaaggacagcacaaggccagcaccgccnngaaanacncccacaacaggaggagcaaacaaaaggggaaacaggaacgcaacagagaanaagaagaaggcccccacgggggaaaaggaggcagcanagnagggaaacgcggaagnaaggaacacaacaaacccgccaagcccgaaaggacggacgggaaccagccnagcaatatttttttttgccgccccccccccccccngggagggaaccnggaangggaaaacnccanaaac

SEQ ID NO: 61634 - DNA, 330 bp, Triticum aestivum
  unsure (1)..(330): unsure at all n locations
  Clone ID: PAT_TA_61634
ccagcagcagcagccaagaagcaacattttcgcccaagancancaccgaacccaacannnaaaacacnccagcancagcagaggcgaaccacacaacaggaagaggcggccagggacgcaacacgcacacagcaaggccagccacagccggacacccacacggcggcagcaagcaagccacacgcgccaggggcccgccggcgccaagcagggcgggacggcgaggccgcaggaggggagggagccgggggcgcgggggcagaggaagttttttttttttcccccccccccccccgggggnaaaagnagggaaggggaggnngaaggggg

SEQ ID NO: 61635 - DNA, 407 bp, Triticum aestivum
  Clone ID: PAT_TA_61635
cccgcccccaattccccttaaaaaggccggaaccaaaaattggggggagttgggaaagggggatcttaaaggaagggtcccgttggggaaaaaaaaaaaaaaaaactacccggggaaaaaaggggggaccaaaccccatttcctttccctgccccccccggcaaccacccgggggggaattaacccctccccccgctggggttcccaaagggcctaatcccccccccgggcccaagggcccattttcttgtttccgcccccccccccttttcccccattttgggggaatcacttcccccggcctggccttggcaacaccccttatccggagaaaagcgttaatcctgccattccccccccctggcgttccaaactgcccccaggctgggaccggggaaaaccccccc

SEQ ID NO: 61636 - DNA, 262 bp, Triticum aestivum
  unsure (1)..(262): unsure at all n locations
  Clone ID: PAT_TA_61636
ngnnnnannnnnanatttctcnnaaaaaaannttatattttttttttttttttttttttttgaaaaaagagaaaggatcgtttaaagttgaggggccatatattcattaaaaggggaggtatgaggaaggaaactggtcgtacagaactaaggaaaacatgaaggttttattttatttaacgcgcgtgcgaggaaatggggaggataatggaactgataccctgggtggaggtggaggagaaaaaaaatggtagcttctcct

SEQ ID NO: 61637 - DNA, 463 bp, Triticum aestivum
  unsure (1)..(463): unsure at all n locations
  Clone ID: PAT_TA_61637
acaacaagacagactggcaacaagagaaggactttagctttacagtccgatcgaattcagcagaaattgagattattcttccgcccaacacgcatcagtcagaaaattcagacgccaaccaaacaaacgcctaccacagcaccagccacttgcctgcctgcagcgccgccgatcgaggctcccaccacccggccaccatgaggtcaggacaggtcagtagcacgggacgacgacgcagcgcctgcgccggggcggcggcgagcagacgacgaagattttttttttttcaccggacaanccccaggggnagcaggaagaaccccgncacgncccccaccaggaagaaaaaaaacaaccccagggccgagcgccaccaacccccacgggcggacggaggagaagaggaagaccagggcccggaggacgaggaggaaggaggagacgagacgaggaagaagggaaa

SEQ ID NO: 61638 - DNA, 541 bp, Triticum aestivum
  unsure (1)..(541): unsure at all n locations
  Clone ID: PAT_TA_61638
acccaaatccaaagcaatataaatatatttcttcgattaaatggggtcaaaagcaatatacatttgccttgacatcatatcatagtacaaaagaatctgagatcatcacggtacacacagtactactagcacaaaagaatagcgacagcaacaacaccaaatcgacacatcttggatggaggcgccgctcgcccgctccagcgggcgaaggtgcacggagcgcggaggctcgccgctcagacatggtaggcgtcggcccagttcttggcgcggcggaggtcgtcctggccgtcnctgcctcggcgcccccccggcgcagggagaaggcgagcgcgagggcggcccactcgaggacgaaaatggcggtgccgagcccgccgaccatcttgaggatgacggcgccgtcgtcgtcgcggacgtaggactggagctcggcgaggaagtcggcggtgcgggtgaatgcgaggagcgcgacggcgccctggaagatggcggtgagcgcggcgcccgccgtgtgcgcggtgtgccagggcgccgggtt

SEQ ID NO: 61639 - DNA, 456 bp, Triticum aestivum
  Clone ID: PAT_TA_61639
cccctgggccacccccaaaaaaaaaaggaaagcaggctttaaaaaagtcccaaaaaagaacccggggcccccccgggaaaaaaaaaacaaagttctcggggaaaaaatggcccccaaacgaacaatcaaagaagcagcagaaaaaaaactatttttttttttagggaaacggaaaaactagaaaggcggaaatttaaccccgggggacccatgaaaaaaggaggttttttttcccccacccccccccccccccccaggcattgaaaagggttctgatcccccgctaaaccaacatgggaaaaaccggtcccttggttgagggccaagggaatgttaaccccccccttgccgggaatgccaccaacaaggtggggtttgagccccccaagccccccccccggctgtttgaggaagggcaaggggtttttgcgcccggggggggggccaacccccccc

SEQ ID NO: 61640 - DNA, 238 bp, Triticum aestivum
  Clone ID: PAT_TA_61640
cccccaaaacttagtttaaacgaaattaacatagcagctttacacaaaaacttttgtccattaaaaagaaaaaaagggaaccaagggttgcatagccctcgcttatcacggggataaaaaactagctaggaccaaaaggaggggacgtttcagggccggcttgctctattgggacttcaaaccccaaccaaagcaggggggcgcaattcccccccccccttagggggggggaggggga

SEQ ID NO: 61641 - DNA, 414 bp, Triticum aestivum
  Clone ID: PAT_TA_61641
gcaaaaagccccctgcgtccattgccgttctccgccgcggcttatacattgccgtactccaccgccgggcacgccgctcgccgccggcgcctgcgcgccgtcctccaccaccgcatcttgccggcggcgtccgcgccgcccgagcccaggaatgggcgaggcgtcgccgcggtagccaaggaaggggagaggtgtcgcggcgggcgtccgcgccgcccgagcctaggaagggggcgaggcgtcccggcggctggccttctcgcttggggcgaggcgtcgcggcggaagacgataatatttaaggcgcgctcgcttgggagaatggaggccgcctcgccgggttcggcgcggcagcacggcgtcgggctgttgcgggtggcgccggggccggggcggtggaatgacggaggaaca

SEQ ID NO: 61642 - DNA, 672 bp, Triticum aestivum
  Clone ID: PAT_TA_61642
ggacatagttactttcttaatgttcagtgaggtcccttacttccgaactgacggtccttacactgaacaacacaacggatgggtgtttcacacgtcgctgcatctgcacatccaaattatctgcgacctactcaagtctcgatacctaatctgacgatccagggatcattctcgcgcgtgcatggaggagctcccgttggccggacgcatctatctgtcctgggcgcccacctgccaattgatgcctgtgtgcccgcccggcgaatccgtcggatacatatttaattagtactcgacgcccactcttattaggctcgacgatcttaatgaacccgaggttatcctccttcccctgtgtgccccggcgcacaacagagggagtctgcttgtgaacaatcgatcccaggcgacattttcccttgacaatgcagtaagggacctccattttcctgcaaagagcagggagccacacaaccagctcaatcggatcaacatcatgagctatgacaaccagctgggctttactctgctcgattaggcaggtaacatggttaaggccatacttaacaactatcgggcttcttggcctcaacagtcttcccttcagcttcagcctgggccctctttataagcctctccttcttggcacctttgtcctcaggccggcactta

SEQ ID NO: 61643 - DNA, 473 bp, Triticum aestivum
  Clone ID: PAT_TA_61643
aaaaaccccccccaccattattatcatcagggaaaaaacaaaccgacaaagggagctacagctagggacccccttgggggcagggaaaggaaaccccacccggcaacggggggccccttcccctgggggttgacgggggccttgccaacagggccgccctgtttggggatgatgagcccaaaccccccctccttccttttgaaaaggaggttcacccccccggggggcccgtttttgaatgggttaaccgaggcgggcccgtattccagttgttcaagggccttatccaccggagggggagaaaaaaaaaacacctgggggggcacaaccttggggagaagggtctcctcgcccccggggccgaagacccccacgagctcgtaatcggcgtaatcctccagttcctctgcctccgactcgtttttcacgtgggaaagcccggaggcgcgccactccttggggcccttgggggg

SEQ ID NO: 61644 - DNA, 701 bp, Triticum aestivum
  Clone ID: PAT_TA_61644
ttttttttttttttttttctttttttttttttttttttttttttttttttttttttttttttttttttttttttttttttttttttttaaaagagaggaaaacccccataactttatagggggaacccccaaacttttgacagcataccccaaagcatacaattacaacccctttcgttgttcgggaaacccgggcaaaaaaaaaatagttcaacaaatatgcgccaacaaaaaggttcaaaacacgagtttcaaggagcccccaaacaaaggaaaaaaaatcggggggcccaaaaaaaaacaaacagggggggtttaggtaaatttaccccccccccccgaggaaaacggtctggttgcccttccagggggctccccttgagggcatgttcttgggggggggggggcccttgccacaaaaaccaggaaatttttttccggccgaagttaggccccaaaccccacggggtttgggcacggttttgaaaaaccagttgatccttgggtcattggggaacagcctgggacaaacctcaacaaggaggaccccaaagtacttgaaggaaaagccctcctccccccagaagggattgagccaacaaaaaccacccagcttggggccagttttttcttcaaaaaaaaacccctttgttccccgggcaattgaaccggggaaaacccccgggggcgtgggctcccat

SEQ ID NO: 61645 - DNA, 265 bp, Triticum aestivum
  unsure (1)..(265): unsure at all n locations
  Clone ID: PAT_TA_61645
ccaacggggacggaacagggaacacggaacggnagcggcggcacagccaacgggagccagaacancccggaacccacgcgaaggagcgagaacnagggcacccgggaggcgagcgacaacacancgggcagacagggaaaaaaaggaacggcaacnaggaaaaccggccagcgagcggccccaccaggcacacccgccagaagccgccgccggagccgccgcggcggccgccggagccgccgccgccgccgccgaagccggagaa

SEQ ID NO: 61646 - DNA, 835 bp, Triticum aestivum
  unsure (1)..(835): unsure at all n locations
  Clone ID: PAT_TA_61646
gccggccggttccgtcgaggaattttatttgctaaccgtttaggagctagcaaacctcaggttgcgttatctgctaatcggatccgactggttccaagcagtactcatatttccctctctcacgcgatagagaccaagaggcaaagtgggaattgcaccgatgcggcgcgagatccgcggcgacaacgtccttctccggcgtccctctccaccgccgttggttttctcgccagagcggggcaaatgaagaggaaggagaccaagaaagaataccgggttgcccaagaagctgctcctcgcgttgacgcggcacaatgggaagaggtggaactcccgttggcgacgtcctcgttgatctcaagtgcaaaattttgggttcggccagaacaagagccatcattctgtcctacagaaaaaagatccctcatactgtgcgtgtgttgtgtcactttcctgggctattagttgtgttttgccacatgaggagttctgcagcggcttttgcacttggaacacgacatcgttctgaacttctaatgcccccaaatgcaccagcaacacagcaggaagaatgtcgacggcgagatgagcaacatctggcagattgccgacagaggccacggaaggtggctggaaccccattgtggccccgaaatcaaccaacaacgggcaaacagagaggaggtgactcacggacgtagcgnngcgtggcagagtgggctactattccacactctaaaattgaggttcagaggaaatgaaaagagtgattttgttccctgatcatgctttcacatttcttagcaaacaagcactagcagccccgttttggacg

SEQ ID NO: 61647 - DNA, 629 bp, Triticum aestivum
  Clone ID: PAT_TA_61647
gccggccggttccaaacatctttcccggtgacgacgtctcctcctatgcactctcactatccacggatatctaagctaaccccacctcctgtgaacgccaacgaaccgaagggcgcggtctgcaccgccaccacagaatcactgggatatgatcgtgctcccatgatcgacaaagatagttatgcattgatgaataccagcactgttatcctcgtgatgatggatattgaatttcctgctcgaaatctcaaacgtgtatctaggcatgtgattgatgctaaactcctccttctcatgggagtcccagacccaactgacgcacgtgattactgttctggagtaaaagcggctgatatctgtgtacgattccccagaaaggaaagaatgcacctcaatgatgttatgaactgaaatgtttctcccaaccaaattcaacatactgctcatcaactacctgaagtactcttctgttccagtctggttgcttcctcgccattcttgacccgtgctcccaacctgatcgatgtcagtcccatccatccctgtagaagaacatatccagctagacaccacgagaacactacaggtcagtcgactacattacggatagactcggtgtacacatgtct

SEQ ID NO: 61648 - DNA, 259 bp, Triticum aestivum
  Clone ID: PAT_TA_61648
gccgtgaacttagtcttcttcacccattcgcactccctgaggattgcttaggaaggaataagctttattgtcgagttaggcatcatgtttattcccgtcaagaccctcacggcgaagacgatcacccttgtaggaggcgtacttcgacacacctgaccaagcaagctgatcgtgaccaacaaatgtatgacttcacgcagaaaatgacaaagacccctgatgttcataagatcactgccgaagagcaaaacccgctctc

SEQ ID NO: 61649 - DNA, 710 bp, Triticum aestivum
  unsure (1)..(710): unsure at all n locations
  Clone ID: PAT_TA_61649
aacaacaaccctcgtaatcacaagtccacgacttaaacgcttcgtcgatctacggattctattgccagacaatggctctactgaccaaaatgacatcctacccttttcccgtctagactgggctatagcaggtacaacagtgtcaacccagaaaccagacccttcaggtgctttgacttctcattcaacctttatccaatggatatcctcacgtgaactgggaaacgacgcgggcttcatgtatccgcaacccggcgaggacctcactcttgaaaaaggcagcatggtaaatccggacacgggcattgacacagcgtatgaagaactctggcacgatgctacgccaactgctgtgccaggagaaccagacgtcagagcgttggttctgcagactgaggatgaagagaagggtgtgagagggtgcgttgtaaggctgggaaggtatgcgcagggactgatcagggttggtgaggagattgcgttggagaggtgggagtggacggaaggtggatggaagagaaccgttaggatgggcgacgaggaattacctattgagaagatcttggntgaggagacgttggatgaggatgataaatggntgatgtttagtggagaaaacttggaaagttatttgaagcgagtggcaagaccacttcaaagtaatactcanaacagacaatctagaaaaaaaaaaaaaaaaaggcccccta

SEQ ID NO: 61650 - DNA, 519 bp, Triticum aestivum
  Clone ID: PAT_TA_61650
gccggccgggttccccatagtccaagcctcttcaccccccgtcctggccgcgtggcgtcgctccctcctcatgctcctgcccctcctcctcctcctcctctccctcttcctctccctcgccgacgccttccaggcgaacgagctgctcctccacgacgatgacgagctcgagggcgcccgtggcctccgtctcaccccctcgccccggccgccctcaattccgccagaaacgtgctcccgccgccgatccatcaagcgctgatcgatccatccatcgcatcaccccggacgcctgcttcccttccctccagtccactatctgcttcgtgctagactgcctgaccggctagccgttcgccctccgcgctctcgttttctttctctggctgcgagagtcttacgaatcgccgaatctgtatttgagacaactctggatgtgaagaatctgctgtcaggatatgactgtatttagacttcttatactccctatggctacagtattatgattccttccctaca

SEQ ID NO: 61651 - DNA, 514 bp, Triticum aestivum
  unsure (1)..(514): unsure at all n locations
  Clone ID: PAT_TA_61651
gnncggcggttccagtcatctgtctgacagatgaagagtctacagatcccccgggatcatgggtcgacccatgcggatgtaccctcgaagcccatcaagactgcatgctttcatgggtaaccgactgcgaacgttccaacaaaccgcttcagtgtcccgtatgtaaagaccggattcaaatggaggggccctgggatcccatcgtctctgtgacagacgccgttgcaaataggttcacacgcgcgagtcctttcatgttgctctcatctgtcacagttggtgcgcagttnagtctccagatgtacggagnatctgctatgtgggcgnttgcaggncgccaggctttggtagaatacgtcctcggncacgaagtttgggcgaatggagatgtctcaagagnattgatgaccgggggnnaaaggctgggaaaggcgttgatcctgancancatagggccagttctccttatcggacagttgatggcgtggnttgcgaacnaagaattcctctccac

SEQ ID NO: 61652 - DNA, 727 bp, Triticum aestivum
  Clone ID: PAT_TA_61652
gccggccgggtcggaaactagacggatgcccaagagccttccactatggtctttcccactcctctcaccctgtctcgtaatcgtggtctcatgcgtgctgaactcggcttagagattgcacacgggggatcaagtggtattgaccgccctgcaaggaggtatgccatgggagttcatcaaccggacgagggcaagggtgccgattttcctcccctacttccaatcccggtgtgtccaccatcgaccaaatcttcaccacgccaggaagaagatgctgcttcagcttccgtttctagctctgcttgagctgcttcgtctgtttctcttgatgtgggtgtcggtcttttgatatctcttctctcactttcggagcacagttggtcctaaatttgaaaaccaacaaagactttggttgagcaaaaaatacacatgccattatcgtcatgtcaatcaaactgtaattgagggactggcagcaaaggagatgttccacaagcactaacaaactgttgagctgacaaacggacaagtaagtttatttggcaatgcaatgatgttatgctgtctagggcaatgatgttatgctgtctagggctatattaggaggatcttatgagtgatgcttacttcaattttgagcagttaattacacttgccatgcgtgctttgattgctcgacagttgtacttaaaaattcacatattctggtgggcatgtcattatctac

SEQ ID NO: 61653 - DNA, 728 bp, Triticum aestivum
  unsure (1)..(728): unsure at all n locations
  Clone ID: PAT_TA_61653
gccggccgggttccggcccttccccatttcgagcagcgagatcttggaggcagagaggggagagccatggcgattttggctggttagctttgtcgttgatctctggagagcgagccggtggttaggcgtccggtcctcctcccccctccccctgttgcttctccttcaagcgcgttgaggcagaggagaagttgacgcatggtgattcagcggcggcgtcttatctgcttcccttgatttggtgatgctcctccttttgttgtggtgttctccgagccttgtgcgtccctccttcccacaacgaggttgcaagtctcttgctcttgactctacaaagaaagcatcaaatgattcgtcagttggtaaatctgctgggaggcaatgccaagtgaggttcagcatgtgcacagtcctagctcagttggtggatgagttctctttttgagtagcatgtaacatagaaccactagtgcaaatcatttggatcattggtggatttacaaggtctttttagtggatttaaagtttcatctttaatgcatcttgcactgtaattcttagtggtnaatcttagcagttttttcagtgcaaaccattttggattgttggtagatttacagtgtcattttagtggattttacagtgtcattttaatgcatcttacactgtaattcttagcgggcagggatagaaattattgtcgaaaaaaaaaaaaaaaaaggccccta

SEQ ID NO: 61654 - DNA, 728 bp, Triticum aestivum
  unsure (1)..(728): unsure at all n locations
  Clone ID: PAT_TA_61654
gccggccgggtcgggcttctggttttccgtgttgttactgaagtgctgcgcgagagccgattggccgacggacagaggggctccgaggcaataatggaggcggcgtcggcggcgtcggcggcgacggcgacggcgacgatggtgttcgtgtacggcaccctgaagcgcgggtttcccaactacccccgcctcgccgccttcgactgccccttcgccggcgcggccaccaccgccgccccagcctccctcgtcatcgggccctactccgtccccttcctcctccccaccccgactccgtcctccgggcgtctggtctccggcgagctctactccgcgtcgcccagcgccctcgccgacctcgacttgctagagggcactcacctcggcgtctacgagcgccggcggatcaccgtcgtggttgacggggcgagcaaagaggtggaggcacaggcttactttgcgaacgcgagctacgcggagttcctgtggctgcgctgcggcggcgaggcggccgagatcgcggagtacaccatggagcacgcgggcaggtacgtcccgcccagtggccgctctcccggcgtctccgggctcatggatgccgtccgtgccttcctcgccactgctccgccagaaaattgaactgttgtcgtctttccttccgattgttctctgaatgaattgaagaataaaatgtggcgtggcaaanaaaaaaaaaaaaaaggccccta

SEQ ID NO: 61655 - DNA, 493 bp, Triticum aestivum
  Clone ID: PAT_TA_61655
gccggccggttcgggaacctccatctcagaccaggagctccaaatcaggaaagaagagcgcagcagagccgtgtttaatcactcaccaaggaccgatggcgtttctgggaggatcattgcgcgtgacgagaagcattagcagccggaagatgacggaggggaagagccacggcgggttggggtcgtggccgcagccgccggcgcccgtgaggcagctcttttggagggtgaggcgcgccgtgctacggccgaagcgccatgccgtgagttttgggtacgatctcaagagctactcccagaacttcgacgatggcctcgtccctgcccaccgcctctagcaacacccgcagcgtcttcttcttcttcttttcaattttacttgccgcccggccggagcacggctcgaggctggtgatttgttcctctagctcagctaccagtgtattagtaaaaaagaaattgacttgaaaaaaaaaaaaaaaaaaggccccta

SEQ ID NO: 61656 - DNA, 540 bp, Triticum aestivum
  Clone ID: PAT_TA_61656
gccggccggttcgggaagccagaagaagcacacaagaatctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggaaatggcggccgagaacggcggctgcgactgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacagcccccctaaataaaatctccctggtttaaccaaaaaaaaaaaaaaaaaaggccccta

SEQ ID NO: 61657 - DNA, 521 bp, Triticum aestivum
  Clone ID: PAT_TA_61657
gccggccggttcggaaggagtgacgtacgtaggttgatttgacgtgcgtgcatgctttgagttggccatgcatgctactacctttgtatcctcttccgcttttcctaagacatgatagctgcgtgtccacaactatgtgggagaataagactcatttcccgccgccacagaaggacatgaacatccagtgcaagatatgcatgcagactttcgatctgcaccacctctgaaggcccctgcgaggagcaccgctatacaaataatgcaaccaccgacctcgacgaatgcttcacccacctcatcccgagcgatctgcccaaggggaggcccagagacaaatacacccatagaggagctgccttactccacctaacagtaccatgttccacaacgactggatggggaactacccgtgggtcccaactctgatgggctggtagcccacctgctttcgccgggtggccatctactatgaaaggcccgctccataaggccgttgcgctacaatatctataaccgag

SEQ ID NO: 61658 - DNA, 586 bp, Triticum aestivum
  Clone ID: PAT_TA_61658
gagtacgaattaagaaggaaatcccttccatcttgcccggccgtgggcaaaaggccccgggccggccctctcgcgccctccttctagcagcgccataacaatttggtatcagctagcttcggttcgatcatgtcttcaccgccgcccaacccgtctcttccgctgccggtcacctcgtcggaggcgaccaccacgaccgtcgccccgctcctgcccgcgttgggattctccgccgcgccctctcccgtcgtcctcaccccggaggtgttcgggacgctgcgggacctaatacaggcggtccaggagatccgcctgttcttggccgggtcctacgggctgcacccggctgtgccgcccatcaccgccaccgcgccgccgtggctgccgccgcaccaggcgccccccgccgcgctcgccgcgactgctgcagctgccatccaccgccccgtcctggctgtcatggcagccgccgcaccaggcggcctccgccgggctgctgcagctgccatccaccaccaccaccgccccgtcctggctgccgtggcagccgccgcaccaggtggccttcgccgcgctcaccgggccg

SEQ ID NO: 61659 - DNA, 315 bp, Triticum aestivum
  Clone ID: PAT_TA_61659
acgtcctcgtcagttcactccccgcgatcccgtacgccattagcaacaagcaccacagctctcagcggcttctatctcccgcggaagctactaccgtctgttctctgctcgatctgtgcgcgggcgaacaagttaattaggtggctgggtgtgctcggcgaccgtcatggccgacgactcatcgtccccggcgtcttacatccgactggtgcagcatctgatccagaagtgcatctgctacgacatgaacacggaggagcgcctcgccccgctggagaatcccccatcatcttgtccttcgtcccatccacttgt

SEQ ID NO: 61660 - DNA, 494 bp, Triticum aestivum
  Clone ID: PAT_TA_61660
ctttcaccaccgtcctcggctccccggagatcccgccgtcgccgtctccgtcgcggtcgccgccaccggcccgtgttggtgccgccccggctggctcttgcaacttggaagggctggtaacaccgcccctgccgcctcctccctccccgccagtccccgcgcccgcggcaagcgctcctcggcgcccctcctcctgccgtcggatcccctcgccgtagcagctgcttggcggtggatagggcaagatgtctggcaatcctgcaggtgtggataacactttccgtaggaaatttgataaggaggagtacttggagcgagctcgacagagagagcgggatgagaaggatgaagcccggagaggcaaggacaggggccctcctgtgcaaagacagcctttgaagcatagggattatgaagttgatcttgagtctcggcttggaaacacacaggtgctaaccccaatcccacctctgagtcaccaggcctgcatacta

SEQ ID NO: 61661 - DNA, 237 bp, Triticum aestivum
  Clone ID: PAT_TA_61661
ccacccatccacctccactatctatctccacccatttttggtctcgccccacgcggcacagaacagagcagacatcgatggcgctcaaggcggcctccttccccggcgagctgtcctccctcctcgactccggcaccaccaggagcaggaggggagccgcagccgccttccgccagcgcaaagtcgacttcacatatcaaaggagggacaaaagagctgcctacctgaggacatgct

SEQ ID NO: 61662 - DNA, 459 bp, Triticum aestivum
  Clone ID: PAT_TA_61662
gactcaccgccgcctgcctcctcccctaacctctcccgatcccaccgtcgcctccctccctggcctgcgccgccgtcggccctcaccagatcgccccgccaccgccaccaccctcaccagatcgggctgccaccgccgccgccctcaatcggagaagatgatgcccggccccggccccgcccccaaccggagatgtcgccgccaccgctaacaccttcacaaccgctgccgcccaccatcccgaccacctccgcaaccaccgccgacatccacctcctccaccccctgccccgaccacctctgccgcccactaatctggcgcgacctaccccagtatttcggtgacctgcccgcccttcctacgcgatctgccgcgtgtgctctggagcgccccatcccttcgagctcctccccactccagatgcaggaaccacccaccaccatcgtcagctgccaccg

SEQ ID NO: 61663 - DNA, 556 bp, Triticum aestivum
  Clone ID: PAT_TA_61663
atttgcacccagtgctcgtctcagagtcttcctcgacccggacctctctgttcaccgcacacgattagcaggggcagcggcgaggaagatgacgacgacgacgacgacgacaaggaagagacccttgacggtccctgagatggcgctgagggtgtgcgtgatccccctcgccttggcctccctgtgggagatggccaccaacaagcaagccgatgacacctacggggagatcagcttctccaacctctccggcttcaagtatttagttttcattaacgctgtcactgccgcctattccgtggtctccatcctgatgtcatccttcaagtccctcgctcgctacgattggctcattttcctcctggatcaggcggcggcgtacctgctggtgacatcgtgctcggcggcggcggagctggtgtacctggcaagggagggcgaccgggaggtgtcgtggggcgaggtgtgctcctacttcggttggttctgcggcagggccaccgtgtccgtggcgctgcaggacgccgcaatgctctgcttcaccgcgctctccctc

SEQ ID NO: 61664 - DNA, 625 bp, Triticum aestivum
  Clone ID: PAT_TA_61664
aatctcctgcccgagcacccaatgagcggcctccctcgcgtgagccccgcaggagctcaaacccgagcggattgagccagccgtccccaccggcgatgagcagcattagctcccgcagctccggcgagccctgccgagctccccgccgccggatcgggccgcctccgcccggttcctctcgcgccgtcgccccgcgtgccctgccccgccaagccgcgccatcctcctgccggcgcccgcctgggatgaacgcagcgtcgccccgctcgccttcgtcgtgtgcctgcgcccgagcctcccgtcgagctccactgcctccgtgcccgcaagtcgccgccgtcccggctgcctcgtcaaccccgtcgttcaaaacgggcaccaccaggagcttcttccagcctcgcgcgcccgagcccccgagctcctctagtcgcgcacgagctccgtgacccccaacggccacttcgtcagcctcgtcgccgccgttgactcgtaagccagcaccttgcctcctcctcccgtcctcttcttcgggttcccctctctctaatccctctcccagatactccgtcgccatggatgacagacgatgaatcgtctctgcatcaagagccgctcgacccga

SEQ ID NO: 61665 - DNA, 732 bp, Triticum aestivum
  unsure (1)..(732): unsure at all n locations
  Clone ID: PAT_TA_61665
actgcgcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggncagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagat

SEQ ID NO: 61666 - DNA, 439 bp, Triticum aestivum
  unsure (1)..(439): unsure at all n locations
  Clone ID: PAT_TA_61666
cggccgggccggganttacaaaacttgcaagctaagcgaaaggctttcccggcagcggacagctcaccaccaacccgcatccctccccccaatggcgaagattcaatcccgcggcccggcggcggagccgctgctccccccgccgccgtacctcagcccccactcgccggccgacttccacgacgccgacgactcctacgtcctcctcgtcccggtgcggctccggcgccgcctgcgccggggctgcggccgcggccgcgtcgccgcggccctcgccgccctcgcgctcctcgccctcgccttcctcctctggccctccgaccccggcgtcagcgtcgcgcgtctttttttcttgcacgcctccgacgacgcccgccccgacgtcgacctcaacgaatccgtcgcgctcaaggaataaagtcgctatcttcaacgtctt

SEQ ID NO: 61667 - DNA, 211 bp, Triticum aestivum
  Clone ID: PAT_TA_61667
aatacatcacgagttggcttctcctccccttctcgttcgggttctggttcggttcgggtccgagagtagctagcctagtctagggtttccgtagttcggagaggagagaaagggagagatccatggcaggagacggagtaccgctgcttcgtgggcggcctctcctgggcgggcgacgaccactacctccagaagaacttcagccagcacc

SEQ ID NO: 61668 - DNA, 619 bp, Triticum aestivum
  unsure (1)..(619): unsure at all n locations
  Clone ID: PAT_TA_61668
ctcgagggcnncggccgggnnccgggaaaaaaaaaaaaaaaaaaaaaaaaaaaaaaaaattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactccc

SEQ ID NO: 61669 - DNA, 395 bp, Triticum aestivum
  Clone ID: PAT_TA_61669
atttcttgtgctctcatatccttgacacctaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtactttcgtgtgctgccgcgcgagtatacgtgactaacgagcgtctgatctgatgcagtctagc

SEQ ID NO: 61670 - DNA, 502 bp, Triticum aestivum
  Clone ID: PAT_TA_61670
acatatcacagcattccacaatcgccatacaaatatccgccgctcccgcatctctgagagtttccagttctgcgtagaacgtagaaatatgtccgcaacgaagggcggcgacaggaagaaagggcagacccgatccatgaaggctcgggctccagatccccggcggacgcataccccgctacctgaagaaggtgcgctacccactagcgcgtacgctccgtggtccccgtctaactcgccgccggactcgagaaactccccgcacacgacatgaagcctgcagtgcccactgacatggacaacaatatgattctgctgattccgagcctgctgctatttgtcgtcacgaacgagcaacgagttcttctacctgcctctacgacgagagaatctgccgcgtaccttgtgatatgctcgcttaactcgctgctagaactccatcaggaaggctgaaaccgccaccagacctgaacaggcagcaaccgctacgaaggatgctccc

SEQ ID NO: 61671 - DNA, 393 bp, Triticum aestivum
  Clone ID: PAT_TA_61671
aattacaaaaaaaaaaaaaaaaaaaaaaaaaaaaataaaaaaaaaaaaaaaaaaaaaaaaaaaaaaaccccccctcacgccgggcgccaagccaaaaaaaaaacgcacgccgacctttctctcgccatggccgccaccgcgtccctgtctgccgtcggggggcccctgtccgtcgccgggttcaaaaaggccgcgtcgttccggcccctgccgggggtcagggccggaaggcccgcggcgaggatgacggccgtccgggcgtcctccgcgtccgggcaggaaaagctcacggccgggttgaccgcgggggccgtggcggcggcgctggggttttttttttttcccccgcccccccccccggggttgtccccgtcgctcaaaaatttcctgttc

SEQ ID NO: 61672 - DNA, 584 bp, Triticum aestivum
  Clone ID: PAT_TA_61672
attctattcattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggtt

SEQ ID NO: 61673 - DNA, 415 bp, Triticum aestivum
  Clone ID: PAT_TA_61673
aacctcaccacacatgctaatcaagctctcagctccttcccagctccacggtttccagcaagcaagccgaagcactagatcctcgatgtctcgcgtggcactggtcgccgtgttcgccgtgctcgcggcactggcggtggcggagatggcgtccggggcggtgacctgcggcgacgtgacgtccgccgtcgcgccgtgcatgtcctacgcgacggggaaggcgtcggcaccctcgggtgcgtgctgcagcggggtgaggaccctgaacgccaaggcgtccaccccggccgaccggaaggcggtgtgcaactgcctcaagaacctggcgagtttttttttcatcactgccaccgccgccaacatccccgttaagtgcggcgtctccgtctctttccccatcagcactaaacccaac

SEQ ID NO: 61674 - DNA, 559 bp, Triticum aestivum
  Clone ID: PAT_TA_61674
aatactgctcatcatcatccccgataccaaagtccatcttcttctccttgaaatctttttgggttccagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgactatgtaagaatgaaagatttacctaattaactagtcct

SEQ ID NO: 61675 - DNA, 207 bp, Triticum aestivum
  Clone ID: PAT_TA_61675
ccgctcgaggcggcgggccggaaaatacaacaacgcgagcacccagcctcctcacttctcacagtcgcagcatcctctcagtcctcaccttcctcccctcgccaccacccaccaaggaaaggaggatgtattgttgaggaggaaactgaggatgaggagacggatgcaagagaggaaacggatgcggcggaagcgagatgttcaccg

SEQ ID NO: 61676 - DNA, 466 bp, Triticum aestivum
  unsure (1)..(466): unsure at all n locations
  Clone ID: PAT_TA_61676
ctcgagacggccgggccgggnctacatcacgagatggagcattcataaattgtgctcttagctcaacatatggttgatcattgctgacaccaaagaagattgtcatcgtctgggtgttcaaaaaaaaaaaaaaaaaaaaaaaagacaaaaaaaaaaacaaaaaggaaaaaaaaaaaaaaaaaaacaaacaaaaacaagaaaaaaaaaagacaagaagaaaaaaaaaaggcccctcggcccgcggaggggggggccccggttgacccgcccccctacccaagtctttttgttgtgggggggcgggaccgaaataaactgaaacgcccaccggaggcgccgccccaatgtttacctggaaagtcccggcccccccccggccgggaagggaaggacgcaaatggacggggcgtccggcccgggccccgggaatggtaccggccccattgccccccccccccccccccgc

SEQ ID NO: 61677 - DNA, 617 bp, Triticum aestivum
  Clone ID: PAT_TA_61677
acaccccaagcacaccagcctcctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgcaactgagccggcgcccaggaggccggccggcgaggcgagcacgaggatgaggaggacaactggacaagcaaccaccaccaccaccaccaccatcactagccgctgcatgcgcccgcccgcgcgcgcgctgaataaaataaaaccgtcgtgtgttccttaactctgtacctgtacgcccgcgttattccaccagcagtggcctttgctcatgcctccaactctaaaacatggcccctccttctaccttgcaaacaaaaaaaaaaaaaaggcccctagggcc

SEQ ID NO: 61678 - DNA, 204 bp, Triticum aestivum
  Clone ID: PAT_TA_61678
aaaaaaaaaaaaaaaaaaaaaaaaaaaaaaaaaaaaaaaataaaatagaaagaaaaaatatgaaaaaaaatccataaattccccccgttgttcgtatacggacgaaaggcccgtccgcacgtcaccggcctcccgcgccacctaccggagccttggccgccttcacgggctggaacgccccgtcggggcccttctccgcaaagt

SEQ ID NO: 61679 - DNA, 593 bp, Triticum aestivum
  Clone ID: PAT_TA_61679
ctccctctctctcctccatttctctcctcctcctgccaccgatcccgaaccagggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggccggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctggaatcactgacaagcttggcctgcat

SEQ ID NO: 61680 - DNA, 234 bp, Triticum aestivum
  Clone ID: PAT_TA_61680
ggacgcagagctctccggcagtctggctctctccatcccaatcccgacctaccgcccgctctcgcacgccatggacgccacggccaccggcgccaaggggaagaagggcgcggccgggcgcaaggccggcggccccaggaagaagtcggtgacgcggtccgtgaaggcggtgctccagttccccgtcggtcgcatcgggaggtacctctagaagggccgctacgcccagcgcgt

SEQ ID NO: 61681 - DNA, 469 bp, Triticum aestivum
  Clone ID: PAT_TA_61681
acgtacacacacacaggtcaccagtcaccacaccacactcccccagatcggcttccgttgcgagacggaccgccccccgctttatttccgccaccaccgacgccgcgccggcgaaggagcccctcgccagatcggatccctccgccgcgacgcaacatggcggctctgctgatgcgcaggctcgccgggacctaccgcggccgcgcgccgctggccgccgccgccgttggcggggccgcgttcttctacgcctcgtcgaaccccaccgtcgcgcacatggaggagaagggggaggacgccgctgccaaagttgctcttaaccctgagaaatggttagaattcaagctccaggagaaggcaacagttagtcatgattcagagctattcagattttcgtttgacccatctactaagctgggcctggatgttgcctcatgtctcgtaacaagggctcccatagggcaggaag

SEQ ID NO: 61682 - DNA, 758 bp, Triticum aestivum
  unsure (1)..(758): unsure at all n locations
  Clone ID: PAT_TA_61682
ctactctcactccctgcttttggaaaattctaaaaaaaactacttttggaatcgaatgaatttattggacctgtatggctgggtgcagaatggctggctgtcaggatgagcaattaaattgagaagaacactacgtctgttaagcccactaatctcacagctcactggtgcccattctcctccattcgctttgctcgctagacaacagacagtcccccgtagcagcagcagaggatagtagctcggtccagtacgtctcgggtgaagcagagcagatcgatggcgctctctcgtcgcatggccgcctccaccctcctgctgctcgtcctcctcgtcgccacagagatgggggcgacgacgaccaaggtggcggaggcacgggactgcctgtcgcagagcttcaagttcaagggcgcgtgcctcagcagcagcaactgcgccggcgtgtgccgcaccgagaacttccccgacggcgagtgccacaggcagcacttggagcgcaagtgcttctgcaagaagccctgctagtccgcccgctcgcccctccccagccggccagcgccgagacgtccgatgctagatcatcctagccgtgcgtccacgttcgtccgtgtgtccctcttagtagaactataatanagtagaaaatcaatcggagtctcggtagtttatatgcctgatttgtgtgtccgtgtgtccgtgtctgtgcctgatttgtgtgtggtgatgttctaagtatggtcgttgtttcagcatga

SEQ ID NO: 61683 - DNA, 704 bp, Triticum aestivum
  unsure (1)..(704): unsure at all n locations
  Clone ID: PAT_TA_61683
ccctctcttttccccctctcgtcgcatcggcggcggcgacaggacatcgggcggcggcggcggctggacagccgcagaacgaaggaagggctcccctgtagcgccgttcctcgtcccgatccgcacggatccgccccacctaagggccccgtgcacaaggagcaaagatgataaaccttttcaagatcaaggggcagaagaacgaagaggcagccaactcgaaaggggggcctcccgtcaagaagcaaagtcctggggaattacgtctccataaagatattgctgaacttaaccttccaaagacaactaaaatttcctttccaaatggaaaggatgatctcatgaactttgaagccactctacgacctcatgaaggatactacgtaggtgggacatttactttcaccttccaagtatctccttcctaccctcacgaggctccgaaggtcaagtgcaagaccaaggtttaccatcctaatattgacctagaaggaaatgtctgcctgaacattctgcgtgaagactggaagcctgtcttgaacatcaacaccataatatatggcttaaaccttcttttctcacaacccaatgacgaggaccccttgaatcatgaagncgcggccgtcctccgagacaacccacagaagttccagagaaatgttcaaacggcgatgtcgggaggctatgttgataacacccatttc

SEQ ID NO: 61684 - DNA, 668 bp, Triticum aestivum
  unsure (1)..(668): unsure at all n locations
  Clone ID: PAT_TA_61684
gccggccgggttctcgaagcaacatctgactctcatcgaactatagccatccccatccgccctgtcaccgtccccactgcggttctcttcgagatgcgcgagggcgatgggtctctcaagcccgcggaggacgcgcatacaaagaccgacactggcagcgatgaacccgagggactgtgtcccaagcgagctcctacgccgcctgcccccggcgaaggagaccggcgaacagagaaatctccccctcatgcccggagcgcaagcgccctagatgtaagacaacccccctgcggcacctgcgccatatcacgctcatctgaccctcttctaccgaggggaggcgctggagctgaaccaccccacagcgaagaggatgaccgaggtgctccgggcagctgccgacaaaggcaccgactgcagaaaacctggacctgacccatgttaagcaacgtgcagctgctccgcctctatgcacaatggcaggaataagggtcgacgcgcgcagcagatccttactgccgacaccgtagcgcancccgtatcgtcttgatagccgactcacgctcacgctctgatgctagaatcatgcgtgaaatagtagccagagcaactcactgttcatgccaatagtgtggatgtctgctggatcccttatcctgcattatgat

SEQ ID NO: 61685 - DNA, 653 bp, Triticum aestivum
  Clone ID: PAT_TA_61685
gccggccgggtctcggcaatcgtctgcactcgctgctgccctcctactacgactatgatgatcttgcaaatcctgaacctgcccttaaaacgagacctgaatgaagtgctgcgccggcagtctgctcaacgatcgctgctacaggctccgcatgctattgccgccgttcaggtcaagacactacactgccagctgtattgaaccgcagataccttcatgctcacatacctagaatcaaggaccttgaccttctcgcatctccatggtagacgtgcacaatatccccgtgcaactgcaacgaccgagatcaccccaccgactacactcttccagaaataaaggacgcaccgtgctaggactcttcccgaaccttcacagccaccccggctgactaggaggcttctccccaagatctctccgcccgtatagccccaacagatataaccgctgtagatgactgcatccccaactctctgctcttgcaaaaagactgtcccaacgccaatgactcgacgtacaacacatcccccgacttccagttgactcagaactcttaaattgcgtccctattactctctgcgacattatgcatgcctgaatggacagtgttgcttaaatgagactatactttggaataacttacctaaaccctg

SEQ ID NO: 61686 - DNA, 725 bp, Triticum aestivum
  unsure (1)..(725): unsure at all n locations
  Clone ID: PAT_TA_61686
gctcgaggccggccgggtttcgnaaactccatatcaggaaatccgatatatccttcagaatgtcaaacacactattgagttctctggctgaggcgaagctagttcccggtgcggcagctagtctaattcccgagggtttcaagcccagcgtcaacctgcgcgtctcgtttgacggcaaggatgttgagttggggaacttatttcgtgcgaccgagtgcaagcgctcacccagtatcttgtttgatcaagaggctgatgcgccgggtgatgctacatacatgcttcttctcgttgatcctgatgcgccgacacccgatgaccccaagtttgccttttggcgacactgggttcttcccggtttgaggcccttgggaagcgccgatgccgttgcacaaattcaacctgcgttgacagaatatctgggacccggccccaaggatgattcaaagcctcacagatacttactcctcctgtaccgtcaaccttccaaccttgatctgacaaaggatgatgttggaggtgaagagttcacgcaaagacggtcattcgatactgccaagtttgtcgaaaagtatgatctgcaactggtgggtgtgaactggttcctcggtgctggagatggttggaaagagtaagaaggaacggaaatttgagccatgaacagcatagtgtcaattgaagccaatgtgactttgatcaaaaaaaaaaaaanaaaaagcccccta

SEQ ID NO: 61687 - DNA, 518 bp, Triticum aestivum
  Clone ID: PAT_TA_61687
gccggccggttctctcaaaaaaaagcccaaggagtgcaagaagcttttcattgttcacctaactgaaagggagtatttcgctgttccaaggaacttgaagctacttgctgttccactgtttgaactgtatgacaatgttcagcggtatggaccagtgatttccaccatcccgcagcagctgtccaggttccagttcaacatggtgagctcgtaatcagtagtggtgatgagatgtgaagattagtccagtaagatgtattgagatggatcttggacgaagcaccaaactagatgctgatcaacttagcatgactccttatttaggcgccaattttcataaactagatgctcattccgactgtcttttatttggcgatgcatgctgttcatacagctcaggctggttagatacgtggtgtattattatttggatggtaatcggttgttgctccggcgcgctaatctgttcatgtgtatgtacgtacgtacgtagcaatgcacgtatgtctgtatgattt

SEQ ID NO: 61688 - DNA, 706 bp, Triticum aestivum
  Clone ID: PAT_TA_61688
gccggcccggtcctccgaaaaaaaaaaaaaaaaaaaaaaaaaattaaaaaaaaaaaaaaaaaaaaacgcctgccaaatctccggttacgcgctgggcgtcgccggttggggcctggggctgaagctgggcagcgagtccaagggcctcacctacagcacccaccgcaacatcggcatcgccatcttctgcctggccacgctccaggtcttcgcgctcttcctcaggccaaacaaaaaaaacaagtaccgggggtactggaatgcctaccaccactccgtcggttactccgtcatcgtcctcgccgccgtcaacatcttcaagggcctcaacatcctcaagccggtgacgggctgaaaaacaagctacatcgtcatcctcgccacgctcgccggggtcgcgctcgtcctcgaggccatcacctgggccatcgtcctccgccggcgcaagcgcaaccaggcccacgggggcgccaacgggaccggcgtgcagctatgagcgtcgggatcggatcggatcggcgtgcagttttgatgctgcgacgtgtttgagcgatgaactccatgtttttatctttcgaattgcttcttctgaagaagacctttctttttcttcttcttcgacttctttgggggccattgtatacattctttcttcgagctgaggtatgattattttcatttaaaaaaaaaaaaaaaaaggccccta

SEQ ID NO: 61689 - DNA, 671 bp, Triticum aestivum
  Clone ID: PAT_TA_61689
gccggccggtcaccatcttcagcatccctgctgctcccgcggcacaggcccctaagcctgccggcttccagcaatctggccccaactacttcagtcctgtccaggcacaggcatccaagcccacaacgtctgccttttctggcatgggcacttccaatgctgctcccagcactcccactaccatggccaacatgaagcccgttactagctcctcagccaagccagctgctgctggcggagacgcctttggagctctatggggcaaggccagtggtggcgtcaagaagcctgagacgcctaaggctggacctgcactgggccagctcgccaaggagaagagcagtgctggaatctggggtgcaccggcagctggatcctctagtggcagtgctcctcccaagactggtggctctgctatggacgacctcctgggctaagctaacccactagtctagtcgacatgtttaagcataagtggattgtaagctgggatcgagattcgatgcattaaagtcatgtttagttggtggccttgagaatgtgcagaataatcagcaacggggtagcatgtttgttttcatgataggatcctagataggcgtctggcgcaacaaaatgaactgacatgccatgtcgttctattttcaaaaaaaaaaaaaaaaaggccccta

SEQ ID NO: 61690 - DNA, 765 bp, Triticum aestivum
  unsure (1)..(765): unsure at all n locations
  Clone ID: PAT_TA_61690
gccggccgggttcccccctgtctccagattacaccgcgctctcttcctcccttgcccatcgccgagacgaagcgccgcacgccgttccgttccatcccaccagccaagagttcgtccgtcccggctggattgttggatcgatggccgccatgaaggtggtgctgaagctggacctgcacgacgacaagcagaagcagaaggcgctcaagctcgtctccagtctccacggtatcgaccagatcgccgtcgacaccaaggacgacaagatgacggtggtgggcaccgtcgaccccgtccacatcgtcggcaagctgcgcagcaagctcttccgcacggcgcagatcctctccgtcggcccggccaaggaggacaagaaagacgacgccaagaaggacgacggcaagaaggagccgacccctgtgtacccgccgtggtacccgccgccgccgccgtaccactaccactcgcacccgtactaccacggccacagcgccgaggaggatcccagctcctgcgtcatctgctgaccgagtgcacgttcagtagctcgccgtcctgcctgccgatcgatcggcttacctgcaccggtgatggacggcgttcgttatatacatgacatgaccgtgtaggcgtgtacgttgcgccggtgatccggcagctgtgcatctggttatgcttagtttgtaacgtgtacatacagaattacagtatattgttcagaaaaaaaagcatcanattgtaaaaaaaaaaaaaaaaaggccccta

SEQ ID NO: 61691 - DNA, 852 bp, Triticum aestivum
  Clone ID: PAT_TA_61691
gccggccgggttccggaccatcccaaagcttacggctctgctgccgtcgcctttgctttcacaaccggtatcctcgtcactctgggcttcaaggacttttatccagatcttgagcgcaggttccagcgcaagaggcgcgcaaataccggcggcgggagaagatctagtgtcttctggggtgaccccgtggaactcgaggaccatgaatctctaccttcgtcgccaactttctacgatggcgcacgaaatggcttggctgatgggatagaagccaccatcggaaacactcctcttatcaaagtacaatctttatctgaagctacagggcggactatcatggcaaaggctgagttccttaacggtgctggaaactcccccaaggatcatgtggcgcttaacatgattcgtgaggcagaagctcaaggtcttctcacaccacacaagggcgatactatctatgaaggaacagttggaagtacaggtatctctctggcaactcttgcgcacgccatgggctacagggctcatatctgcatgcccagcgacatggctcttgagaaatccgacctactacttcatctcggcgcaacggtcgagcgagttacgcctgcgcctattaccagttccgatcacttcgtcaaccttgcgcgacgaagggcggaggaacacgctagcaaggccaacgatggcagcaagggattctttgcgaatcagttcgagtccgaagctaactggaaagcgcacttcaacaccacgggccctgagatttggggacagacgaacggtgaactggatgctttttgtggcgggtgcaggcacaggaggaacagtatcaggcgtcgcaagtatctc

SEQ ID NO: 61692 - DNA, 579 bp, Triticum aestivum
  Clone ID: PAT_TA_61692
gccggccgggtttcgaaaacctctcaacgaccgaccttgaagagacgagccgcagccatgtcgtcgaccaagaagccctccggcaagactcagcgctccgccattgcggatgtcgtcgcccgcgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggacaaggttctagggtggcatggcatttggagttgtactcggcattctggctttcgacgctgaaaaatacacagagggaaaatgtgattaaaaaaaaaaaaaaataaaaaaaaaaaaaaaaaaggccccta

SEQ ID NO: 61693 - DNA, 545 bp, Triticum aestivum
  unsure (1)..(545): unsure at all n locations
  Clone ID: PAT_TA_61693
gccggccgggctccggagaccaggcaacactagcagaccagaggactggtgaggaagaagtagtcctagcctattgcttgcgtgcagcagctagataaagatagccagcgatggtgtacgaggcagcagaggccgttgttcacaggggcgcgggaaaaggtggcggtgcgagaaaaagaagccaagagcagaagtatcaggtgcacaaggagagcaagctaagatggaggaggattgttctctggatcgtcaggaaggttcacccggcaccttgaagaaataaattcaagcgcatatgtgcagtggcgtctcatagatacctcaagttatgatgggaggttattatgcatatatttatttatccaagtaacgtagatcctggcgtacggtgatttcagcactgtactttgggaagtgtatcatatacttgattttttttttccgagtcatatcatagttgagtttttcaaaaaaaaaaaaaataanaaaaaaaaaaaaaaaaaaaaaaaaaaaaaaaagaaaaaaaaaaaaaaaaaaggccccta

SEQ ID NO: 61694 - DNA, 351 bp, Triticum aestivum
  unsure (1)..(351): unsure at all n locations
  Clone ID: PAT_TA_61694
gccggccgggctcgggcttcaacccaaaagcctgctctacatgcacaattacccnttttcggattacaaatatattacaggaaataatgtcagttgatttataaggggtttacaatttatttatttttttaaaaggaggatcacccctggcatgtgcataagtggtttacatacgaaatgagtttacataatgcttttcagctttaagaaatgtatgtattttgcaaatcgaaatattattgtcattcattagcccctctaaagtttgaggcaaatgaacaaaaaaaaaaaaaaaaaaaaaaaaaaaaaaaaaaaaaaaaaaaagaaaaaaaaaaaaaaaaaaggccccta

SEQ ID NO: 61695 - DNA, 269 bp, Triticum aestivum
  Clone ID: PAT_TA_61695
gccggccgggttccgccacgagcagcctcatggattaagtgcacggacctaaacaaatccctatatttagggtacaattattcttttaaatttcttgttttttattttcctttgattctgactattatttatttggacatgtgattcctattcctttttgtgatctatatatatagcaggccggtaccaaagaaattgattatagactgtaaaagggcttatattgaataaacatgatatgataaaaaaaaaaaaaaaaaaggccccta

SEQ ID NO: 61696 - DNA, 448 bp, Triticum aestivum
  Clone ID: PAT_TA_61696
gccggccgggttctgggaaaaacctacaagagcttcacccccccagcgccgccaccgacgccaccttcaaccgaggtcgacatcccccgccctcctgcgggaggcatggccactgacctgaatctacacgccgccgatgatgtctataatattttctcgtccatgccatacaccaggtgcagtaccgaatcggcatcaccctctactcataccaccggaacaatctccagaaggagtgatcggatctggtgaaagctcgccagcacaaccatctcagggatcacacgggcgcagctcggatgccctgcaatgagctcatcatgatgaactagcaagcagccctgtggacaggcaccaacagctgcagataactgtttgcaagcaggtgcacaagaggcgtaatccggacctaagtcatcctcctgggcacaccactcccatgagatgc

SEQ ID NO: 61697 - DNA, 864 bp, Triticum aestivum
  unsure (1)..(864): unsure at all n locations
  Clone ID: PAT_TA_61697
gccggccgggtctcgatgtcatgacccgacccaccaccttctaccagtttgcttccactggtgccaacggtgcttctcttgagcagattcacaacgccattcactgggatgcttcttgtgctggtcagttcctcgccaccgagttctctggtttcgacgctctcttctggctccaccacgtccaggtcgatcgtctctgggcctactggcaggctatgcaccctacccagtcttctttcactggctcctactccggtggctctcgatactccactccccagggcacccgcatcacccagaactctcctctccagcctttctaccgatccaagggtaacttccacacctccgagactgttaagagcatccagagcttcggttacacctacgctggacttgagtactggcacatgtcccagagccagctctccagctctgctcgatccaccatcaaccgtctttacggatcaagctccaacaagcgtggcctcgaggagcgtgctgatggcaccaccacccgttacttcgtcaacgtccagctcgacgttaccgaggttgagcgtcccgctcaggtcaacgtctacatctccggaaagcttgttggtggtctcgtcgtcatgcgacagcctgctgagggtatcgtccacggttctttctctgccgatcaggctgccgacacccctcagcttcttgcttcttgctctcctgacaaggttgccgatgctgtcaancaagggtatccaggtcgagatcgtcaagcttaacggcaacaagatcgacctcaagggcgtccccagcttgaaggtcagtcttgacgacgttgcttacactcctcctgctgctgaggacgacctccccatctac

SEQ ID NO: 61698 - DNA, 610 bp, Triticum aestivum
  unsure (1)..(610): unsure at all n locations
  Clone ID: PAT_TA_61698
gccggccgggtcccgnacacacttcaagcaaggtcattcatccataccgtacgtaccgcaggtgtactcagagactcaaaaattaaaccaggaagatttctatggggtcgtcggcgacgatgacgagggcggtggtggtggccgtgctgctggtccagtgctgcaacgtggttctcgcggcgaggctgctcgagggagaccgcggttggctgcacggcggcgttggcgccgccggggcgcttatcatgcaggtcctgcccagcggcacccccggagcgggaacacccaacggctgcaccaacaaccccaaccatccccccggcgggccatgcaacggcggccgctaagccgccggcggagctcgactagtcaattggcatgcatgtgcgtgacgcacgtacatgcgtagatagagatcatctctttttcgtctggtttgattaattctttgtccactggttctttcattctttttagatgtaattataattattttagggcttccgtgaaaagatggagcccaagaagctgttcaaaattagttagttttagtacatgaatttgcaataaagttgtctctcacgaaaaaaaaaaaaaaaaaaggccccta

SEQ ID NO: 61699 - DNA, 773 bp, Triticum aestivum
  Clone ID: PAT_TA_61699
gccggcccatacctgaacatcactctaatctacaactttcgctacaacacgcctcaaagaactaaacccgaaccacatcgctagcccccgattaatagcttcgaccccaaaagaccaaaacagccttcagaaaggacggcaccaatggcaaggaccgtttcctaggtggctggcatgcggaccagacccctggggcccacgccgatactcccatcgctacatcgcgccgctactaccaacgtcactaggccctttcccgggtcaggctctgggaacccctatgtgtccatttctctaatcacatacccccaccgatcccctcatcatagaacacaccggacatgtggttgcccatacatcatagctcttagatactatgatgattctacattgacactgtctcccatattccctatattacgatactgtgacttactgccttggatcacccagaaacaatcgtgatggtgcaagatgatctataccaggagatagatcgagtgttctacatgctcccctgtatcacaaaatagatcagagccttgagatcgctccacccacataacgactacccgcgtaccgcccttttaaagatctgctatgtccctagggactatcccgcatctgaaaccagtgaatacccctcgctgcccgaatacgatattctcttatcgactcgcgtgaccactcaccagtcacacaataccctcttacgcctataatgacacgaatagaattatgctcactgtgccataacatacaacgataagact

SEQ ID NO: 61700 - DNA, 506 bp, Triticum aestivum
  unsure (1)..(506): unsure at all n locations
  Clone ID: PAT_TA_61700
gccggccgggcttcgnaaaatgcattgaatacaaactcaaaggaatcgagacgcctatggagagatcacgagagaagggcgcgcacgccccttgcccgcgggtcaagggtgcaaacaaaggcgataagagtcatcgcctcgaaaaatcaatgcatgactagtcgatcgaaataaacaatgaatctactgcgaaatgtctctcgaatgaggcccctgaggcccaggatgcgcctctataactagccggatacaccatccttgaaaggattctagatcgagcttatcgatcatcgctcaacctcaaggcgggctccagcacccaattgctgctatagcgatccagattatcagcgagtcacctgacctgagatcttagacgacaagaatgagcaaatcctgcagaacccacacgttcagatcgacttgcaaacaatacccattttgtctcctggaagactaacgaagaggagcacagccatagccactttgaacagctgattgagaag

SEQ ID NO: 61701 - DNA, 768 bp, Triticum aestivum
  Clone ID: PAT_TA_61701
gccggccgggttcgggaaaatccattccaagtttgcagccacaaaccattccagctccaccacgcggtcaaccgagggaacaacacatccggatccgaaatctcccagcctcccactgctccgtcgcggctcatccccgtcgatcgaccttgcgatcgattccgtttcttgccgcgcgcgcgcgcacagcacatccatggccgtcgccggaggaggagtggtgctgagcctgcgcggcccgtcggcctcggcggggcggctgcgtagggtgtcgtcgtcgccggcggtgaggtgcggggcgacgcgggaaaggatgccggcggcgcccccgtacggggtgctggaggaggaccactaccgcactttgaggctgcagccgggcgcctccaggggcgaggtcaagaaggacttccaccgcctcgcgctgcagtaccacccggacgtcgtgcgccggggcggcggggacggacgccaagacgacgccatcgacttcgagcggatcaacgcggcgtaccagacggtgatgcgcaacatgcaggaggcggaggcgacgctcgagtactggcgccgccgctacggcctcgccgacgaggacctcgaccgctaccgccactacctcaacgacgacgaccaggacgactggttctccgacttctgaaatctcaagggccgctttgattcctggcatggcagaggcagcagcgctgtaaataatttgtgaaacgttgctctctgcttctctcctctgggttaattggggaggcgagc

SEQ ID NO: 61702 - DNA, 385 bp, Triticum aestivum
  Clone ID: PAT_TA_61702
gccggccgggctgcgggaaggccggctacgtcatcatccacggcgccgaggacgtcgtcgccggtaagaactaactaggatcgggctttgcaatcgtcggcaggcaggcagaggattcgggttgcataattacatggaattgtggagtactcttatactatattcccacctatgattcgtgttgcgcctgtctaccgttctctatgtgtgtgtgtgtgtgtggttggggaggacaaattgtgaagaatgtgattcctatctgttcttacatatatatatctatatatatggtaaatttcatgccgaaacatgattatgtatccatccttaagcatgaaacttgttcgtttctgctgcctaaaaaaaaaaaaaaaaaaggccccta

SEQ ID NO: 61703 - DNA, 764 bp, Triticum aestivum
  unsure (1)..(764): unsure at all n locations
  Clone ID: PAT_TA_61703
gccggccgggtctcgactcaattgctcagaattatctgtcgctcaccttgaccaactttgttaaacacgatatcttcacctttcgtataccacttgatctttcaacatgtcgactgacaagatcaccttcctcaccaactggcacgctacgccttaccacgccccgctgtacctggcccaagccaagggatacttcaaggaggagggaatcaaggttgctcttcttgagcccaacgatcctagtgatgtcactgagattatcggaactggcaaggtcgaccttggtttcaaggccatgattcacactctggctgccaaggctcgaaacttccctgtccaatccatcggcagtcttctcgacgagcccttcacgggagtcgtctacctcaaggactcgggcatcaccaccgacttccgcaccctcaagggtaagcgcatcggctatgtcggcgagtttggcaagatccagattgacgaactcacctcgcactacggcatgacccccgaggactacaccgctgtgcgctgcggtatgaatgtctccaaggccatcatcaaaggcgagattgacgccggtatcggcctggagaatgtccagatggttgagctcgaggagtggctcgctgctcagggtcgtcccaaggatgatgtccagatgctgcgcatcgatgaacttgccgagcttggttgctgctgcttctgcaccatcctctacatcggaaacgagaccttcctgtccgagaacccgaannagtccgctcgtt

SEQ ID NO: 61704 - DNA, 503 bp, Triticum aestivum
  Clone ID: PAT_TA_61704
gccggccgggtttcggtattaccaagaatggtatcaccaagctgggtgcccccccccctctggaccttgagaagtacgagaccgacaagaggatcgaggacgaggagattctcaagatcctggagcagcccattgcccgaaacactggtaagaagaagagcaagcctaagaagaagactgccaagaaggagggcgacgaagagtaaggtatgcggcatgaaaagatgtgtcgaagaggtgcggaaagaccaaggacccgaggacgggtgaagccagaagcgcgagtcaagaaggatgtatatcggcagtttaggccaacgacttttccaccattggatgggccatacacatgaaggaaagcgtcttcataggaaaactgttggaaggctgaaagggacgactggaatcgccaaacccgacaccgcccggtttgatcaggtggtgtggagcgaccagaaatatatagaaatcccacacaaaaaaaaaaaaaaaaaaggccccta

SEQ ID NO: 61705 - DNA, 855 bp, Triticum aestivum
  unsure (1)..(855): unsure at all n locations
  Clone ID: PAT_TA_61705
gccggccgggctgcgatcatacttcgaggacgacagctcaatttcccgtccaattgaccagcgatagtgctcaagcctgaaaggcactgctgtccaaaatgagcagggcacttttccgctccatgctggagcttcgagctcccagcgcccgacttttggccccctcatctctactgccgattcgaactcgcgcgttcaacaccacagcgcccatcatcgagcaatcgttccctgagcgtcacccaaagaatgccaccaaccccacggccaatcagcctcgacctctcgctctcaaagtcagccatcctactcctcctccaaagcccatggaggactctgtcaagacccttctaccatttctggccgctcaaccggatcattatatcaccgttcatgtccatggattcccttaccttgtccgggagggtgatcaggtccgcctgcctttccgcatgcccggtgttcagcccggcgatatcctacggctcaaccgtgccagcgtcctcggtagcagagattataccatgaagggcgctcctcatatcgatgagcgagtttttgagtgcagggctacagttattggaacagaatctgagcctctacgtatcaagatcaagaagaagagacggcagcgaagaatgagacaggccaagagcaagcaccgatacancaattctacggatctcggagctaaacatcancaacggagaggatatcgaatgaggatgagatggagaatgaaagttcaactggaaagacgntggtgtacatgtaaaaacaaaaaaggaaacgccatggaacgatgtaccatttaccagctcagagctggctggtacataatacagcaattttgca

SEQ ID NO: 61706 - DNA, 306 bp, Triticum aestivum
  Clone ID: PAT_TA_61706
gccggccgggctcggtgcccctgggaggcagccagaacgactctgctgtctttgaaccgctgagaagctgggcattacctttgttgagcagaacattcgtctgttccaccactaagcgatacctgatgagagaatttgttttttgttgatttttgatatgaaaatggaaccggaaaagtaaagacctggcttgcagaacttggcatggaaaagagggattcccagaaattgtaatctttatgattgcgatgttgtatatatatgacagatttaacgccggaaaaaaaaaaaaaaaaaaggccccta

SEQ ID NO: 61707 - DNA, 443 bp, Triticum aestivum
  Clone ID: PAT_TA_61707
gccggccgggctggatcccctgaaagctctgaaccgtgaagcatatcaagaggggaaaacagcaaacaggaggcatgaggaggaacactctcctcgcccttgcgtcctggctcatgctgcttgcactcttcatcacaaccgccactgcttcactgccgtgccagtgttgctggatcgtggagcatccgaggaggacctgcggccacgcctgctgcggcgacaactgctgcccgcccgctccaccgccatccgcaggctgaaaaaggatgcacaggcttgttcatcggtaatacagaagtaaaaatataaaaagaaaataatcagagggaatgatgttgtgctcatacctacctgctcttctgtgagcatgtaatagtctctgttactttccagcaataaacatcccttggctcctacaaaaaaaaaaaaaaaaaaggccccta

SEQ ID NO: 61708 - DNA, 584 bp, Triticum aestivum
  Clone ID: PAT_TA_61708
gccggccgggtttccgtcagattgtcccatctttgatactttagctgggaaattgttggctgtagcagacaaatatgagttgccaaggctaagagtgttatgtgaatcttacttgtgcaaacagatttctgtaaaatctgtggcaactactctagcgctggctgatcggcatcatgctacagagctcaagtccgtctgcctaaaatttgctgctgagaacctttcagatgcccttatgtatctgcagctgtaatccggaccgacggattcgattacctcaaagacaactgcccggcgctgcagtcggagatcctccggacggtagccgggtgcgaggaggaatgcagcagcggcggcaagagccagagcgtgtggggccagatctcggacggcggcgacaccagcgggcgcagggtgaggcccagggtctaacgccgccaccgccagcaagcactgacctgtatgtgttagcgacctgccgctgctgtataaattcgtaacagccatttgatgttgtgacagatcttcttgtaataataatagcatccgctctgttgtaaaaaaaaaaaaaaaaaaggccccta

SEQ ID NO: 61709 - DNA, 453 bp, Triticum aestivum
  Clone ID: PAT_TA_61709
gccggccgggtttcgacatcaagtctgacacagcgcaagtcgttagcttgtcgaatactgaatatcatcggccgttcatcagttcggagaagatcgggttcgatttagtcgcggaaccaccatgagctccactgaggtcgccagcggtgagtgcaagaagatgtcgtggccggaggtggtcgggctgaccatcaaggaggccaaggagatcatcctcaaggacaagcctgacgcagacatcatcgtgccggttggctcagcggtgactgaagacttcaggccgaaccgcgtccgcatcttcgtcggcactgtcgccgagaccccccacgttcgctagttggattgcccttacttcccgtggccggcatagatgctggctcatgaataaatcagtaatggaggaataaaactgtgaactgtgaagtcgaaaaaaaaaaaaaaaaaaggccccta

SEQ ID NO: 61710 - DNA, 731 bp, Triticum aestivum
  unsure (1)..(731): unsure at all n locations
  Clone ID: PAT_TA_61710
gccggccgggttccgattcagcaacagaagttcttccgtgtcacggaacatacaccaaacccagcctacgagagcgaccaaggagcggggagagcgtgcacgaccatggaagccgaggccttcccgatacggttcaccaagggcatacggtcctactggcgccggagcaagtaccagcgcgtggacggcgccacggcgggccggggcacgcgccacctggtgcggctcggggacggcggcagcagcgacggcaaggcgtggggcgtgcggctcggcggcatgttccgggtgcgcgtcaaggcgccggcctcggccgtggccgcggcgaaggccccgaagcgcgtgcttggccggataagggacgcgtacgtggacgccatgctcggcgcggccaagaagcactcggcggcgacgcacacgctgccgaacgggccgaccccggaggcgctgtggcagaagcgggtgcccgtgcgccggtcgcgcagccaggcgcaggtgcggcagaaggcggacgagctgggccagaggctcgtcctcgagatgtacaagtccgtgcgcgcgtccagggacctcgcgggcatgctcgaagcttcaagggcgcgatagcatggatgcactgcaccagcgacttggaggaaggcgaatgatgtgttagtgttacacatatgcttgtatatgtaagatcagntggtgatatgtaatctggtcataccatggggctttgctctgct

SEQ ID NO: 61711 - DNA, 609 bp, Triticum aestivum
  Clone ID: PAT_TA_61711
gccggccgggtctcgataagcttggtcgcatttgtcttgacgttcttaagaaaactggtctcccgcccttcagatccgaactatccttctctcgatccaagctcttctcggtgcccctaaccccgacgatcccctcgctgccgatgttgccaagagttggaaggaggacgaacaggcggctatcgctaccgccaaggagtggactgcccagtacgcgaagccttgaaggaagtgtgaagcaataagaaataattacaaaaaaaaaaaaaggaatcaagacttggacggactcgtatcaccaggttagaaatacaaatgctggagttcggggctaactgatgtctcaatggagaaccttcctgtcgacttttggctggatacaagagtacttgtaggtttgtgcttggcgttgtcttgcagaactgagagtttttcgtttgtgcaaagcatacacaatgattttctggtatggagtttcgtgattgatgagacagcattgtggccttactgaaatgtccttttttattgttgaacttcggttacactacggttagaagcattactgtttttcaccaagaaagataaaaaaaaaaaaaaaaaaggccccta

SEQ ID NO: 61712 - DNA, 542 bp, Triticum aestivum
  Clone ID: PAT_TA_61712
gccggccgggttcgaaatcggcacaagagaaatctagtactaagtagaagaacaaacgtgaaggttagagaggatcggttccatgggagacggtaagaaatccagccccggtttctggtcggtggtggggtcttggtttgcttgctttcgtcgcccagctaagggcaaggtggcgagcgccggcggccggaccaccacgtatgaatatggtccagccgacgggatggtggcggcggccagacatttctccagtgctcacaaaataaactttggatgattcatgccatgtctgtgttgggaatagttttgtggtctacccatatccctcaacgcttatccatggtatagcttatagttcgcaaatcagaggctaaggataggtactttcttatattgtcttttcaaaaagttcacctcttatacaaataagattcataatatttttaactatttttcaggatagactcaagatcaaattaccaatcacgatcaaatttgtctgttaacggattcaaataaaaaaagcaataaaaaggccccta

SEQ ID NO: 61713 - DNA, 749 bp, Triticum aestivum
  unsure (1)..(749): unsure at all n locations
  Clone ID: PAT_TA_61713
gccggcccgggtctcgtcacattgggatcaagatgccttctccaattgttgccgctacggtccaggcggcgggcctgtcgacagcttctaatatcatggcccagatgattgaggcccgccaagccaatcgcccaatgtccctagacataatccagctcctccgctttgttgtcctcactttaatgactgcccctcccaactatcactggcaagcctttctagagcgcaagttcccggcttatcctgtcagtaaaaggcccaacctcgatcgtctgaatgacctcgagatgcagcctagccaagacgcacctgagctcaaggagggctacgaggaacgtttgacacagatcaacaaagatagagagcccgagttcagtacgcgtaacaccttgaccaagtggtttgttgattgtatcactgcgggtgccatcatgaacacggtcgcgtttctggtaatcatgggtctgctcaagggacaaggcggctctcaaatctggagcaacatcaggacggaaacgattcccatcattgttgctgggtacaaaatctggccaattgcatccatcatcagcttcacttttattccggttcaccgacgcattgtattcctgagctttattggtcttttatggggtatctacatgagtctagtggctgctagagtttanagagtggcatgtacattctagtttgaaaatgggatatcatgtacaacaagaaaataaaaaaaaaaaaaaaaaggcccccta

SEQ ID NO: 61714 - DNA, 523 bp, Triticum aestivum
  unsure (1)..(523): unsure at all n locations
  Clone ID: PAT_TA_61714
gccggccgggctcccgaccttcaacaaaatacatccacctatcatccccttaatttgcagcaacaaacagcttgtgtaaggagaaaccaaggctagctatggcgtccaaaactcagctcttactttacctgctcgttgcattcttcttcttcttccttgtggcttctcaggttgatgctggtagaaaactagctgatgattacacaggacttccacctattccaccttcctacggcggcataccaccaccagcaccacgaccctaggccggagtttgcatcgtatgatggaggggtttacaattatacacatacatatacatatctgaaaaataatgtctgagtatatatatcgggtacggccaaacatatacatataaactcctactacaaataaacaatatgtactacatgggtatgtcaacacatgtattgtacctgctatgtatgtacctacatgttaagaaaacatatgtacttctccataanaaaaaaaagaaaaaaaaaaaaaaaaaaggccccta

SEQ ID NO: 61715 - DNA, 834 bp, Triticum aestivum
  unsure (1)..(834): unsure at all n locations
  Clone ID: PAT_TA_61715
gccggcctggctgcgaccaaacctgcaccaaacccgaaacaggccaggactccacgagtcaagtcagccacctgccagccagccagccttcaacgctcacccaccccgccacgaccacgaccatgtcctcctcctcctcctcgtccatgggcgcgctcgccgcggccaccgccatggcgctctccggttccctcgtcctcttctccctccgccgcttcgccaagcccagcctcgacgacgacgcccctgcttcggacgaccccgcgtcccttcgtccatgcctctcctcctcctcctcctccccaggtaggccggtgctgatctcgtgacgcttcttcttcttcttcttctctgtgcacgggatcctgatggagctttcttgattcttggcgtaacagagaagcggcagcgcggcgggaagctgcggcggaagggggagaagcgggtgcgcttcgcggagggcgtcatcgacaatgagggcgcgccccccgcggccaggtcctcctcctcgcccccgccggcgccggcagcggccgagccgacgtgcaggggaagcgtgacgggatcggaccaccggatgccggcgaaccgggaggcgctgtaccgcggcatgctccgcgatcgctccgtgcacaggaccgcctactcctactgaccggccaccgaccggtcgacccgacgcccgcccgccgccgtgcccgattagttaccagagctagattagcctagcccgtccatcccccgtcccctgcttttgcctggtcctgttgcttcttttctgggnnttctgctgtgccgttggtgtctggttgctttggcatttggcagcacgct

SEQ ID NO: 61716 - DNA, 637 bp, Triticum aestivum
  Clone ID: PAT_TA_61716
gccggccgggtctcgatataaccgacactagcaaaaaagcgtgccgcaccttcatcgacagggacagcttgtggaactgggagaaattacgtgacgccaccgacactgggacaccaggatcaactcctcagcgataacgacgtgatgaacaggtacaacttctggatggagtgcgctccttataccgactacgtggcgataacaactttctaggctgagattgaccctgccgcggcgctatcatcaacaacgacacactctgcatcgtgactgctgaagtcgtgccgtagaagcactgccacatgaccagaccgtacgacacaccatttctccgccgcgctcttgaagctcaacagcatgctcgacgcctgcacgttcatgaagatcatgtcagatcctcatcgaccaggtcttgaccatctgccgaacgcataaggtacctaggcgcgcgtccggtccagaactacgggatcccgatccgtcgaggaactgcacacctgcttgatgtgtacggactacattctacgtaccagccggttatccaaatcaaccgaaatagaattttaccatgccagctctgtgtaccgccgtgtaccatctgatgactgcaaaaattctgtaatataccctgcttatt

SEQ ID NO: 61717 - DNA, 502 bp, Triticum aestivum
  Clone ID: PAT_TA_61717
gccggccgggctcgcgactgcacagcgccagcgcgagagaccgaccagaaagtagaaacccccggccggaaggagatgagctactacggccagcagcaggcgcccgtcggcgccccgccgcagcaaggttacccgccgcaggggtaccctccggccggctacccgccgccacagcagggctacccgccggcaggatacggccagcagggctacccgccccagcagcagcagcagaacagcgggccttccttcatgcaaggatgcctggccgcgctttgctgctgttgtctcttggacgcctgcttctgagaacagagaccaaagttccatcctcacgcgtgttggaactgatcaattgtgccgtgttaccgaaatgctactagcctacatgttttgggccctatcgcatttttctaccccttgtttgtaaacttcacattgggatcaattatttggttggtttggatgtgatgactaaaaaaaaaaaaaaaaaaggccccta

SEQ ID NO: 61718 - DNA, 533 bp, Triticum aestivum
  Clone ID: PAT_TA_61718
gccggccgggctgggatatcctccgtcagatacctcttccttgactctaatcatcttctgatctgttgagaatatgtcgctaagctacgatgacgggaagctgatagctctcgccgcctctcgcaagcacacctgccagaactgccatcatcacttcaaggacccccacatctctaaaggccttgacatggatctttcagatccacacatgcgacgctactttgacaacaattgaaaactattacacagaaaacggacgaaggaaatggctgcttatacttgacttcatgagtgcgaccacacgcagagatctcctagccatgcgttactgatctaaccaaaagcactacctatcacttagctgactatcgagctaaaagactaagctatatcactacctatacattaactactgatcaaggtaatagctatacgcctgctgtcattatgcatttaaggggactctatatccgacgatcgtctatctgtgccgcctggtcagatgagaaatctctatcgtaattatgcataag

SEQ ID NO: 61719 - DNA, 800 bp, Triticum aestivum
  unsure (1)..(800): unsure at all n locations
  Clone ID: PAT_TA_61719
gccnggcccgggtcgcggaaaaaaaaacaacccaacaaaagaatgctactacacaagcaagccactcccacctctaccagctttaccaagctcaacatgctttgactcgacaaaaagcgacacctcttcaacttcttcggcttcctttatcttcgcctctggacaagcatacaaacaaataaaggcctacgataagagtctcagaccacaagacgttgttcgagagacggtgcaacaaaaagtccatagctggctctcccaacttcctttccgaccagaaatcgccgaatgttatcgaaggcagactatgcacagttggcagaaatggcctacaaaacacaagcggaatcagaaatcggaacctcctatcattatcaatagcccgcgaatgtcagaagacaccaccatcgcagcgacagacgacggcgaaacacaaaacggcgagagggacagccatgaagctttcagaaaacctcatattggacacgatcgacgaaggtctcttgatagctatcattcagcattgttacacatggagaagccgtttgctaactacacctccaaattctgcccgacgctgcgacgaaagtatcctagaggcttggaagatgaggctcgcttgggaataggagttgcgttcgtgacagcaaaatttgaggcctgatacgcctagctcggttgtgcactccaatgcatatgttgagcggcattgatcgcacggatacttcatttttctcacatcaacgagacacgtcttatgtttttttaagtagattttcaatgatatcttgtttcgggca

SEQ ID NO: 61720 - DNA, 699 bp, Triticum aestivum
  unsure (1)..(699): unsure at all n locations
  Clone ID: PAT_TA_61720
gccggccgggttccgactgatctccccacctcttccccccgccaagagcagcagtgaactgtgaatctagctctgaagcagctcaagatcgggcttgctagaagaagccattcgcccattcctagtctcttcccagccatacaggctacagcaataccatggcggcaccagtagcatgcgccttcttcttcgacgccgagccggtgggcgagcccggcatgccggcgctggacgcttgcgcgctctgcgccaagtcgctggcgcgcgacagcgacgtcttcatgtacagaggggacacgcccttctgcagcaaggagtgccggcacgagcagatgcagctcgacgccgtctccgccaggcaggccacccggaggctgcagcggttctcggcgggagcagagtccgggcgtgcacaaccagggnggtgtccgtgtcgagctaaccggcgagagtgcctgacaaagaaaggttattatgcttgagccaacatgatctccgtgcaccgagccgctggtgtccgtagctagctgatcgagcagcacgagatcgaggagacttgcctagcaaggggncgggtcgctggagtcgctcacggcgggtcagcgctgcatgtgccgccggtcaagtgatttggacataaacactgcagaaaaggggctgaatcagatctgaacaaagccaagcaaacaagattcccca

SEQ ID NO: 61721 - DNA, 716 bp, Triticum aestivum
  unsure (1)..(716): unsure at all n locations
  Clone ID: PAT_TA_61721
gccggccgggtcggggaactagaagggatggcgcctatgaaggtgtacggttgggcggtgtcgccatggatggcccgggtcctcgtctgcttggaggaggccggcgccgagtatgagatcgtgcccatgagcaggagcggcggcgatcaccggcagccggaccacctcgccagaaaccccttcggtgagatcccggtgttggaggatggcgacttgacgctttacctcaggtaattgacaccaaagttatgaattagccaggggagcacatcaaacgtaccagttaccaggttgcacacggcgaagagttctctgttgaacacaacagagcggacgccgacgctgtgcacgtcaaggcgcacgaggaggaggccgtggcgcgagacaaggggcaccgcgtggtcgaagaagccaggattgtctaggntcggggaagaaggagttcagagatcggcattgagagccccagaccggtcgtggcgctgggaccctctacggggccgtcgctggacgaaacagcctcggaaaggggccgagcggcacgcgtcctccggcaggcagcggncggaggaaggaggggtcggcaaatacgaggctgcgccaccccttgcacgccgtggcgcagcgnaagagagtggccacgtccttgacgcgttcgaagatccggaggaccacgtcgtacgggagggacgccgccgtcgcctcggccatgtttc

SEQ ID NO: 61722 - DNA, 881 bp, Triticum aestivum
  unsure (1)..(881): unsure at all n locations
  Clone ID: PAT_TA_61722
gccggccgggcttcacaacacggcaacttacaagccagagtgcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtnaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccanttgcggttttgtcaacttctgacattgctttgggttttccttctccatttatctttcttgtttgttcctaagaatatgtgtatgtccatgttcatgtaccaacatgtctcgagaaagcatgctcgtatgtgaatgcaatcggtggctatgtatatgcacatgcacataatatatttatacnatctgtcgactatgtattcnggtaaaaaagaaaaaaaaaaaaaaaaaggcccct

SEQ ID NO: 61723 - DNA, 228 bp, Triticum aestivum
  Clone ID: PAT_TA_61723
gccggccgggctgggatctatcgccggtccaaccggccggtgatgttgtatcgtgtccatggtcgtagtgaggtcgtcgggcgtctcgtcgccgtttagtttcgccggagttcgttttggcgccatcttttttatttcccatgcgtcggtccactgttttcttcttggatggaataaataacaaaaggaaactagctgtaagaaaaaaaaaaaaaaaaaaggccccta

SEQ ID NO: 61724 - DNA, 841 bp, Triticum aestivum
  unsure (1)..(841): unsure at all n locations
  Clone ID: PAT_TA_61724
gtgcggccctcgaggcggcgggttcgacacccagcccccacagnccacaaccgagtcacctgtccactccactccacatccaaaatggctgccgtgacgttcgaagaggaggtctccaggcaggctgcgcgcgcagcggccatctcgccggcgctggtgaggacggccgtgggggcactggcacgcagcagggccgcccgcgccgctgctgatgccctgttccatctcttcgccggcaccatcagcgtcgtcttcgccgcaacattcctctgcctcgtcgtgttccgggcctgcgtcgggaactgcaccgtggccttggtagtttgggagatcttggtttattctggtatgctctccctgcttctcatggcgccagcgatggtgctcttcttcctgcgcgccgccggcagcggcagcgggntactcgtcgcccctcccgtgtcccgccccgcgaacccagtgtcgcttatgatgtgattgccaaatgttgtagatcaaggatgatgtggatggtcgcgtccgtcggtggccgctaatctgggacgcggctgtggcgttcttccacctggcggccttggtgggactcatcgggctcgttcttctaatctgtggcgcgtttcaagaggtttcttaccttctccgcactgcggctgtgatgtgcaagctcctactcaccgtcctcttctccatccgtgctgctgtggcgctgtggaggatgaatcctcgacagccggccgcagttgctgttgcggtagtgtgatgactgtacggagtagtaatctatctagtagtaactactagtagtaggcttgcttcaatgctaggtcagtgctgctgatgc

SEQ ID NO: 61725 - DNA, 440 bp, Triticum aestivum
  unsure (1)..(440): unsure at all n locations
  Clone ID: PAT_TA_61725
gccggccgggtccggatctgcaacacacaccaacagacagttccgcaagaaagagcagagcatcacgtagccttagcaggcgacagagagagagagagagaacgaagtgtctttagccacctagcaacacaccaccccccgtacgcacgcatggcgcgctgggccattgccatccacggcggcgctggcgtggaccccaacctgccggaacaccgccaggaggagggcaagcgcgtgctggcccggtgcctgcaggttggggtcgacctgctgcgcgccggcgccacggcgctggacgtggtggaggccgtggtgcgagagctggagacggacccctgctttttctcgggccgcggctccgcggtcacccgcgccggcaccgtggagatggaggccagcttcctggacggacgcggncgccgctgcggtgccgccctctc

SEQ ID NO: 61726 - DNA, 560 bp, Triticum aestivum
  Clone ID: PAT_TA_61726
gccggccgggttccggaaaaagaaaccacagcgctcgccggtgctccaggtctccaagctcgaggcgatcgaccgatctgacatattcttattcatcgccatggcatggaggaagaagaacggcggcgagtcgttttcgcccggcgcctcgccgtgtcgcgacgacgagcaggagaaggtccctagagggcacgtcccgatggtcaccggctgcggcgcgcgcgtggtggtgccggtcaggctgctccgggaccctcgcatcgctgagctcctagacatggcggcgcagcagtacgggtacggccagccgggcgtgctgcggatcccgtgcgacgccgggcatttccgccggatcgtcgacggcgcgctgcacagggccgaataggcgcccggcgtcattagagcatgtgtgaaactgtgaatacatatgcagcagcgccactgtagaagagtatagttcgatatacgaagtctgctctttgattgatcagttcttttgtacatgaacgcaccaggaacgtgacaaatttgtgtgaaaaaaaaaaaaaaaaaggccccta

SEQ ID NO: 61727 - DNA, 433 bp, Triticum aestivum
  Clone ID: PAT_TA_61727
gccggccgggctggggctcaacatccatgactgtatcactctacagggattgtgtacatcctaagattccgcaactcgctgtcatcggatattctgagagctatgcaaatctccacacttctgaactacgggccaagtggctagcacatttcatggatggtggatttaggttaccaagtgttaaagcaatgcatagggatgtcctagaatgggagaagttcatgaagcggtactctcatggcgaattccgtgcatcctgcattggacttctgaataactggtacaaagataacctatgtcgggacatgggatgcaacccaaggaggaagaatgaactttttgttgttttatttgacgtctatggtcccaatgattatattgatcttcaccctaagcgagggtagatcttgaggcatggttctcttgcatgggc

SEQ ID NO: 61728 - DNA, 298 bp, Triticum aestivum
  Clone ID: PAT_TA_61728
tgtgcggcgctcgaggcggccggttcgaaaaaattgttttgaaaacattatgtcaccagatggtttttgtggtatggctgagattgagacctatctgttgcgctttttggttacctatttttagaacggctttttggttatgctggctccagacttcagtggactgaccctttttattagggctaatgtgtattatttgttccaaattcagcaaggatttgcacttcttaaaaaaaaaaaaaaaaaaaaaaaaaaaaaaaaaaaaaaaaaataaaaaaaaaaaaaaaaaaggccccta

SEQ ID NO: 61729 - DNA, 523 bp, Triticum aestivum
  Clone ID: PAT_TA_61729
tgtgcggcgctcgaggcggccggtttcacaactccgatgatgactcttcttcttaccatggctcagatgacggctccgaagacggctccggaagcggcagcggctctggtacacctaccagcggctcgcccttgacacctggatctgcaggaacaccaacagccggcacacccgttgtcacagccggtgctgcagacctctccgcacctttgtcgatgctagtagcagtcggtgctgccgccctctgcgtgctgtaaatcgatacccagtgctggatgagtgtgttttatgtatagacgtaatgttgggaacaattaatcgggatacctgtgccaattgctggaacgattggaagtcccgggatgggcataatcaaatattcatggagttcaggacaggattgccaaaaactctggcagatcattatggaataatgtatcaagtttaaatgtatagaataggtactcacaaaaatacccaataaacttggagagaccaaaaaaaaaaaaaaaaaaggccccta

SEQ ID NO: 61730 - DNA, 428 bp, Triticum aestivum
  unsure (1)..(428): unsure at all n locations
  Clone ID: PAT_TA_61730
ngccggccgggctgccgaaaaaaaaaaaaaaaaaaaaaaaaaaattaaccaaaaaaaaaaaaaaaaaaaaaatctacctcctccgccgtcttctcggtgtcaggactgccgatggtaagcaggccaaggttgctaagctggctaaaaacgaggttatcatggtcaacatcggttccacctctactggtgccaaggttgctgctatcaagaacgatgctgccaagcttgtcttgaccagccccgcctgtaccaacattggcgagaaggttgctctcagccgacgtatcgagaagcattggcgtcttattggttgggctaccattgctgccggtgtcacactcgagcctagcacttcttaaaagattcatgtagaccaacgaaagaattgaacgtaatttccgcaaaaaaaaaaaaaaaaaaggccccta

SEQ ID NO: 61731 - DNA, 455 bp, Triticum aestivum
  Clone ID: PAT_TA_61731
gccggccgggttccacctcattctagccaggcgagagcaataggtagggtttccagttgcaagccgcgccgccgccgccgccgccatgggacactcgaacgtctggaactcgcaccccaagaactacggcgccggatccagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaattatcaacgaactgtggtgcttcatcgaggctgatctttatcctataagctatgtaatgaactactattatgtttgaatcctggtgacaaaaccgtgaaaccatgttagcgactgctgtttgagcatgtgaaaccgataaaaaaaaaaaaaaaaaaggccccta

SEQ ID NO: 61732 - DNA, 582 bp, Triticum aestivum
  unsure (1)..(582): unsure at all n locations
  Clone ID: PAT_TA_61732
ctgtgcggcgctcaggcggcagctccaccagcgacgagntcggccttctcgttactcaagacatgncaagtntgccagnaggcggncgcaaacccaacgatgcagagcaagccgagttccagcgacagctagagattctagtcaaccagcacaagagctatccctcaattacaacctgggtcatctacaacgaagcatggggccagcgggatggntcgcccgagggtgaccttacacaacttgttcgcaagctcgacaaggcgcgactcatcaattctgttagcggatgggacgaccacggntatggcgactttcatgacaaccacaactacgccgcgcctcaatgcggaacacctttctactcccgacccaagacgccatacgaccctgaacgcatcggcatcgctggcgaatacggcggnatcggccataacgtctctattgagcacctttggaacgtcaagcaagcaatcgacagtatccccgaaacatacgagatccacaaagacctcgaatcatacaactatccgatcccggtgtccttgtttcgcagacatcccgtgagccagacctggaacgctt

SEQ ID NO: 61733 - DNA, 294 bp, Triticum aestivum
  Clone ID: PAT_TA_61733
gccggccgggtccgaaaaaacgagagtcgagacgacaatattagggagtttgcagatgagattagggatttaggaatgaggcataaagaattgctccagagaactgaagcaatttgagggaagttgtctcgtttgtcagaaaaagggttgcgaggtgcgactctgagaaagtgtcgtcaccatcatgttgtacacgatctatccgagcccacgctttgtgtctaatagtacagttggtattatatatagtttacaaaactttatttagaaaaaaaaaaaaaaaaaaggccccta

SEQ ID NO: 61734 - DNA, 799 bp, Triticum aestivum
  unsure (1)..(799): unsure at all n locations
  Clone ID: PAT_TA_61734
gccggccgggtcggaaaaagaaacagctcgagctcctccgattccgcccgcctccgttcctccgcatcttcccggccgccgccaagatgaagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagtgtgagaggaaacaacattcggtactacatcctccctgatagcttaaacctggaaacgttgctggttgaggatacccccagggtcaagtctaagaagccaactacagggaagcctatgggtcggggtcgcggacgcggccgtgggcgtggtcggggccgggggcgctgagctttattgttccctgctttggaagctcgtgcagtgcaagtccctacagcgtaacctgcttcctctgcgagctatgtcgagaaatgtttctgttctgttagaagatgtcaatctaagcctccagacttttgaaatgctaagtggcatcctgtgctgttacttgttaccctggaattcttgcccttgtgcttttgcgtagcagtaagttgtgtttgagtagaagctgaccctttttcttctgtggcaatgcttgagattaaactgggctgggggcattggtatttcagattacgcgttgacatattcatctgaatcatgcacatgntgaacatttcttggctgtaaaaaaaaaaaaaaaaggcccctaa

SEQ ID NO: 61735 - DNA, 692 bp, Triticum aestivum
  unsure (1)..(692): unsure at all n locations
  Clone ID: PAT_TA_61735
gtgcggcgctcgaggcggccgggttcggaaaaactgcgcccgcaacttttgaatatttcgactaatcgaccactacatagatcaccgtcacaatgggcgacgcagtcattgagggttcaaactggcgcctcgttgaggttggccgagtcgttgttatcaacggcgaccaccccttcgctggccacctggccacgatcgtcgagatcatcgaccacaagcgaattctcgtcgacggcccttccgcgaacgctagcctcgccactccccgacaagctgttcccctcaacaaggttctcctctcctctctcgttgttgagggcctgaaccgcggttcccgaactggtgttgtccgaaagctctgggagaagtccgagatcgactccaagtgggagcagaccaactgggccaagaagcgggaccagatggagcgaaggaaggctcttaccgacttcgagcgtttccaggttctccgactcaagaagcagcgacgattcgaagagcgcaaggctctggccaaggtcaaggcctccgcataaatgggttatttagctggagtcacggaggtgcttgaaagtcgggtttagatcaagtggcacggaacagggtacgaaacacaatcacggctgtatagaggctgctggattcnaaaaaaaaaaaaaaaaaagaaaaaaaaaaaaaaaaaaggcccccta

SEQ ID NO: 61736 - DNA, 752 bp, Triticum aestivum
  Clone ID: PAT_TA_61736
gccggccgggctgcgaacttagacctcgcattgaacagcagtagcacaacatgtcagcactacggattcttgtccccgtgaagcgggtaatcgactatgctgtcaagccccgagtcaacaagtcccagacgggcgtcgagaaagccggtgtcaagcactccatgaacccattcgatgaactctcagtcgaagagtcagtgcgaatccgagagaagaagcgcgcccccggtggtgtcgaggacatttgcgtcatctctgcaggcccacccaaagcgcaagatgtgctacgaacagccatggccatgggcgcagaccgtgccatccacgttgagctcaaggagggcgaggaaatcgagcctctgacagtggccaagcttctccagaaggccgtggaacaacagaagagcaatctggtggtcctgggcaagcagagcatcgacgacgatgccaatcagacgggtcagatgttggcgggtctcttgggatggccacaggctacacaggcgagcaaggtcgaattcggcgccaacgacgaggttactgttacaaaggaggtggacggtggtgtcgaaacggtgcgcgccaagctgcccatgattatcactacagatctccgactcaacgagcctcgatacgcaagtctgcccaacattatgaaggctaagaagaagaatctgcaaaagacaaagctcgaggattttggattggatggagtgaacgttcagaaaccctcaaggttgtcgagctccgct

SEQ ID NO: 61737 - DNA, 239 bp, Triticum aestivum
  Clone ID: PAT_TA_61737
gccggccggttttcaaactgtcactatgtaatcgcaatacttctcggttcgagaactgtgttgcaaattctcccagctgtggactatagtctgtttatgacccccatttcatggttatatgtttcactgtttcttgctaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaggccccta

SEQ ID NO: 61738 - DNA, 545 bp, Triticum aestivum
  unsure (1)..(545): unsure at all n locations
  Clone ID: PAT_TA_61738
gccggccaggttgcgatttacagagttgctcttcagccatttcccagtcgatattgaactcgttaaatcgctttgtgaggtctcgttcgccgcggtcggtgacgcagataataatgatagtctcctcagaatcgtcccccagaaagcgctgggcgccagcacaaggttctgttctgtgtcatttaataatggatacatgtaggaggaaactcgtcatatgcgttgtcgcgatcccagtcatctagctgtagtagcggcaacctgggtctctggctacttggcgatgggcttgggctagcaaaggagcttgcgtgacggctgttgatgcctgacagctgaggcctgaggaagtctaggtcttgatggtcccactgtatagggtcaaatggctgactgtcgtccatgacgatgagtttggagcattcacagtattgtagagcaaagagtggcggcaggaaggatggaaggatgataatctggaagcaatacacgggaacaggtttctttcacaanaaaaagaaaaaaaaaaaaaaaaaaggccccta

SEQ ID NO: 61739 - DNA, 549 bp, Triticum aestivum
  Clone ID: PAT_TA_61739
gccggccggtttccggaagccagcaagaagcacacaagaagttcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactaaacaaaaaaaaaaaaaaaaaaggccccta

SEQ ID NO: 61740 - DNA, 821 bp, Triticum aestivum
  Clone ID: PAT_TA_61740
ctgtgcggcgctcgaggcggccggctcaagtgataaaagtcgatgcactccttcgaaggactggctcttcgacttcttcttctcgcagcacaaacaaaatatactggcccacgccgccgccatgttcatattatcacccagcctcatatctggagccgctgctctgttccttgttgcctatatcatcacccgcctgagttcggcgacagcaaagatccccggcccatttgtgtcaaacttcacctcgctcgtactgaaatggcaagaactcaacgctaaccgtactgtgtatccatgagctgcacaagagatatggcccagtggtccgtgttgcgcctaacgaagtctcttttacttctattgctgctgtcaaagagatttatggctccggtggtagtggatatgacaagacggaattctacaatctctttcaggtctatggaaagcgaaccatgttctcaaccttggttaaaggcgatcacgcaaaacgaagaagaatgattggcgatcggtatgccaacagcaacgtgatgaaggcagctcctctggccggtattaaggaacgatccagcaagttcctccagcattgcgtcgagtctcccgaaagaacggcagatgtatttagagcactgcacgcgtatgcatggcgattgtgtcacgcatcaactgttccacccatatggaagcaattgcttgcaggacaaacaggaatgaggagatgatgcaccaagttgccgctgacgatagcttgcagagtgagtattatcaccagaggatttaagcaccgtagctgacgcaaaaaaaaaaaaaaaaggccccta

SEQ ID NO: 61741 - DNA, 852 bp, Triticum aestivum
  unsure (1)..(852): unsure at all n locations
  Clone ID: PAT_TA_61741
aaggccggcccgtccccccatctacggagatcgggatcgtccacncccttccgccgccgccgncgcgaaaaggagagcgaggccgactccgccgccgcgntgaggnccaagcgcaagaagaagaggatgaggaggctcaagaggaagcgccnacagacgccgccccgatcccagaaacccccttggcgccggccaagcatccccctaccccccccctgcccccgctccccccagccccccctgcccccccgccccctcgcccgccccctgccctgcctgccnacgctgtcttacctgtgctctgcccaatttatctgtttaatgctaatctgtttttgttccacgcctgagttttatgcactgtgaaactacatgtgtttgtgcctgaattttcatgcgctattacttttgccgccctcctcgctacccaaaacaaccacaaaaagaacaaaacccaccccccccgcccccccgcccccgcccccctctccccccccggccccccccccctcccccccccccccccccccccccccacccccccccccccacaggggcccccccccccccccccccccccctcgcccccccccacccccccccccccccgcccccccccccccccccccctgccccccccccccccctgccgctctccccccctcctcccctcccagtccccccccccccccccccccggcgccccccccccccccccccgcccccacccccccttccacccccggcccccccccctgcctgcctcaagcccccacccccaccctccctactcctcatcccccccccccccccccttcccccccaccccccccccccctctcccgccccccc

SEQ ID NO: 61742 - DNA, 560 bp, Triticum aestivum
  unsure (1)..(560): unsure at all n locations
  Clone ID: PAT_TA_61742
gncggncgtgttcaaaaaagaacaagacatcgaacttctttacccacacacacaagagcaagaacaagcttctttgcctgcctcatcgatcaaaacacaggacggatcatcgtgcttgatcagcgagcagcctgcggctataactcatgcggttcgtcagacggcgcagcgttctcactcgcggaggcctctcgccgtggcttctaacgtcagacgtcccatggtcgctgatgccgcgaggcccgcgccggcggcggaccaagcgcggctgctcgacggcggcgtcgtccaggcggagacgctggcggccaaggcgaggcagacggtggagctgctcatgggcaggttggcggccggggcaagccccaagggacctggccactagatagacgaaaaagaagagagagttcttgtgacgccggtcttttgttcatgtgtcttttccggggaaaaaagacccaaattctttataagttacagattcgtttttgaggagagaaaaaaaagaaaaaaaaaaaaaaaaaaaaaaaatagaaaaaaaaaaaaaaaaagggccccta

SEQ ID NO: 61743 - DNA, 380 bp, Triticum aestivum
  unsure (1)..(380): unsure at all n locations
  Clone ID: PAT_TA_61743
naatgcaaccgagggcggtgtacgtcaactacttggaccttgacctggggacgaatgagctggacggtgacgtgacgagctatgagaaggctagagtcagctggggagacaagtatttcaaaggaaattttaagaggttggcagccgtgaagaccatggtggatccccatgatttcttcaggaatgagcagagcatccctcctcttcccactgccaaaatgatgatagattccatttgagactcttaattttggtctctattgctaaatttgtgcgtcttggtgacgtgacgtgtttataatattcatggatgaaaaagtatgtgtatcgtatcaagtttatgaaaaataataaataaaatggaatgatattgtccctta

SEQ ID NO: 61744 - DNA, 635 bp, Triticum aestivum
  Clone ID: PAT_TA_61744
cggggtctgctgaagaccatccccatacattgtcatatgtttttgtagcctccgcaatgacagtacccgtgtaccactctgtcatcacatccgctgtgtatccattttccatacaataagaggcataatatgatctcatagacgacgcatcttgcgactcgactcctgctgagcagcttgcctgggcgcaagtgtcgatgtgctcactgacgagtttcgctttgtctttattggttgcgcagtagcaatcttgcttatacggtgtaccgcagtccagcacaccgccgacgtcggtgtttgcgttgttgagccgaaaaagacatggtttgacgcattgatttacatcctgagggattttattgaatattctgacttgttgagatacagcctgagtgacaaagacgaataagaaagtgagtttcggcagcatgatgaaacaattcgacgattagggtattgcaatatgctttggcttcgtaattgtattcgtttggattggctttatccagggtcaaaggatgcgaaattgggatgggcggacaaccaatacgcacaacaaacaacgcagtgacttaccattagacttcgcggcataccttttactttatcaactcatttcatctcgttattacgac

SEQ ID NO: 61745 - DNA, 495 bp, Triticum aestivum
  Clone ID: PAT_TA_61745
tttatctccctcaccgtcacaccttcagatcccaccaagcggcggcacgccgcgccacaactccatcacctcgctgctctcgtctctcctctgctctccttcacctcgatggtggaaaacgtctcccgtgtttctccgtcgtgacagccgtcgttgatctggcgcggccttctcgtgtgcagctgcctcgatatctcgaggttaccgcggaaccgccgccctcctattcctgccggcgaccgtggaccccggcctctcgctgcacacaacatctcggtttggcggcctcactgtctaatatcccccctcactctctctggagatctgatgctagcgtgatgtactgatgtgtgcagagatggatctgatgctatcctggtctgtgtgcgaggatggatctgatgtattaaaccgtgaatgtactataacctctaaacagttagtgaaaagcttaaatgcgtgatgtgtatggatggatccgatggattacactcc

SEQ ID NO: 61746 - DNA, 833 bp, Triticum aestivum
  unsure (1)..(833): unsure at all n locations
  Clone ID: PAT_TA_61746
aataatcatcacaatggctcccgaacgtgtttgccttgcctactctggtggtcttgacaccagcaccatcctccgatggttggtcctccagggctaccaggtcgtctgcttccttgccgactgtggtcaggaggaggactttgacgccgtcaaggtcaaggctgagaagctcggcgctgagcgcatgatcatcctcgatgttcagcaggagcttatcgacgagcttgtctggcctgctgtccagtgcaatgccatctacgaggaccgatacctcctcggaaccagtcttgctcgccctgtcattgctagggccatggtcaaggtcgccaaggagcacaactgcacaattctcagccacggatgcactggcaagggtaacgatcaagttcgattcgagctcgcatggaaggcttgcgaccctaccctcaaggttctcgccccctggcgcatgcctgagttctacaaccgattcgctggacgtgccgatctgctcaagttcgcctccgagcagaacattcccgttagctctacccccaaggccccttggtctatggacgacaacatcatccactgctcttacgaggccggtattctcgagcaaaccgagcttgagccccccaaggacatgtggaangcgcactgttgaccccatgaaggcccccgatgagcccacccccttcgttattcacttcgagcagggtgttcccgtcaagctcgaggttgcaggcaagaccatcactggatctctcgagatcttcaaggaggctaacgagatcggccgaatcaacggtattggacgtgtcgacattgtcgagtcccgattcattggtctc

SEQ ID NO: 61747 - DNA, 878 bp, Triticum aestivum
  unsure (1)..(878): unsure at all n locations
  Clone ID: PAT_TA_61747
atcttctagaaaactgtcactatacaatcatcatgactatatcaccacttacgttgcgcatcgctatgctgaatgctgatgccccggtgcccaatgtgatagaacaaagggcaccatcttacggccatgttttccacgaacttctatcccagtcggccacccgagttgctcctgggttagcggttgaggcagaatactttgacgtttaccatggtatttacccagagtcactcacgcacttcgacgccatcgtcatttccggttccagcgccagctcctacgaagacaaaggttggattaaacaacttgacgcttacatcgccaaagtctacgccgaacaaccccgcgtcaagatattcggcagctgcttcggtcatcaaataatctgccaaagcctgctccgtgaacacggggtctacgtggaaaaagaccccaaggggatggaaatgggagtccacacagttcaactccagcaagactttctcaaagcgctgggaagtcgttcgtcggtcacagacaacagcacactccgactgcagttcatccacggcgatcatgtcaagataccagaaggtcattccctacccccaaagtggctctctatgggccaaacagaacactgcgcattccaaggtgcatatgagccgaatcatgtgctcacatatcagggccattttgagtttgacagcttcataaacaccgagacttgtaaggcttttgcaggaacttatggctgnggaccccagtttattgaagcatncatcgaggccatggataaagatgacgactccaagactgccgctgatatggtgatgagattcttccctgagggacgacatgcagtggccggcattggagggctgatgagtccccattgg

SEQ ID NO: 61748 - DNA, 857 bp, Triticum aestivum
  Clone ID: PAT_TA_61748
ctcgaggcggcgggccgggattcttttatttcattttcgcaagaggttattccatttccctgattctttctttctttctcacactcacaaacaacacacttatacttgacatcacaaatcttgctcaaaatgcctcctcttcgtctcgccatcctcgaagccgatacgccccagccgcaaacccgcgatcgttatggcggttacacaggcgtctttaccgcgctcctcgaagcagcggccaagcccaaaaagctgtctgagctcgtctccatcaagggctacgacgtcgttaacgagctgcactcgtaccccgtgatcgaggacatcgatgcgatcctcatcactggctcccgacacacggcgttcgacaacgacccttggatcctcaagctggtagagtacacgaaaaaggccatcgcatcgaatcgcgtgcgcgtcgtgggtgtttgcttcggacaccagatcgttgggcgagctgagggtgccaagtgcggtaggagcaataacgggtgggaggttgctgtcacagaggttgatctgacagccaagggcaaggaggtgtttgggttggacaagatgcgcattcaccagatgcatcgcgatattgtcgacgcatttcccaagaactctatccctctgggctccaacaacatttgcgaagttcaggggttctactcgcctggaaagtacatcacagtgcaaggacaccccgagttcaacgaggagattatttctgaaattctctttaaccgtcataccgttggcattttcacggacgaagtatataacgatgccatgaagcgtgcgcctctaccccatgatggagtcgctattgccaagggctttctcagttttgg

SEQ ID NO: 61749 - DNA, 858 bp, Triticum aestivum
  Clone ID: PAT_TA_61749
cggcgggcggaattaaaaaaaaaagccagctctcttactccattggtgtcgctgagcccctttccatctacgtcgactcctacggtacctctgagaagacctccgaggagcttgtcgagatcatccgcaagaacttcgacctccgacctggtgtcattgtccgtgagctcaacctggaccagcccatctacctccagaccgccaagaacggtcacttcggtaccaaccagagcttcagctgggagaagcccaaggagcttaagttctaagctgtcttgtgacatgatatcaaaccacaaaaagagtattcaacagctctatgcatacatcacaacagatgtgtaatcatttgatttagcaactaaaggcggcgtacggttctcaacgaaacctatgtatctcccaccggaagggaggacggtcggtttccggcttttgttttgtttatgatttctatccaaaacttattttggttccacgggtgtggagatttctttcgcgatataccaggcacggagtgggcgtctttcaacaaagacattttagggcaaacctgcatttgtgaggcgaatcaaaagaagagtcaaagagacttgcattataacgataccacgacaagggaaatgacaaaaagacgacgcatccgatgggaaggcggcgttttgacgaggaaacaaaagaacttcaacatctttttctttccaggatttctagccgagctgatgcagtaggcgggcgagaccagccaggacgtggtggaggttggattgatcgctaattagaagtcgatctttgaatgatagaaggattctaatgggctgatagatatgcccagtcgctgcgaatgcagacggcagc

SEQ ID NO: 61750 - DNA, 531 bp, Triticum aestivum
  Clone ID: PAT_TA_61750
atttcttgacatcagcaaatcctatccactgccagccatcatttggcattccatcgcttcgttccgtttcgtttccttcctttcgttccacactaccgtcgcgcacgaatcgcgaaatacacatcacatcatgggcaagcgcaagtcctcaagcaagcccatggggcccaagaagaaagatccccttcccaccactttcgcatgcctcttctgcaatcatgaaaactcagtctcggtaaagctcgataagaaagctggcgtcggtcaactcgactgccgtgtttgcggtcaaaaattccagtgcgcagtgaactacctctccgctgcggttgacgtctatggtgaatgggttgacgcggccgatgccgtcgccaaggaagacaccgcggagcccggctacggtggcacatctcgaggaggtggacgaggcaaccgaacggcggtcgaagatgactacgacgaccaatacggagatgatgattattaaacgtttcttttacgcgccctgtaacaataccaagatttgctacg

SEQ ID NO: 61751 - DNA, 818 bp, Triticum aestivum
  unsure (1)..(818): unsure at all n locations
  Clone ID: PAT_TA_61751
agttctgtcggctgctacactgacccggcccttgttgccgctcccgccccagacctctctcctgttgatgctgtcgaccaggtaggccacgacttgtcggccgttgaccaagttggcgatcatgtcggcgcgtcaccaaaagagaggcattctctgaccctcgatcaacgtagggctttgcggcgctgggccaacagtcagcctatccgtccttcgcataaagcctgtattgagtggttctactcgcagtacggccagcaaataagccaatccaccgtgtcgcactcgctgtcgccaaaatactcgcgccttgatagtgacaaccctcaattatctggttctcgtctacggtatggaaactggcctgatgtagaaaagctcgtcctcatctggttccagcaagtccaggcctctggacgccagcctactaatgaggagttgggagataaagcaaaaaccatcttcaaccagctaccaagatacaaagatgaaaaccctcccgaattttccccgggatggattcaccggttcaaaaaacgctatgggcttttgatacgaagacaacggcgtcatggggatggcggaataaatccagccgaagatattggctatctagccgattgcattccccgattcatgaatctcgctccagatacaagcccaggagcgatcagagaagaagtcttgcgtgttgttggcatcgaaccccagcctcgcatgtgtgcattggtgcgtgatgaagtggttcgtagaataacaggcccccnnacancacagccgccctctctgccccagcctcctcccatgatgacgcacga

SEQ ID NO: 61752 - DNA, 809 bp, Triticum aestivum
  Clone ID: PAT_TA_61752
agtccgagacctttcagcctcaacccatacagtgcctccaccatgttccgtctctcttccatcatcacagcaggtctcgccctgattagttccgtcaacgccgcttgtggcgatggaacaccgcagggcgtagtctcgggctccggatcctcattcaccgccactgtcaacggcgcaaatgtctactctggctccgactaccgtctcgccatccaaacagcgctcgaccgtatcggcaccaaccagcgtgtcacggtccgcgcctcgggcagcataggcgccagcaccatcgttgtcactagcgggaagacgtttgaggtctgcggtaccatgaacgttgtctacaaggctggtcgaggagccatcgaggctatcaaccagaacgatgtcaagatcccttacctcaagatgacgggcaatccttactttggcatgcgcttctctgggacccgcaacctggctcttggtgacatcacaatgaaccttagcggtggtctcggaattcgcttcgaccgcgacgcgaactggaactatggagttaccatgggtaatattgttgtaacaggagctggtagccacgctgttgagacgttcaagatcgacggtcttaccattgcttctgtcaaggcccgcgacgttggtgaatcgggactacttatccaagaatcacgaaacgttcgcgttggctacgtcgagggcaacacgtcggcgcaggcacaggctatgcaactcttcgtttcgccaacgagaatggcaagctcaacaatgtctataccaccaccaacgtcttcgtcgacaagtctactctc

SEQ ID NO: 61753 - DNA, 803 bp, Triticum aestivum
  unsure (1)..(803): unsure at all n locations
  Clone ID: PAT_TA_61753
aatccttctcgaccgaccgaacgaccgattgtctgcgcaatccttccgcgccttctgtctttacttttcggtcgcacgctctccgttttttctgacaacctttccaccttctcctcaccctcatcacatccaccacagcgaccatgtctcgagcgaacccacctaacgctgcggggtcccgcaagatctccttcaatgtgagcgagcaatatgatatccaggatgtggtcggcgaaggcgcttatggtgtcgtctgttccgccattcacaagccctcgggccaaaaggtcgccatcaagaagatcactcctttcgatcactccatgttctgtctaagaactctgcgagagatgaagctgctgcgatacttcaaccacgagaacatcatttctattctcgacgttcagaagccccgaagttacgagtcatttcaggaagtctatctgatccaggagctgatggagacggatatgcaccgtgtcatccgcacacaggatctttccgacgaccactgccagtacttcatctaccagaccctccgagccctcaaggcgatgcactcggccaacgtgctgcaccgagacttgaagccctccaacctcctcctcaacgccaactgtgatctcaaggtctgcgatttcggtcttgcgcgatccgctgcctctcaggaggataactctggtttcatgaccgaatatgtcgcgactcgatggtaccgtgcgcctgagatcatgttgactttcaaggagtacacccaggncatcgatgtgtggtcggtcggctgtatcctcgctgagatgctc

SEQ ID NO: 61754 - DNA, 604 bp, Triticum aestivum
  Clone ID: PAT_TA_61754
ttgtcttacgagggcgacccgccctccccgctaccccacctccacctccacctccacggcctcgccatgccgccgctgcccacgatgacccactcctcctccttcctcctcccgtccccgcctcatcccccggccgacgcaaccgacgccgagaacgcggtctcctacgccgtcgtcgtcctcaaccagcgcctcccgcgcttcgcgcccctgctctggacccgagaaaaaaaaaaaaaaaaaaaaaaaaaaaaaaaaaaaaaaaagaaaaataataaaaaaaaaaaaaaaaaaaccaccttccaccggcaattatcttgttctgcactcggggcttacgcgccaccgccctggggggttctcagccaattctccggcaattcacgacaacgacgcctttccgatacgccgagcccacgttatcgacacctgtcacagcacctggggaggccctcaaggatgctcttgccccacgatcttcatgggcacccggaattatccttagcggattaaactaccccaaggttggccaaaatcccgttgcgaagattgacgacaagcacccgaagtggttatggagttgcttggatgtgaaaaaaaagga

SEQ ID NO: 61755 - DNA, 677 bp, Triticum aestivum
  Clone ID: PAT_TA_61755
acctgcatcaaccgtacactcttcaatcagtgtcgatgaagccaattcgtcttttgtcactttctccaacgacactgcccgtaacagtatcaacaaacttttcagcagcgtcgtctttatcaaggcaacttagtgttacccgttttagttccaggtcccgttttacggcctgcgcaaaaccaccccgcactcgcacatttgcgacctcacgacccctcaacgctttcagactgcaaaagtcgcagaagcgcaccaaagacacaatgacttccagcgcgacaaccctcaagggccagccccttgacaaggctgttctcgaatccatcctccgacgacgcatgttctataccccctccttcgagatctacggcggtgttggtggtctgttcgactatggtcctcccggttgtgcgctccaagcggccgtcattgaccaatggaggaaacacttcatcctcgaggaggatatgctcgaggttgactgttctgtcctgactcctcacgaggttctcaagaccagtggtcacgtcgacaagtttgccgactggatgtgcaaggaccccaagaacggcgagattctccgagccgaccacttcgtcgaggccattctcgaagcccgcctaaacggtgacaaggaggcccgtggccagaaggtggaggaaaaagaggaggacccc

SEQ ID NO: 61756 - DNA, 760 bp, Triticum aestivum
  unsure (1)..(760): unsure at all n locations
  Clone ID: PAT_TA_61756
actcccgaacatcgcacagcaattgtcgacttgtacgcactcaaaccgaacaatctacctcacgaatcgcctcaatacgcatctagccatgtctctccgagctcctctccgtcgagtcgccttcgccaggcccacttcttccatcgccgtcgctgcccgaagcttccactcgacccctcgtgcctccgtccgtgtcggccaagagatccccaacaccgacgtcctcctcgaggattcgcctggaaacaaagtcaatctcgctgaggagttcaagacatccaatggatacatcgttggagtccctgccgccttctcgggcacatgctccagcaagcatatcccctcatacatcaaccaccccaagctcaagcaggccggacaggtctttgtcgtctcggtcaacgacccctttgtcatgaaggcctggagcgaccaacttgacccagcaaagcagactggaatccgattccttggtgacccaactggtgagttcaccaaggccctggacctcggcttcgaggcatacgccgtcttcggtggtatgcgaggtaagcgatacgctctcaaggtcgaggacggcaaggtcagcaaggcctacgtcgagcctgacaacactggaagtgcagtatccatggccgaccaggttctcgattaagtgttatgactattatcctgaggcacaccgtcttatctacgtcctcttgtattcattcatatgtaggagaaccttcggaataccanagatatacattttaagagc

SEQ ID NO: 61757 - DNA, 797 bp, Triticum aestivum
  unsure (1)..(797): unsure at all n locations
  Clone ID: PAT_TA_61757
attcccctctccgctcgttctggatcagggcacaacctagacgaggccgcaacgccaccgctcgtccccgacaccatgcctcaccgccgccgccccgaagccgccccgcctcgcctccccacgccgctgacacccaccgcctgaccccatcgcccttggatcccgtcgtcgtcgctcggaacgcccctctccggaagtgtcctcgtcggatctcctccccgtcgcgcgctgtccccctcatcctcctcgacaaccgctgccttgaccctatggcccgcggtgaggctccgaccttatctcctccctctcccccatcgacgacctgcgccctgcctcgcctccacgtggcccgaccgcgccacacctggcctcacctgctacagccccgctccggcaccccgcaaccgcctacactccgccgcgtcgaccgctacccagcgacgcgcacgtcatgtacctcgccaccgtttccccctgctgccccttgcccggcgcacctcccagcggccgcttctccaccggccacggccaggccgccatccctgctcccctcctcctacctgcagctgatgctgcccgttgctgctgcggttgccgcagcccctgccgtagcccgcccccgcccggtagcgcccgtcaccggncggccgccctggcgcgcgccggcgcttagccgcatccactcggccctcacccgggtcgggcgcccgcaccccctatacccgttagaaccgcacacccggttggccctatgagccactgcccagtgggcctcccctagctccaggatgatttag

SEQ ID NO: 61758 - DNA, 499 bp, Triticum aestivum
  Clone ID: PAT_TA_61758
gattcctctggctacccaagatcatcgaccaatcttatcagtcttcacgtaaggcctgtcatatgcagtcccaacatccaacggtgctagaactcatctctaggtttagttcaccataatgtcacacctcacatattacaactatgaaggagtaggcaaaaccaacaacaaggaatactcctactcccaagccgtacgcgtgggcaacacaatcaagtgctctggccaaggtggctgggatgtcacggaggtgcttgaaagtcgggtttagatcaagtggcacggaacagggtacgaaacacaatcacggctgtatagaggctgctggattcacttttcgctacgttctggaaggctgtatgccacatttcatcgtccagatgaacggcgtcaatacggaaattctgagatcaactgaattcaaagcatgaggagcaccaaaaagaacatggattcattgtgaagtgtagccaaaataaaaatgaaatgaataccccct

SEQ ID NO: 61759 - DNA, 904 bp, Triticum aestivum
  unsure (1)..(904): unsure at all n locations
  Clone ID: PAT_TA_61759
aactcattaacagtgtcattcattgtatcaaaattgcaaaatagtatatctctgtataacctcaataggtctcgatcaacatggcacctcgtcgccctctccaaaaactcacatcaccctcgcggagcctttcgctagtccttcatcttgctggtatagcctcattcagctacaacttcaaattccttacagaatgggacgttcccatgtccaaatcctatggatggcactttcaattcctcacaatcattggcctctcggcatcgttgcttgcctttgttttcggcgccctggctgatctcacactgagccgaactctattccgagtcaagaactatgttgctattctcgctacgcctatggaagtcgtaatttccatcctgtactggggtatcaaattcatcgaccccaagctgctcatgcctaccgaattttacatccacatcatccctgatgtcgggttccatcttgcgcctgcagtgttcctgactccgggtcttcttctcttcagccctccatggacggttccagcttatggaattatggcaattagcactacccttgcgtttgcctattggtcctgggtagagctttgcttcagccacaacggatggtacccttaccctctgtttgagcttctgtctaccaaccaaagagttgctctgttcacttttgccgctgttctggtcactgtgtcttcctcaggcctcaagtggctgtatggacaagtcaatggctatcagactaccaagaggggagctcacnagcctcttaagaaggttcagtgattcatctacagttgaatatctaaacagtatatagaacgctgccagtcgatggcgcaacagatancaacattcaaaatacagtttcaccaaaaaaaaaaaaaaaaaagcccctaggg

SEQ ID NO: 61760 - DNA, 439 bp, Triticum aestivum
  Clone ID: PAT_TA_61760
tttccgacgtctcgcgagcacaaagccaaacccaaaacatgtccattctgatgggaacctcggcggcccaggaggtcagcaacctccgcctcaagcaccaggcggtccagaagcccttaagaggaattggccacccatcgctgcagcagctgccgtactgggaggaggtttttggatcatgctccctaagaaaggaaatccacccgagatgactctgcggtcttataaagacctcgatagccccgacgggttgaaggagctcagtgggcgaaagcccaactcaatgggtggtttcagagctgactagtcaagtatgcgatgaatcacggaagagaaatgagcaattgtttgtaaagtgcatcataacgtaggcaatcgcccagagtatcaaattatctatgtcatccctcattcagaatctatataaaataatggtatc

SEQ ID NO: 61761 - DNA, 511 bp, Triticum aestivum
  Clone ID: PAT_TA_61761
tttccaccctccttctcccgtgcccttttcttgctggcgacgacgacgggattgctgtcaagcttggcgccgcagggtcgttccagtactatgggaaccgataaggatgtagcggccggctcgaagctgaggcgaccatcacgacggctcaaaactgcatcaattcgctgctgcatcatgtatgtgcttcccacgccgccgaggtggctgacagtgtgcatgggactatgggagacacgcgaagccgatgatgggaggccacgctacagttcgttggcggccgagcttggaagacagatgccaggaaagagcaggacggggcgccgctggctgcgtcacctcacggaaggtagccatcctgggcgcgggcgtcgcggccacttcagtgggtgccgcctgcctcggcagccggtgctccactgctcgtctatagcgacgccgaacccgcaagatttttttccaaagctatcacgttttttatagcaaattcagaaactatagtacctaatgc

SEQ ID NO: 61762 - DNA, 806 bp, Triticum aestivum
  unsure (1)..(806): unsure at all n locations
  Clone ID: PAT_TA_61762
gnttcgnacaagaagaacgacgagacaatccatctacgcgatccccgaatttctcacgctcctttttccctgtacggttcttccttggtctgtctatcttcagatcatttttttctcttctttatcctccttcgaatcgatacccctttgcaattccgcccatcatggctcccaagggaaacaagtactcggttatcttgccgacgtacaacgagcgcaagaacctgcccatcattacctggttgttgaaccgtaccttcacagagaacaacctcgattgggaactcatcatcgtcgacgacggatcccccgatggaacccaagaagtcgcccagcagctcgtcaaggcctactctccccacgtcctcctcaagccccgcgctggtaaactcggtctcggaacggcctacgtccacggtctcaagttcgtcactggcaactttgtcatcatcatggacgccgacttctcccaccaccccaagttcatcccccagatggtcgctctccaggagaagggcaactatgacatcgtcaccggtactcgctacgctggagacggcggtgtttttggctgggatctcaagcgcaagtttgtcagccgcggtgccaacctatttgccgacactgtcctgcgccctggcgtcagcgacctgacaggcagtttccgtctgtacaagcgtgctgccctcgagaaggctattgctaccactgagagcaagggatacagtttccagatggagcttatggttcgtgccaagggcatgggntgcactgtcgctgaggttccatctcttttgtgacgtctg

SEQ ID NO: 61763 - DNA, 800 bp, Triticum aestivum
  Clone ID: PAT_TA_61763
aatacttcgtcaatggaaaacatcgagatggccaaccaacgacgaattcccggagactctttcgcccgcgcgcttgcgcggacgggttcttcttcttcttcttccctccgccgcatcgtctgatgtcaaccgctacaagaagagggaaacgggcctggaaagatcgtggggtcgcagccgtgccgaggggaggggaggaggtgatcaggcaaatcggtgcttcttttccgaggggctagctttgctacagatcaaaactcgggaagcgatgccatctccatcagcacctattcgtgtggcagttccaccaccctatgtaacatcgcatggagctaaaattgcaaggctacatatgtatgactggattgtgctggttattctacttgtggtggatgtagtactaaataaaatagaaccattccatcgatttgttggatcggacatgctaacggatctccgatatcccatgaaagacaacacggtgccattttggacggtgccgatatatggtatcattggacctatgattatcatgaccagtatatacatcaagaggaggaatgtctatgatttgcacatgccatactaggtctcctcttttcagtggctataactgcagttttaactgatgcgattaagggatggtgttggtcggccacgtccagatttcttttggcgctgttttcctgacggagtacctgcctatgacattttactacgggcgtcctgtgtcagggtaaagcgagggatatcaaagaaggtcacaagagtttcccaagtggtcatactttctttgtctt

SEQ ID NO: 61764 - DNA, 711 bp, Triticum aestivum
  Clone ID: PAT_TA_61764
ctcgaggcggcgggccgggaatcccaacctccgatttcttctcaaatctatacccactcgtgcctagctagctccttcccgcttccagtggtcgatcgcatcccacagtttcctcagctccacaggttccctgttcttcacttgtacgcacgtccatgacgaagcaccagagagcagcagcagaccaggccgtgtcactctccctctcgctctccctcggcgtcgtagccgacatcaacaagaagatgcgccgcgccacggccgccagtggggaccagttcgtgtgcaagacgtgcggccgctccttcccgtcgttccaggcgctcggcggtcaccggaccagccacctccgcggccgccacgggctcaagctcgccctcaccgccggcggtcagtgctactccgtcaaacccaagagtacggatcagaagcctgagcaccggtgccacatctgcggccaagggttcgagacggggcaggctctcggcggccacatgcgccggcaccgtgatgagggcggcgcaggcgccgcccgtactgctcgagctgtttgtctaggctgatctcagtagttctagtgcagggttgctgacatgaatatatgcgtgcacagtcgtagcagtaggtgttgatcattggttcgttcattcctttatatgtgtacatataagtatgatggcttcttcaatgattatatactttagttcgttg

SEQ ID NO: 61765 - DNA, 422 bp, Triticum aestivum
  Clone ID: PAT_TA_61765
ggccgctcaggcggcgggcgggagatcacaaagggagtatgatcactgggcttgcaaagtccgaggagcaagatgaaaaagcacttcgccaaagcttaaaccggcttgagatgttggccaagcagctagacagcgacgctttgcgattgttggagatggaaatggctccgttcaagggcgatgccgaagcaagggccaatttgcaaggcaagatgagagaatggcttgtgcaaaacaccattagagcggatcctatggtgagagacgctatgggaacatcgttgaggaagaggagagttgatgcaccagcaggcgctaaaggaaaccgataggcaatgcttatcaattcgttattgtacaatttaaatagacctagactgctccaaacaggcacctatatgaataacaccaaagttgaatgc

SEQ ID NO: 61766 - DNA, 598 bp, Triticum aestivum
  Clone ID: PAT_TA_61766
atttcaaaaaaaccctcccgtgctagttggtaaccagcaacgaaactactcccgcagatcaatccttgggcgagaagaaagaaaggaagaaacaccaatggcggccgctggttcctccgccgcctggaagcgctggctccgccctgaggtgtacccgatcttcgcggcgaccggcgtggctgtctccatctgcgccatgcagctcatccgcaacatcaccaccaacccggaagtcagggtgaccaaggagaaccgggcggcggggatccaggagaacttcgacgaggggaagcgctactcgcagcacggcttcaggaagttcatcgaccgccagcgccccgagatcatgccggcgatcaacaacttcttctccgaccctcccaagtattagttcagttcagttcaggcaggccgcgaataccgctcggatgcactcttctttcgttccaaagattgcgtccggattttagaaactgcccatgatgttgtttgtcataattcgaatcatttacatgcatggccatggattgatttgattgcctggctgtacgcttttgatcgtatctcgaacttgatcgggttaatttgcatgtcgttt

SEQ ID NO: 61767 - DNA, 780 bp, Triticum aestivum
  Clone ID: PAT_TA_61767
aataccatcaaaatgtccgtttccacaagactgtctttaccctcaacaatggtgtcaagatgcccggtgtgggctttggcacctttgctaacgagggcgccaagggcgagacctacaaggctgtcattgccgccctcaagaccggctaccgacacctcgactgcgcttggttctacctgaacgagggcgaggttggccaggccgtccgtgatttcctcgccgaggacaacggcgtcaagcgcgaggatctcttcatttgcacaaaggtctggaaccacctccacgagcctgaggaggtcaagtggtcattcgagaactctctcaagaacttctgtcttgactacattgacctcttcctcgtccactggcctatcgctgccgagaagggcgacgactaccagcccaagatcggccctgatggcaagtacgtcatcaagaaggatctcactgagaaccccgagcccacatggcgcgccatggaggagatttatgctagtggcaaggcccgtgccattggtgtctccaactggactatcgacggcctgaagcagctcatggccttcgcaaaggtcaagcccgccgttaaccagatcgagattcatcctttcctgcccaacgaggatctcgtcaagttctgcctcgagaacgacattctccccgctgcttactctcccctcggttcccagaaccaggtccccaccactggtgagaccgtccgctccacaagacccttaacgaggtcgccgaccgtagcggcacacccttgctcaggtcctcatc

SEQ ID NO: 61768 - DNA, 700 bp, Triticum aestivum
  Clone ID: PAT_TA_61768
ctgtctgagtgagtcttcacccttcacctattatccaagaaaagaaaagaaaacaagaacaagaacagagaaaccatggttatcggattactcgccatcgcggctatcccgactgttacaggcgtgggtaacgcagtgagtgcgcaaaagagacagaatgagagcatgagcaaggaacaggaaaagttccatctcacatttatgctacggcagaatggaaagatagaagaagtcggacaaggagttttggttgacaaaaagatgtatctcaacctctcagacgctccagttcaaggctacagattcctaggatggttcttcaagtatcccagcgatgaaggccatctggggctggtgagcatggtttctgacgaccctccagcgctcaactggatctttgtcgacaaggacacgcatgccgtgacctttgggggcaagaaggacaccatcgaccacgtcaaaggaccctggggctggacagcagatgagaaattcctgacactcaagggcgaccatgattcgtttgtggcggtgcgaggtgatgatgggaaatggtctgtctactgggacccggagggtgatatcgaggacgagattgacgatgaggagagatgccagccagtgaggcttcgaagaagaccgcaacttggcatggagagcagctatgttaagaagtgatttacagcagatattccccagt

SEQ ID NO: 61769 - DNA, 632 bp, Triticum aestivum
  Clone ID: PAT_TA_61769
actaaatccagcccacctccagtctgcctcgccgccgccgggaaccacatccagccgaatccccctcagctccaccaccagctctcgacgggatgggttcggggagccgcgcggcgtcgtgcctgtgctgcccgttcaagtgcctggcgtgcggcctcttcagctgcctctgcagcatcctcgtctcgctcctcgtcaccgcgggggtcctcgccctcatcctctacttcatcttccgcccgcagatgatcgccgccaccgtcgactccgcctccctcgcccagttcgcgctcggcaccccggccagccccgcgctgctccagtacaacctcacgctcgccatgacggtgcgcaaccccaacaagcgggtggggctctactacgacaacgtcgaggccctcgcgctctacgacggccagcgcttcgggttcgcgcccctcgaccccttcttccagggccaccaggcgtccacgggggtgaagccggcgttcggcggccagcaggtgctggagggggacgtgacccagtccaacctcaggacgcagctggcgggaggcgcggtggaggtggaggtgaagctcaacgccaagctccgcgtcaaggtgtgggcgttcaaggtgcccgggccacgc

SEQ ID NO: 61770 - DNA, 728 bp, Triticum aestivum
  unsure (1)..(728): unsure at all n locations
  Clone ID: PAT_TA_61770
ccgctcaggcggcgggcgggattcacaaatcacacatggcgagcaggttcactcctctcatccgctccgtcatccggccggcgtgccgggttgcccgccctcagtctcgcgccgccttctccctcacagccagccgacgaagcgacactctcatggtgcatcgaaacaccgaggacaacaaccccgacatccccttcaagttcaacgcagagaaccaaaaagtcatggccgagatccttaagcgataccctccccagtacaagaaggctgctgtcatgcctctgctcgacctcggccagcgccagcacggcttcaccagcattagcgtcatgaacgaggtcgctcgtcttcttgagatgcctcccatgcgagtgtacgaggtcgcttctttctacaccatgtacaaccgaaccccagtgggcaagtactttgtccagatctgcactacgaccccttgccagcttggaggctgcggctccgatgttatcgtcaaggccatcaaggaggagctcggcattgagcagggccagaccaccgccgacggtctcttcaccatcctcgaggtcgaatgcctcggtgcctgtgtcaacgcccctatgatccagattaacgacgactactacgaggaccttacccctgcttccgtcaaggaccttctcaagtccctccgatccaggccactgctactgatccttccccacgtcatgttcccaagcctggntcccctt

SEQ ID NO: 61771 - DNA, 833 bp, Triticum aestivum
  unsure (1)..(833): unsure at all n locations
  Clone ID: PAT_TA_61771
aatttccgagcacctactaacccgaacgattcaagatggtgagtgaataaaaaccaactcgactctaatggccacagttttgtgagtcaaatgtgctttacgcgcaattgaagccgcagcgtcgtccacattttgtgggcgacatttgctgttggtattccgccagtaatcgatcaccgtaaaaaagtgtcgaactggtgaagacttggctggagatgcggcgtgtgcagaaatgccatggcctattctcgttagagttcagagaagaccttttgttggcttgaatgccttgctgatgtcttcttttctcaatgacagcctcccaacaaatccggcaagaaggtcgctcccgcccctttccctcagggtaaggctggcaagaaggccgctaagaaccctctcctcgagaagcgaccccgcaactacggtatcggccaggacatccagcccaagcgaaatgtctctcgcatggtcaagtggcccgagtatgtccgtcttcagcgccagaagaagatccttcagatgcgcctgaaggttcccccggctctcgctcagttccagcacgtcctcgaccgcaacactgctgcccaggctttcaagctcctcaacaagtaccgacctgagaccaaggccgagaagaaggagcgtctcctccaggaggctaccgccgtcaaggagggcaagaagaaggaggatgtctccaagaagccctacaccgtcaagtacggcctcaaccacgttgtcggcctgattgagaacaagaaggcttctctcgtcctcatccccaacgacgtcgagccaattgagctcgntgtcttccttccttctctctg

SEQ ID NO: 61772 - DNA, 718 bp, Triticum aestivum
  unsure (1)..(718): unsure at all n locations
  Clone ID: PAT_TA_61772
atcctcgccagcaccaaaacaatccaagagtagtagtactacaaccagcctcactacgtgagcatcttcacaatgagtgtgtgcgtgcttcacttgtgtcctgatagcttcagttagctgcaatatagatcctctttgcctctgatcctcggcggttctgccagtagattgtttgggctaacagagcagaggaggaagaagaggttgccgggctcgctgcggtggctccaggcttgcgccggtcgaagcttaagatatagtctacaacagcggttcgatccgacacggctgggagtcctcgcggtggcggtggccatgggatcgacggaggacggccacgagggcactcggcncacggatctgggggagaggaggggcggagcgagcgatggagagggagggagagtggataggggatggaggggaggncgagggaaggncattatcctcntggnggngctgnagcgacgcggggcggctagcgggggcgggggcgacggcgagcagcggcgggcgcgcgcgggcatggngacacggngaggagggagcgcgcggggcacgctgggctggctgggcctgccactgtgcactaaggcccagtcagtcgaggcctttttcttttctggctatttcttctttgtttcacggctttatttccgtattgctaattggttatcctccaatctacttttgaaaaaaaaaaaaaaaaaaagcccct

SEQ ID NO: 61773 - DNA, 682 bp, Triticum aestivum
  Clone ID: PAT_TA_61773
aattcacgaggtccaaattcagcagcaaacatcatctagtttcttgatccggttctgtttaccctgaaggctcggcttccgcgggtggctgcgatggcgggaggagggaaggtgtactcgttccaagaggtgcggaagcacagccagcgcaaggattgctggctcatcatctccggcaaggtgtacgacgtgacgccgttcatggaggagcaccccggcggcgacgaggtcctgctggcgtgcaccggcaaggacgcgacggccgacttcgaggacatcggccactcggacgcagccaaggagctgatgccgcagtactgcatcggggaggtcgacgccgccaccatcccggccaagctcgcccacgccgtcctccccgccaagggggcggcggcggctccggcgccacgcgcgagcgcgggccagggcgtctggctcacggtgctgcagctcgccctgcccctcctgctggtggccatggccttcgcgcttcagaacttcgccaaaaccaaaacagagtagacgagaaggacagatgccgtcgcggataccggcctgcggcctcttggaagtatctgcacgtccaaccacttcctgtcgacgtctctaccgctgcaatcgttgtaattccatctcccatatgtgtactgacgtcattattggtggaattcatatatctacg

SEQ ID NO: 61774 - DNA, 708 bp, Triticum aestivum
  Clone ID: PAT_TA_61774
atacacagattgtcgtttgagaaattccccgtccaactcgtcattccttgcctggctagagagagagaggatggcgcttgctccccggtcgtctcttagctcgctggtgctgctcatgtcgcacgggaagccccagctgagcgctttcttctcctccgccgccaccaccgcctcgccggttgctactgccgtgaagcctccagcagctccagccggtggtagtccggccatcgaccctccagccgctgcagcttcgtcgtctgggtctggctcgactcacagtgcccctctcgaatgcccaagcagaacatttggacatgttgaacctgaacctgaatctgagggttcatgtcacacgcttggacatgaaactgacaagatttcgcctggcgccaccaaggatcaggagggcccaatatccgagggctcatgcggcacgcctcagcctgtatcggacgatcctcagcctggacctcgcaaagacccgaggcacggagttcctgaagacccgtagggcctgtgcgatgctggagaagttgagatttttcttgtgttcatcatgtccagaattatcccttaattgtattgggtcccacacaccatgtattcccaaatttattgatgttgatactttagctcaatctcccgatgcccatttctttcgcggaaaggccaaaggctatatgtttaaatcgaccaactcttatg

SEQ ID NO: 61775 - DNA, 648 bp, Triticum aestivum
  Clone ID: PAT_TA_61775
acatccccgagggctttggaattattgttaccggcgctgtcctattctacttcttctgtgaggcgtctttgccatggatccagcccggctcgcgtgcttgggaactgttgaacgaaaactttcctggcggagccagcttcttccactggctggtcaacaccattttctggcctgttgttggcatccacgttgtcgagtgcttcttctttgacaagaagctacagagacatggtgttgagagattctctggtcagtggtggctctggctcaccaactgcttctttgagggattccctgctttcaagcgtgtggatgggatcgtggcccgcaagcaggacaagaacggcaagacacagtgattgtcgtattcgacatggagaagaattagtctgtctctggagataaaacgaggaagcttcagaactgggtatcagggatgtagtctatcaacgattgttcgcactggctgcatctttgcacatgcttgaagaaaggcaaccgacaaccacaagctcataggccgagacagtttgcacaccgagacacgcctgtgtgctctagagtacaaatgagggagcagccgatttcccgcatacatagagtagacttaatgacatatctacccaattgcgaaaaagcgatcaagag

SEQ ID NO: 61776 - DNA, 498 bp, Triticum aestivum
  unsure (1)..(498): unsure at all n locations
  Clone ID: PAT_TA_61776
naatcatcaacccatctctagctgccgaacttgtcgcctagaagtagaatactgtggctagtgcgacctctctcccaaagcaagctctaggatcggctttctgtcttccggctcggtacattgttcgatcgggatggcggggggctcggcggcgaccggcgcggacgagcaggctctggcgcaggggtcgcggagggtcgttgaccgggaggccgtcgaccggggcgtcgcctacgcgctcatggtcgtcgctctcgtcgccacgtatgcgcttcactagcctgctacatcggctcccatacatacataccatgggcggccggagacggagaggaaggattttgttccgatcgagtgcgtttcaagtggccgcactttatgtgtgatgttctttctttttaaacttcgacgtgtagtgagagttgagagaggaggggagaaaatatagatgatcatgtatattttattttatttgcaataaaaccctgaccttagtag

SEQ ID NO: 61777 - DNA, 837 bp, Triticum aestivum
  unsure (1)..(837): unsure at all n locations
  Clone ID: PAT_TA_61777
actcctctcttattgcaagtcagaagcggccgagcgaggccaagctagagcaccaggcagatagccagggagcaatggggcggaggaggcaggtcctccatggcgccgcgctctcgctgctgctgctcgcggcggtcgccgatgctcagcagaccgatccaggcgacggtaagcaaagcttgattccctctttctcccgaatcccaaagctcacgccgcgcgttcctaaattctgaaccatcttgctcgaatagactagaccatccacttctcttggtcttggctactctcttccaagagaaatccttcctgtttttgctgcccgattgatctgtaaaaacaccatgactcattcgcctatgttctggccaaccgctgctgaagaaagcaggggaggcaacacgattctcctggttaatttcccctggattccttcgctgggttcgttcgcatcatctgcatgccaaatgatcccgttagctcttccaagaagccagccagccctcaagtcaacggaggcacgtcgacgactctgtctgatatttcggcgtttgacttttcccgcgtcggcacggaaaagtcaaaaactacgtccagtttcatctcgcctctcgaccgtcggatccgcgtgagcctggcccatcggacggcctagcagcggtctaacggctgaccggtgtggttactcatttgcttctgcctcgcagcggcggcgctgaacgcggtgttcgccaagctcggncagaaagcgctgtcgtcatggaacatcagcggcgacccctgcaccggcgccgcgaccgancacaccacatcgacaacaacccgccctttcaaccg

SEQ ID NO: 61778 - DNA, 599 bp, Triticum aestivum
  unsure (1)..(599): unsure at all n locations
  Clone ID: PAT_TA_61778
ggcccgctcgagggccggcgggccgggaattctaaacgcggcaacagcaagcaaacgctgcctagctacctctcacatcacacacgcacgatgctcaccgccatgcagcacatggactcctccgcctacgcatcctcgccctcggcgtcgccgtggcagcagctcctcacggcccaacgcggccacctgttgccctacgactacgagggtctcacgtccgtccccgccgcggcgcacgcgccggcggcgcaccagcagcacagacccgcgcgccgcgtcgccaggcggcggccgcgcccgtcgcggcggctgcccacgacctacatcagcgccgaccccgcggagttccgccgcatggtgcaccaggtcacgggcgccgacgaactcctcctcccgccggtccagcagcaggcggagtggcccctcctccccaagctcgccgcccgcgcagcgccttcgtcggncggcggggcactgctgctgccgacgctggacacgtcgtcgttcctgctcggcgggtgcagggcgaggccgtccaccgcgcggacgggtgcgatgccagcgccgacgactcccgacgggtcgttcccgctggacag

SEQ ID NO: 61779 - DNA, 671 bp, Triticum aestivum
  unsure (1)..(671): unsure at all n locations
  Clone ID: PAT_TA_61779
cgttgttccgtcgcgccacgtgacggaaacgaagagacggtcagacacgacgcgccaagcggcgcgaaggcacacgccaccgacgtcgtgcgtgcctccataataagcgcgcgagcaaccccccgccgccaatccccagccctgaccggcgcgatcaaccgaccatggccagcgacgaagcgctccgccgcttctactccgacgacgacgactccgacggcggcatgtatgcgtatcaccactactttgacgacggccaggatgacgccgggagggacgaggagggggcgccgcagcagccggtggtcaggaggaagaaggccgccgaccgcagggcgccgcgtgggccgctgaggtcggtcaggcggcgctcggggctgccgacgggatgcggcgacggcgccgggccgtggggcggaaagcagcggaggaagctcctggcttggcggctgcggtggaaggttcagcggcggcaggcgagagagaaagcgcggtggtccggcgtcaaggcgccgccgggcctgctcgacccgatcttcctggacctcgagattgatcttggtgatgattaacgagtggcctgagcatacgagtagagtagnatctgcttagttcttctgtgtggggaacgtttccgctggccctaaataaaatggaaagtacattcagtc

SEQ ID NO: 61780 - DNA, 659 bp, Triticum aestivum
  Clone ID: PAT_TA_61780
cggccgctcgaggcggcgggcgggaattcaacgaacatttctcgagccgatcgacgacatggccacgaccgagaagaagccccacgccgtgctcgtgccgttcccggcgcaggggcacgtcaccccgatgatgaagctggccaaggtcctggcaagggcttccacgtcaccttcgtcaacaccgagtacaaccagcgccgcctcgtccgctcccgcggccccggcgccgtcgccggccttccgggcttccgcttcgccaccatcccagacggcatacccacgtcccatgccgacgctgactccaggcaggacccgacgtccctgtgctactacaccatgaccacctgcctcccccacttcaagagcctgctccacgacctcaacgccgcggttggggcgccgccggtgagctgcgtcgtgggcgacggcgtcatgagcttctgcgtagacgcggccgcggagctcggcgtgccgtgcgcgctcttatggactgccagcgcctgcggattcatgggctaccgcaacttccggttcctcctagatgaggacctcacccctctcaaatgtatgcatgccatgcgcgcgcaagtttctactatgattgtgcatacgtgtaatgttgatctgagcagatgaagagcaagtgaagaacgggtaat

SEQ ID NO: 61781 - DNA, 789 bp, Triticum aestivum
  Clone ID: PAT_TA_61781
aatcccccaaccccgaccccgatctcaccaatcccccggaaccgaaaccctagccagcggcggcggcggcgatgggcaacccggagaagctgatggcgcagatcttcgacctcaagttcacgtccaagtcgctgcagcggcaggcgcgcaagtgcgagaaggaggagaaggagcagaagctcaaggtgaagaaggccatcgagaagggcaacgtggacggcgcccggatctacgccgagaacgccatccgcaagcgcaccgagcacatgaactacctccgcctcgcctcccgcctcgacgccgtcgtcgcgcgcctcgacacgcaggccaagatgcaggccatcggcaagtccatgggcagcatcgtcaagtcgctcgactcctccctcgccacgggcaacctccagaagatgtccgagaccatggacagcttcgagcgccagttcgtcaacatggaggtccaggccgagttcatggagggcgccatggccggctccacctccctctccacgcccgagaccgaggtcaactccctcatgcagcaggtcgccgacgactacggcctcgaggtctccgtcggcctcccccaggccgcagcccacgccatcccggccgccaaggacaaggagaaggtcgacgaggacgacctcacccgccgcctcgccgagctcaaggcccgcggctgaacgacggctttttcacttcacttcacttcaggtgattgtttagatctgatcttggcccctcatacacgaatgaatgagcgatataatactaattccctgctgc

SEQ ID NO: 61782 - DNA, 781 bp, Triticum aestivum
  Clone ID: PAT_TA_61782
tggttatctcctcgcagctccattcccctcccactctacaccactcacccactctcccttttcgtcgccggattggaagacggccggccaaatcatggcgtcgcgcggcggaggcgggccggagcagctggggcgggagctgggcctcgaggacgcctgcgtctacgcgcacgagatgtggcaagcgagcggggcgaacgctgggtcaacgcccacccgcgctggaggttggggacgccggcgggcaggagaggcaggggaggccagacccttcggcagcgagcacgggacgacgacgaacggtggaggtccggaagagggcggcttgagcgagtcgcggcggccgccacggcgccggcttctcccgccgacctcgtctgatgcgcggccgcccggagtcgacgacgccatcgtgcaccgcggcgccctccaaggcgactgcttctcccgccgacctcgtccgatgcgcggccgcctggaggcgacgacgccatcctgcgccacggtgccctccacggcgtaggcttctcctagcacagctaccatacgctgcccatgggcaacgggcacatcctcatcatcttctcgccgtcagttgaagatagtcttcctgaacagggtctacatgaagagggagaatgccggcagctggaattctgggctggaaaaggagcaaatattagagacctattctgcacaactcgaaaagtcctgaaacttcatgggagcatgttttggaatatataaaaaatactggcgaaagaattaaccagagggagcc

SEQ ID NO: 61783 - DNA, 638 bp, Triticum aestivum
  Clone ID: PAT_TA_61783
gcaatcccttcgactaacccatccagcaaaaatggccgctgatacccccgcgaagtccggtctggccgttggcctcaacaagggccacgtacgtttacctgtcgcagtctcacctcgtggaggatctctgcttcgccttcgcgacggatgacggcgcgacgaaatccaactagcagacgatggacgctgacatttgtcgccgatattacagaaaactaccccccgtgttgtcaagccccgtgtttcccgaaccaagggtcacctgagcaagcgcaccgctttcgttcgcgaggttgtcaaggaggttgctggcctcgccccctacgagcgccgagtcatcgagttgctccgcaactccaaggacaagcgtgcccgtaagctcgctaagaagagactcggtaccttcggccgtgccaaggccaaggtcgacgagctccagcgtgtcatcgctgagtctcgccgtgctggtcactaaatcgcttaatctgatttctgggaatctggaaccgaatggggttcgcatggattggcgtggtcacggtatgatctaaaaaattaacggctttgatgctccgtggcaaagaagctgcggctcaccggaataccaacactttcaagcaatttatggcataatgatc

SEQ ID NO: 61784 - DNA, 500 bp, Triticum aestivum
  Clone ID: PAT_TA_61784
atgctgcgactgcagccttcggagaaagtttgacacaacatgctccgtcgtcgccatcgccaggaccgccgcctcgagccttgcccgagcacatctttgcacacctgcaggcgcgatacctcgagaccgataatgactcgatgatcgtctaccttgtcgaagacccgttggtgtctgcaaaggaaccagatgacggagccactgagaccgttgccaccgccgccgactactactaccccgagggtgcctaataccacttgacagacaccgatgaccaagagtagttaggaggctcccaggtaggaggccttgcctttttgatcgatgttgcttctgtgctagccttctgaaggcaagcttgtttaactcatgtctgtactcagatattgttgcttccactgactcgtttgtattcgaactgatgtattcgagccctcgaggcccatggcttgtaatataaagcttgtattattttaatgtggttctagagttgtgttgtg

SEQ ID NO: 61785 - DNA, 536 bp, Triticum aestivum
  Clone ID: PAT_TA_61785
attttccatttgtgttccctccactcaccaggtccccagccgccccactacctgacggccacttgtgccgtggtgcacgccatggccgcctccgctgccgcttcttctcgccgtggcttccttcggctgctcgccgccgccgccgtcctcgcggcattcggggtctgggctgcccgtgctgcggggagctcggatgatcgcgcgctgctgagcgtggcgtccctgttccccggcccggcttgccccgcgacagcaggttaattccccggtcgagctcatgatcgccgcccgtcaagctggtcgcttttcttctctcagtcgttcgttgactgctgcgtctagctaattgaatccggccatggttgaatcgcctgtgttgtttctatttttcggccttagtaatttcatctcttcttttgacaccaactaataaatgcatactgcaacgtacgtcgatatgttgccatttgaatataggagtatattacttgtgtatatgtgatgataagcacagcattgatattcaatatgatatc

SEQ ID NO: 61786 - DNA, 793 bp, Triticum aestivum
  unsure (1)..(793): unsure at all n locations
  Clone ID: PAT_TA_61786
cggccgctcaggcggcgggcggatcctagctgctactagttgtagagcaacatgttgtggccgccgcagttgatcgaaggcccatctctggtatctccaattgattgaagattcttctgtttcctagtgcaagtgttactatgggaagcacaggggcagctagagcgatgccggtgcaggagcttgctggagcccttggcacacccgacgtgccggcaccgtacgttgtgcgcacgcacaaggaccaacagcttgccgcggcggttgtagcgccggtccctgtcatcgaccacggccgccttctaaggaaggaccacagcgccgacgaaaccgcgaagctccggtcagcgatcgagtcctggggcctcttcatggtcagtaaccacggcgtagacgccgccgtgatagagagcatgagagccgcgtcgagggagtttttccggcagccactcgaagagaagcaaagatacagtaatctaatctgcgacgagcagttccagtccgagggatacgggaacgaccgggtgagctcgccggaccagacccgggactggaccgaccgcctctacctcaaggtgcagcccgaggacgagcggcgcatcgccctctggccagcgcatcccgaaaacttcagggatgttctccaccagttcacgaagaaatgtggacaattgaaaaacgatctgctccgggcaatggcngaagctggtggggcttgacgacgagaactacttcgtggaccaccttgggggagaaggcccttacnaatgctagatgcagctactatcccgag

SEQ ID NO: 61787 - DNA, 467 bp, Triticum aestivum
  Clone ID: PAT_TA_61787
tagtccgacgctctcgcatccgcatcgcaccgctattgtcttccttcctcgacggacgcacgcacgcagatctcatccaaggcaggtacaagatggctctcaccagaattggtcttgctggcctcgccgtcatggggcagaaccttgccctcaacattgcagagaaaggcttccccatctctgtctacaacaggaccacctccaaggtcgatgagactgtccagcgcgccaagctagaaggaaaccttcccctgtacggtttccatgaccctgcatccttcgtcaactccattcagaagccacgcgtcgtcatcatgcttgtcaaggctggcgcaccagttgaccagaccatcgccacgctcgcagcacacctggagcagggcgactgcatcgttgatggaggaaacgagtggtatgagaacacagaaaggagggagaaggcgatggaggagcgtggactcctctac

SEQ ID NO: 61788 - DNA, 594 bp, Triticum aestivum
  Clone ID: PAT_TA_61788
gccggccgggtccggaaagagcaacaccacatttagaatgtcagacacgacactggtcaacgggcccgatgccctcgaggagaagctcggtcgcttatcaaagaagcctggtgtgaaagctagcattgtcctcgaccgcgctacaggtgcgatcctcaaaacaagcggacaagtcgacgccttacagacttcaaagtctcgaactacatctacggccacaacattctccaacgaaacacctgcgctagaagagaacgaaacacagggagtcgagcagttcgcagcgatcgtctggaactatgtgaatagctctgggaatctggtccaggagttggacggtgaggacgaagtgaagcttctacggttgcggacaaggaaacaggaattggtcatcgtgccggatcccaagtatctgcttgtcgttgtgcatgatacgccaccagcttgagctccgaaacattcttgtctgagtctaacaatgcttcagcagactagagccaatcgcttgttgggtactgccgaaggattgaggaaagggactccttgaatcaaagaacatgtttgcagcaaaaaaaaaaaaaaaaaaggccccta

SEQ ID NO: 61789 - DNA, 624 bp, Triticum aestivum
  unsure (1)..(624): unsure at all n locations
  Clone ID: PAT_TA_61789
gccggccgggtttcggaaacgctcttctgcctccaactcgctccttcataccctccacttcccttccatactcccccagaaataatgtcgtcgcaaatcacagacgagtccctgcgcgaggctatcaaggagcgcctcgaagccgcacacgttgaggtcacagatatgtctggcggctgtggtcaagcattcaactcagtcatcgtgtcttcccaattccagggcctcaactctctcaagcgccaccgtctcgtcaatgctgccctcaaggaagaaatcgccatcatccacgcttggaccgccaagtgccagacacctgaagagtacgccaagacgaaggaagcagccgatgcgccagcacaggcataagctttcactctctctctccttcaaaattactagaatcatgcaacatggagttttttgcgtaaagacgggaatacggcagacacaagggatggaagaacaagaatgtgatgaagggatttagatgacgagatatccgtatcggagcggtttggtaccgcgatacatcacgaagcaacaaatatcaagaaatcanctttannanaaaaaaaaaaaaaaaaaaaaaaaaaagaaaaaaanaaaaaaaaaaggccccta

SEQ ID NO: 61790 - DNA, 192 bp, Triticum aestivum
  Clone ID: PAT_TA_61790
gccggccgggctccggttacttcaatataagcaagtaggcagtgattttggccctacagaagtttagagtggccgacattttccatatgtaattgtagtgatatcttcttcacatttagaagtatgctggactttttatatatatacgacatgcgatttttttacgaaaaaaaaaaaaaaaaaaggccccta

SEQ ID NO: 61791 - DNA, 776 bp, Triticum aestivum
  unsure (1)..(776): unsure at all n locations
  Clone ID: PAT_TA_61791
gccggccggtttcggatcaacaactagccaactactacattcacaatcaagatgctattcaagccatcttttctcattttctctctcttctctctcggcactgtcgcctgggatgcccccaactacagtggcttcactaaagtctggcaagatacctttgctggttccggcggcactctgcccgacaccagcagatggaacatcataacaggataccttaatgtcaatgcagagcttgaggtctacacttcttccacccgaaacgtccaacgaagcggtggtgacactctccagcttgtgccgtggcgcgatgcttctgcacaaaacggctggacttctggtcgtatcgagagcaagtatgttttcactcctcaagcaggcaaagtcacccgaaccgaagccaacatacgcttcggtacctgctccaccaacaacaagcaaggtatctggcccgccttttggatgcttggaaacatcctccgcaacggtggtagctggccttcttgtggtgagatcgacgccatggagacagtcaacggccagctcactggtcacggaacagtgcactgccancgtctatcccggtggtatctgtaacgaaggtaccggtattggcaacactatcggaatcccagatcagagctggcatacctgggagagtcgagtttaaccgggccaagagcagctggcgcgatgagactatcactgngttcatgaatggtcagcagntccaccagatctccggtgccaggatcaacgaccaaaacgtttggaac

SEQ ID NO: 61792 - DNA, 458 bp, Triticum aestivum
  Clone ID: PAT_TA_61792
gccggccggttcgggtcctatgggtcgttcggcgcccgcccccgctgagggagtcctggactaaggggccctcggcagtccggcctgttggccatgggccggactgatgggctgtgaagatacgaagaccgaagactgcacccgtgtccggatgggactctccttggcgaggaaggcaagcttggcgactggatatgtagattcctttctttgtaaccgaccttgtgcaaccccatatcctccagtgtctatataaaccggaggacttagtccggaggggagatattcattacgttagtcatacaggctagacttttagggtttagccattacgatctcgtggtagatcaactcttgtaatactcatattcatcaagatcaatcaagcaagaagtagggtattacctccatagagagggcccaaacctgggtaaaaaaaaaaaaaaaaaaggccccta

SEQ ID NO: 61793 - DNA, 157 bp, Triticum aestivum
  Clone ID: PAT_TA_61793
gccggccggttccaaaaagttggccaattttcttatttcttcgaaaagtgggagtaaagtggaccttatgctttatcttataaaaactgaatttactcacatatatttactgccgccaaaaaaaaaaaaagaaaaaaaaaaaaaaaaaaggccccta

SEQ ID NO: 61794 - DNA, 521 bp, Triticum aestivum
  Clone ID: PAT_TA_61794
gccggccgttttccgcactgacgagagcaacttcgtccatgccatgcgactgttcaaggaggaccccaagtggacaccactgaaccgcggccccgatgtcgacaagaacgagcaccgacaagaatacgtgaagcagttcattggcgagtctaccgagtaagaagcccacgtgggaaacaagtcgtctttgattgtaggggctaagtagcaggagatcaaccacattaccggtccaactcaagagccagcaagcataaataccgctgcttgaagattctgcgccgcaatggagagcccagcgttgacgtgacgaggagggccttttacgtcatttcgtgatttcaaacagcttacaactacgtacgatttgcgagaaacgaagagtcatggcaaagtttgcatatccaacgtctgatagcatagtgcacggtttatttcgagatgagagttagcgggagttgaaaccatttcatagcaattgaatattgtgcatccaaaaaaaaaaaaaaaaaaggccccta

SEQ ID NO: 61795 - DNA, 782 bp, Triticum aestivum
  unsure (1)..(782): unsure at all n locations
  Clone ID: PAT_TA_61795
gccggccgggtttcggaattgcaatcgccatggagcacccgtcgagcgcgaacctgccggctcacaagaagcccgacacctactttaagcctcacgatgtcctagacgacactgcaaaggctgccgtggttggtggtctcagtggtctcttcctctcctccgtcaagaatgccatggccaagcacaatgtcggcattctgagcgtcttcacccgtggctctgccatgattggtatcggagccgccgcccccgccgcatatgtctttgcttcgcgaacctctatgaaccttcgtgaaaaagacgactccttctctgctgctctcggtggttttgccctgggcgctgtccttggtcttcccacaaaacgaatgcccatcgtcatgggtctcggcggtggtcttgccgccttccagggtatgttccactatcttggcggccgatacgactctttcaagcgagagggcgatgagttcgagcgcaaggaaattgtccgacgatccacccgactgcctattgagcagaccatttcagggattggcgaaggtcgaggcattcgacctcctggatacgatgagcgaagggcggagcgacttagccagaagtacggagttgagattaaccccatcaaggcgactgtcgagggtagccaataaagcacaaaacaacacgcaggcgaacgggacgggagcgactgtacataactcttctggccgaggaagaggtgtacctaggagaattggagttttgttttgtttccaaaaaaaaaaaaaaaaaggncccta

SEQ ID NO: 61796 - DNA, 564 bp, Triticum aestivum
  Clone ID: PAT_TA_61796
gccggccgggctgcggtgcggtagccgccgcggctatcatgtgcccggcgctgctctcttgtcctggtggccaccgacgaatctaagtcgaccctgacgctgcatcagctgacctgcccccaccgcccgatcccccactcaatccttcctcgccgccgccgctgccgccgaagacctgggggggacgaagctaaattgcggactggacacctctgcgtcgaggataccgacctcgagcagtccaccaagaattccgaggaggccatcctcagcgacctctccttgctcggcctcgactgggacgaaggaccaagaatcagagaggaaggtctgccaagaaaagaggatgtcacatggaaaatgatattgtacttattatgctgaattctgaattgttgaagatcatactgtattttagctattaatcataaattttttagaatcatgaggctccttctgtatgaccattactatgaattcttgaaggaacgtgaagattatcactaattattgaaagaaaactgtatacatttgtactaaaaaaaaaaaaaaaaaaggccccta

SEQ ID NO: 61797 - DNA, 615 bp, Triticum aestivum
  unsure (1)..(615): unsure at all n locations
  Clone ID: PAT_TA_61797
gccggccgggtcgggatcatttcgtgatctcggcgcaaccaatttcacaatcacctccaagatatacaaaaaatcatttaacaatggccgacaaacttagaacccaacaagagctcgagcgccttcaggcaaagtacatcggtactggtcacccagacacaaccagctgggaatttcgtaccaacatccagcgcgacacatactcttccatcgccggccaccgacctcttctttcctacatcgctctggctgagaacgagcccgtcgccaagatccgcgctcagatgatcaggaaaatggttcaaccttgtggtcctcctcctccgcgcgaagattagaacatgtacgatataagcgatgctaagcacgacatgcaaaagattcgaaattggtttggcttggatttttagacggcgtcaaggattgatacccccgtggaaggggtacttttagacatactgcgacatctcgccttacgatcgcgttcatactttccaagcatacaaatgtaattcgctgagctgtattgngtatcatagtgtcgaccttgaannnnnnnnnnnnnnnnnnnnnnnnnnnnnnnnnnnnnngaanaaaaaaaaaaaaaggccccta

SEQ ID NO: 61798 - DNA, 412 bp, Triticum aestivum
  Clone ID: PAT_TA_61798
gccggccgggttggggacgccggcatgagcagttttggtgcatcttgaatgctttgcacgatttcaataccgaataatggcatcgttatgacgattcttatgatggagatgaagggaccgttggtttcatggccctaggcgttttctgttgacggatgacttgtttggtctccgtaagcatggatcggtgtttgtatgttggtgttaaataggcatactcggatagactcttgctcagagctatatgctaagtaggtattcgaagcgtggccatgtcgcgaatattaggtactcatcgcctacatagcttgctccttccaaagtgctatttagggacacaccgagagagcaagcatctttatctaaaaataagttttggaatcaagaaaaaaaaaaaaaaaaaaggccccta

SEQ ID NO: 61799 - DNA, 508 bp, Triticum aestivum
  Clone ID: PAT_TA_61799
gccggccgggtctcggaaaaaaattgcaacgctctccttctcaaggtcaaccagattggtaccctgaccgagtccatccaggctgccaaggactcttacgccgacggctggggtgtcatggtctctcaccgatccggtgagactgaggacgtcaccatcgccgacattgctgtcggtctccgtgctggcgagatcaagaccggtgctcctgcccgatctgagcgtctcgccaagctcaaccagatcctccgcattgaggaggagctcggtgaccaggctatctaccctggtaaggacttccgcaagtctgttaacctgtaaatgatggttaccggatgggtggaacaaaaagccttgtgatgattatgatgcctttgggtcttcagccaggacgcgtgagaccatataccaggatggcaaattgaaagtaatagaggcaaaaatagtaaaagccaactgatcaattaattaaactttgattgaaaaaaaaaaaaaaaaaaggccccta

SEQ ID NO: 61800 - DNA, 430 bp, Triticum aestivum
  Clone ID: PAT_TA_61800
gccggccgggctgcgactgcctcctccctcctcccctctccctccaatgccgccgccatgtacgtggaggtgttcaacagaggggtcatcccgctggcctacagcatcaggaagaggaacagccggaccgggctgcccttcacctactacgacggcatctacctcctctggacctacttcaccaagcccgagtcagtggacgcccttcagatgaagctcaatgccgacgatgatgttatccgctcgaccagcttcaaagtccgcaagaggagagtgtactaggaccaagaatgtaaaattggtttcatctggactgggctgaaagctccatgtttttagttcgtgtttatatcttacgagaatgctactgcctacattgtattgtagatgtatgccttcttttgaaaaaaaaaaaaaaaaaaggccccta

SEQ ID NO: 61801 - DNA, 230 bp, Triticum aestivum
  unsure (1)..(230): unsure at all n locations
  Clone ID: PAT_TA_61801
gccggccgggttcctgatcaagacaaactagaacacaagactacactgacaaggcacatcatcactagagacggagagagctcatttcattaagtgtaaaaaaaaaatatttgtagtcattcgtaaaagcaataaggaaaaaagcaaactcgctaactcgaaacaatgtatctagaagtnctctcaatgccccgaatcgccatagaaaaaaaaaaaaaaaaaggccccta

SEQ ID NO: 61802 - DNA, 649 bp, Triticum aestivum
  Clone ID: PAT_TA_61802
gccggccgggtcgggatcatctcatctgccttttgttctgcttgtctttggattgtgggagcatatgtcaagattggacaccctgctactattatcgccgagggcaaggatttgtcgccatcaactgccgctggtggtaaggctgccacagccatgatcatgatctactctgtcttctggtcttttggtttgaacggtatcccttggattgtctccgccgagatcttccccggtgctctccgtactttgacaggtacatacgcggcctgtgttcaatggctcactcaattcgccatcacaaaggccctcccctacatcttcaagtccttcggctacggaacatggttcttcttcgcgtgttggatgatgatcgccaccatttgggccttcttcttccttcccgagaccaagggcaagaccctcgaagagatggatgtcatgtttggctatgtgcacgatcgggcgcccgccgagagcgacgacatgggcggtaagcttggtgccaaggcatcagtaactgagcatagggaggacagcgtttgagcagatttacataagagacgaacttagtaggacagtttatgctacttagatcagaaaattgttagtctgtttattttgataaaaaaaaaaaaaaaaaaggccccta

SEQ ID NO: 61803 - DNA, 484 bp, Triticum aestivum
  Clone ID: PAT_TA_61803
gccggccggtccgggaacctttataactgtcagagacaccggctcacagccaacagatgatccaaaggttatgtagatctttccatcactctcaaggtaacaaaatcccgcctcgtcgaaggcctcattctcccatgcgagcttgccaccaatcacagaaaaggtggttgtgatagcatcagctgggggttggccattggcagctagctcctgtcgctcaccaccagcgtagtaaatcggcacgccgttatccaataacttgccgttgtcaagacggaaagcagaggcaaaggtacagtcagaagggttatcgtttccaacaaaggtggtgtctctcttggacaaacgcctgatacgattgatctgcaagataattgcttcaccggctggctcagaaacacttgtagtagtagcagaagcttcttccgtagtagaagtaacaaatacagaatcagtagaaaaaaaaaaaaaaaaaaggccccta

SEQ ID NO: 61804 - DNA, 681 bp, Triticum aestivum
  unsure (1)..(681): unsure at all n locations
  Clone ID: PAT_TA_61804
gccggcctggttgggagcaatgaacacaggatattgtcaaggtcaacgaacactttgactctcttcgaaagggatggaatgatgtcaacacctactggaacgacgtcgactatgccatcttattatccttccttcttgtcggaaaatcctcgacggagatttgcaagaagatgttcgaccactttgccaacctccgagtcgaatatgctcaacgcaacacggatttaaatcgctcgcgcgctggcgccgctctcttgacgttactgacaggtggcctggctgcccccgtcacgattccgatgatgatgggagctggcgacgccgcaatgaccatgtcagcgaatgaccgttacctgtggggagaaaggaacaacatgtgcaaggaacacatgacgcgacacaaagaactggaggcgattatcgaattgaaggatatagagataaatgttaccaagccagtaaccttgcctccagcattagagtcgagttggttggcagatgatggcttggtaagaagggttcacacaaatatgaatatccacacgcggatcttttatcattgaatagctagattcattgagatatatgtccaagattacatataaagaacgctaaatagaatgcaatatacacctaaataccaaaaaaaaaagaaaaaannaaaaaaaaaaggccccctaa

SEQ ID NO: 61805 - DNA, 521 bp, Triticum aestivum
  Clone ID: PAT_TA_61805
gccggccgggttcggggaaataggaacaaggaccgaaacaagtctaaatgcgtggtattatgagtggatacgcaccatcaatggatgaagggatccatatgttaagaggagggaaaataaggcggacgagcaaatcgagacgccaacaacgacaacaggccagcgtcaagggccacatataaggtgatgcctttggcgagatcaggatatgcccaatgatttattggcaagataccgtgggaagtacagagagatgggatgagataagaagggatttattacttttctgcaatttctagatggccaactgcccaacaaacagggcgacatgacgacgcagcatcgaataacgaacgaaagcagaagcagttccgcaccggcgcaaggcgtacgaacaaaaagaggcatattcttggggcgctaggttatttgttgacatttataattatcgttttgcaacatttacgacaaaaatttgaatggcattcataattcaaaaaaaaaaaaaaaaaaggccccta

SEQ ID NO: 61806 - DNA, 588 bp, Triticum aestivum
  Clone ID: PAT_TA_61806
gaactccagcaatccatcaccaaacgtacagtcgccgccaaccagtcgcccaatcagtcaaaatggccccccagaagaagagcaagaaggatgccaacagcatcaactccaagttggcgcttgttatgaagtccggaaaggtcactcttggttacaagtctaccctcaagagcctccgatccggcaaggccaagctcatcatcattgctggaaacactcctcctctccgcaagtctgagcttgagtactacagcatgttgtccaaggcccccatccaccacttctctggcaacaacatcgagctcggtaccgcatgcggtaagctcttccgatgctccaccatggccattctcgacgctggtgactccgacatcctcagcgaccagcaggcttaaatgtctcgttgatagagaatgtttttcaaggcgtttcggggtaaaatgggtctagggcatttgaggatataccaaacaagggtgatgaaaagcgacgactcttagtgagaacatgtagtgcaatgcaaagcatcgcagttctccccaaaaaaaaaaaaaaaaaaaagaaaaaaaaaaaaaaaaaaggccccta

SEQ ID NO: 61807 - DNA, 871 bp, Triticum aestivum
  unsure (1)..(871): unsure at all n locations
  Clone ID: PAT_TA_61807
tcgaggccggccggttcggctatgacttcatccatgggacatctttggtggatggcgcacgatgggacggcaagattcggctcataggttttgttgatgtattcttccttatctgttactcaggagaatctcgctttgagaagggcatcatcgtatacaaggatgatgtttttatccgcgagattctccgacaaaccaacgttacggctacagagctaggccttgaagttacgaaatgatgagatagtcgccgcaagggagaagggtcgagaaccgattcttgaaagatactttaagtttcagagcatcagaggtggtctcgactacaccatagctagcctcgggcatgaaatcggagtcaagacgcggtacagcaagacagaactgaagaagtatgatatcaagatccggaagggaagagattttgctatgaaaaaacgcgtccgtcgtggggtttcccagcataatttatttgacttgatgcacgatgcaattcgactcggaatagtcacacatgctgagcttgtcgggcatattgtgggtaaggctatcggcggcacgacagtggaggatatgggttccaagtattttgaggccatcacaggcgccagaagctcgcagaatgtggcgttggcgggggacaggtaggtgatggtctgtccaagactcatcaaggaggtggggaattttgcgcaatggacagttgaacacacagaccaacaatacattacntagcggcatgactgtcgtgtcacttgatttttctttggctgtgtcgtttcaaatctccactactatccctgcacattagccagggtgggacaacgtattgcattctcactgtcgaatacacaatacnattggatgacta

SEQ ID NO: 61808 - DNA, 607 bp, Triticum aestivum
  Clone ID: PAT_TA_61808
gccggccgggcttgcgatcctgctaaccatctacctcactacacaaaccaaatcctctgctactacccaatcgcaacaatgttccccactatgaacctcttcaccctcgttctcgccatccctgctgttctcgccgcccccgcaactgaggccagaacagctggaaaacaggtcctggcctgtgcttgtgccaatgccgcaggccagaccaagatcgacggttactgccaatacattgccggcagcaatgtcaatcttgacggccagagctactgcttccctgccgctacgtggtcagagtacatggacacccgcttcacagccgacttctgtcctggctactaccctggcttccctaagcctgtttgcaagactgttactgtttgccctacgattggcgactaccaggacatctgctaagttggatgatattggatatgagggccgacagcgattcagatggacttgacatttcatccattgttcagctctttggtctacatgttgggtttccgtcgtcttcgtgctaccatgtggttatattttctcacggtatatatttatctctacaatttggactccaaaaaaaaaaaaaaaaaggccccta

SEQ ID NO: 61809 - DNA, 732 bp, Triticum aestivum
  unsure (1)..(732): unsure at all n locations
  Clone ID: PAT_TA_61809
gccggccgggttcgctaagatcccgttggaattaaaaaaaaaaaaaaaaaaaaatgcccgaccagtcccatccgccgccgcgcgctcccgatccggaggagcagctcctcccacgcccgagcccgctgaacccagcctagcacccgcgcccaccgcccctgtgcaggtccgcctcgtcgaagatccacatcgcgtcgctgcccgttcaggatccaacctcaacgcctcctggctaggcttgaggaacgcatgccgggagagcctccgccgcgccggtggtagcggcggcgaggccgacgcgccaacgaccattgttcaaggggccatgcaggatgtgcttccgcatcaccctctcctccactccgacggtggcctcggacagggcaggaattggataacacgtccaccacctgatcgagcacaaccgcaacagaggagggccacctctgcctcgtcgtgcaggagatgcttcactagggctgaagtcattgtctggtttttcttccttctatgattccattttgattttttgccggtagttcatgatgtcgtttctccacaatccttaccgtgcttgtgtagaagaacagatccaatttttcgagagaaacatgctttgttgatctgttgctgctgctcacgcaggtgtcggagcaggtgcttcgtgacggnctgggtttgtctataggtatgtccctttttgtgtcaaaaaaaaaaaaaaaaaggccccta

SEQ ID NO: 61810 - DNA, 417 bp, Triticum aestivum
  Clone ID: PAT_TA_61810
gccggccgggttccgaaaaacactgcccccgtcccctctcagcctccggttaccggcctctccatggcccattgattttttcggatattccctcgagctgtctctcactgaccctgagtcaccttcatcttgtcttctcgcattgaacaattgctattttcccgcaaaaaagaagcttcttgtcctgactagagaaccgttacttgttctcacgtctctacaagatggcatctctgcggtcgttgactgcttcccttccctgggtagcccccgcgaggggcgtcgccgctgtgcgatatagctcttcctcgacctctgccaaaaaaaaaaaaaaaaaaaaaaaaaaaaaaaaaaaaaaaattcttagcaaattgaactctcatttacaccgaaaaaaaaaaaaaaaaaaggccccta

SEQ ID NO: 61811 - DNA, 191 bp, Triticum aestivum
  unsure (1)..(191): unsure at all n locations
  Clone ID: PAT_TA_61811
accggtaaataccggacccgtttccgcgcttccctgcgaaagnaggntnagaagatggnnatcncccnnnacgnaagtacacttgcaccttctgcggaaaggtcaccgnnaagcgccaggntancggnatctgggantgnaagnnttgnaagcgnaccgncgccggtgntgnttacaccgntgccaccccc

SEQ ID NO: 61812 - DNA, 841 bp, Triticum aestivum
  Clone ID: PAT_TA_61812
gccggccgggtctcggatttaggtgacctatagaaggacggccgggccgggtgttgttgttgttgttgttgttgtttttacaaacaactctttaattctttaattaaaccaccaacaacaaccgccatcatgcagttcaagaacatcatcctcactcctctcgttgctgctggcatcgcctctgccgctcccaaccccgacatcaagattttccaagctgttgctctccgatctgcgagccccattcaccataccaaccttcaggcttccaacaacggcttttccctgaagctcaaggaccagggcgcctcttgcgaccgtggtgagaaggtcgactccgctacctttgccctcaataccaaaacaaaggagatgctcctttacgccacatcttttccacgtcaaagcgcgtggaccgatagaagtggcatgggccagggcatgatgggataccgtaccggcgctcagcctctctgcacccgctgcgaggacaacaagtggtccatctctgaggacaacttcctcaagtacgatgaccgtgacaacttcatcgcctgccctcagaccgatggctcttacaccgtctttaccagcgctggtgtcaacaaccctgctggtaacaaggactgtgtctctgtcacctttgccgtcagcgaggtcagcaagcccgtcggctgcctctactcccagcagggccagtaaattctgagctctgatgttccaaagggatctgtctagactgccttctacctaccttcttggctgagatctttcgatcttgttataacgattcacaatgcatatattaagcgtctccgtttggttcttagaaccttgatct

SEQ ID NO: 61813 - DNA, 395 bp, Triticum aestivum
  Clone ID: PAT_TA_61813
gccggccgggctcgaagaaccgaggtcacacccacacaagttctccttgcttgggcccaggttggcggccacagtgtcatccccaagtccgtgacccccaagcgcattgctcagaacttccaggagatcgacctttccgagtccgatatcaaggaggttgaggaggttggcaagcagcagcgccgatacaacgttccctacgtcgccaacaagcctcgatggaacgtcaacatctttggcgatgaggctgaaaagcctgctacacaccaggttatcatttaaatagataaaaagcaaggctcgggtatgtctcagacataaaggaaaagacgatagacattgaaataacaatatgataccattcaaattaaaaaaaaaaaaaaaaaaggccccta

SEQ ID NO: 61814 - DNA, 865 bp, Triticum aestivum
  unsure (1)..(865): unsure at all n locations
  Clone ID: PAT_TA_61814
gccggccgggttcgggacattacatttcatggccaattgtgttatatgatgcgctacatcaaacttctgagacccagactccaaacctatactgtattgccgagcatttggaacttcgctcgaccggccccgctctctcgggtccgaagccgcttcggccatcccgtcaacaccaacctctcagtctcacatatcaacgccttctcatcagccagcatggagtatccttcttatagcaattcagtcatctgcccagcgcttgatattgcgcccgccaacgcgccacctgatctgttcgcttcagagctctccttctttgcttcacatccttggactgcttctctgctgtccgcaccggatacaatcccgtttctcccatcgtgtcgaaaccctcaatcatctgcgcatgatcagctttttggaaactcgcttaataatgctcgtggcttgacgcatttcctcagctatttccgtgcgccaagtgttgaggttgccaaggatccatcgcacaatatcactgagattgttgtgctggtatcagtgggagagggcgtgagcgggtatcctggtattgtgcacggcggcatcgttacagctctcttggacgaatctatggggactatcttcgatctgaacggcacattaggtaaagatgccagagcgttcaaaacgtccaatgtaacaggtggaatagacgtanagtttctgaaacacgtgccaacggatagtgttctttgtatcacagctattgcagaanaaatcgatggtcgaaagccacagttaggngtgagatgaaggacgagcaagggcagctgttggcagttgctcaagcaagtgggtagcgctgaagccaagcctctgatac

SEQ ID NO: 61815 - DNA, 563 bp, Triticum aestivum
  Clone ID: PAT_TA_61815
gccggccaggctctcgtatcctaaaacaaatcagtcaagctgtcattgcctactcgctgacccatggtctgggtggactgacgctatggtgccgccagccaccgccattccattgccttggattcggttgtgtcgtgagctggcaaccatacagtgttgtctgatgcatcgtccgagccggaggtttggttggctgatgccaggcatgagcagctcctgagagcatggttaataatctatccatccattgatccatccatctatctatctatctatttggggcgatgatgataaaacatggctgacataaacttgtcctcgattattcgaggagctgtgggcttcaaaaacctactctcccctcttttggcaccttatcattctcactgaatattgatgtctctgtcttggatggtcattctgctgagtgataaccagaggagcttgacctcagtggtggggttgatctggtgaaagaagatggagctaggttgtatgatctatcaaaggcgaatctgagccctcaatatgaataagaaaaaaaaaaaaaaaaaaggccccta

SEQ ID NO: 61816 - DNA, 611 bp, Triticum aestivum
  Clone ID: PAT_TA_61816
gccggccgggctcgggagcactaacagaacaggcaattattagcatctggtctaccaagccctcttgatctctcgattcagcgagcagcaaaagggggtctcaggtgtctgatcggagcatccacgcgatccatggccatggagaggtttctgactgccgtcgtcttctgcgcggcgcccctggatgaatacggcatgttgatgatgacctctagggcgatcaagccgcaggtgtccgctggctcgatgaagctggcggctgctgcgcccaaggctgaggatgcgtacgcccggaagaagcctggattctgcggcgagacaatcacgcagcggcgtactgggtacgagctggcgttcgacggtctcaactgctttgacaccgtcgtcgtgcaccaatcatgaaaaatgattgattcattgtatgtttgtatggacgtgtgtaatggcataacggttctttcatttgatctgtatatttaggacttggatcaattgggttgttgacatgtgcgtctagtaatggtttacttatcgaccacactatattattactgcataactttgacaaaaatgagtcagggtcgtaaaaaaaaaaaaaaaaaaggccccta

SEQ ID NO: 61817 - DNA, 854 bp, Triticum aestivum
  unsure (1)..(854): unsure at all n locations
  Clone ID: PAT_TA_61817
gccggccgggtctcgttgcctttgcaacggtcctctacgaagacttcgtcgcggccatgctcccaagagtccgccgtgagaaccaatactgtcgccctaatagccagagcacgggtgctggactgcgcgatacgctgctaatgttcgggaggaacaagaactccatgatgaaagtagcggctgcgatcaaggctgcaacatcagagatggacctgtgctactacatgcagggaaacagatacgtgctctggaatttccagaacatcttcccaagtcccaagaccggaaaatgtactggtacggtcgagttccgaggcggtaaccagttcctgaacacaaccggaaccctggcttgggtggcatttgtgatgggcttcatcacgctggctatagaggaggatctcatcagcaagtttaccctcttcacaacgtctgaggatcccaagtttcaagcacgtattgaaagctggtggaagcgaattcgctcatcagccaaggcatccaagcttagccgatatctcccttcggagtatacttcaatgcatacccgataaaatcgggtagcgttgattcttcatctacaacagacccaccccagaaacatcggggtcaaggcaaatattcttttgcttttgttttggtttcattcaaaggtttcttcacatttaagattgcattgctggangttggtggagtttgggcatatggcagagacacaattcaacgacaaacaggataaataaatacctactcgatcatcaagtgatagattgagctgatagaaatttgcatattcattgttaactatataaatagatctacattcatacaaaaaaaaaaaaaaaaaaggccct

SEQ ID NO: 61818 - DNA, 335 bp, Triticum aestivum
  Clone ID: PAT_TA_61818
gccggccgggttccgtatctttagctcccgagtccaacttgagaacaaactcatctgatacttgtcattgatggtagatactagcagttcatgcgatgaattttctcgccgttgatgtagaatgtgtaacagtttactctgcagacgtcaatcaatgtatctgcgtttgaaacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccccaaaggccacgcccccttaaa

SEQ ID NO: 61819 - DNA, 508 bp, Triticum aestivum
  Clone ID: PAT_TA_61819
cctgtgcggcgctcgggccggccggttcaaattcactttccggtaccgaagagtacctcgccgacaagcccactggttctttgggacaagtactgatccgatgcaataacgtgctatgggtgcgcgcagctgatgcaggaggcgacgcggatgctgccatgtctggttaatcttaatctctatggaaggcgatgggactatctgatctgagggatagagaggaggatacggcgctctcgacaacgcagagatttaatctagtatgagccctgcgcccgggacctgccctgacgcgacaccgcttttttcaaccaccaaaaactacacccgaggctgatttcatgtactcacggacgcttcatcgcgacgccgcagttgtcgacttatttcaaaatttagatatgaattccaggcggacgactcacgcagcctacagaatggcagggttgctgggtcttaattcttatttcaacttctgagataaaaaaaaaaaaaaaaaaggccccta

SEQ ID NO: 61820 - DNA, 762 bp, Triticum aestivum
  unsure (1)..(762): unsure at all n locations
  Clone ID: PAT_TA_61820
gccggccgggtacggaaacaccccaacaccaacaacatgtctcacgcaaaggataccacgactccagaccccaaaggaaagggcaaagaagttgctgatcccgccccaaagagcatcttaaagtcaacccaggatgcctctgccaacatctcccagcacgtcaatttctcttgggaagctaacacaataacccgcatcccagccgacaatcgcggtcgtcgccttcctaccggtaaagagaataggcgcgagcgcttgtactataatctcgagaagaatcgggtggttgccaacaactctagcgttgaatgcggcgcctacgttacccaggacgatacctgggatgaatgggaaatgatctctcgtcccggccaggaggatgctacctccgaggtgggtggagaaatcaccagctgccgtgaggttatgaatctgcctggcgacgaccgtgccgcctctatcctcagtgagccgtttgagaacacgtgcacccgactccagcgccaactgcagcgtgacttcgagactgaccttaagtgatcatgtttcctcagtaaactcgacgaataaaagtatgaaatgttgaccgcgtctacttgcaatcgtagttgttccctgggcaatgagaactgcgcccttcgtagcgtaatctcgctgtgagatgtgngtatttcttatggtttgtgaccctggggcatcgcttgggcaaatatcgtagaatattaggtacctatcgcaaaaaaaaaaaaaaaaaggncccta

SEQ ID NO: 61821 - DNA, 517 bp, Triticum aestivum
  Clone ID: PAT_TA_61821
gccggccggtccgggaacaacacttctacatcactcttataccaaaccaaaaaactacaattcaaaatggctgcctttaagcactttgcccaagctcaatccaagttcgagatcccccctctgtctggcggaaacacctttatcggagacatccactccacccccgatgacgccgccaaacccattacaagcggcctctttcgcgtcaacaagggcgagcccttgacctacacatacaagtacgacgagaccaagatcattctagagggcaactttgtccttgaggactctacgggacaaaaggtcgaggccaaggcgggagacatcttctttatccccaacggagccaccatcaccttttcgtctcctgatacaggactggctttttactcgggggcaagaaagtttaacgatctatgagggtggaataaatagagaataataggactgaatagaatgcttccataaagctaatatatattctcaagactaaaaaaaaaaaaaaaaaaggccccta

SEQ ID NO: 61822 - DNA, 529 bp, Triticum aestivum
  Clone ID: PAT_TA_61822
gccggcacggtttctccacagccgataagcttaagatgggtgctatgatgggtggaagtatgacttacttgcttagttcttgaatctatgtttgaatatttctaacatttttttttctttttagctgttggtgtcatcatgggctttgtctttggaaccgtcaacattttccgatacggtgctggccctaacggcatcatgagaaccctcggccagtacatggccggctccggtgcaacctttggcttcttcatgtccattggcagtgtcattcgatctgatacggatcctaaactgcacgacatgtatatgcgagcccaacgtcgacctataatgctgatggcaaaccccgcatggaggaaatcatgagaccagcaacagatcatacgatacgagagcaatacccagtcgacttcaacgtccaccttgtacagtctggcatctgatggccgcattctgtaaaatatatcaaatctatttcgaaaatggaccaatgtcatgccaaaaaaaaaaaaaaaaaaggccccta

SEQ ID NO: 61823 - DNA, 706 bp, Triticum aestivum
  unsure (1)..(706): unsure at all n locations
  Clone ID: PAT_TA_61823
gccggccggttcgggatcatggccgtcctcctctaccaactgccgctctagactcacgcacacacgaattagactccctcccctgtcgcgctcccgatcactcaatactacaagtatatcacccgccgcncctgtctcggacagcatgcgctgcacgcaaccatgactgatacatatacgtcttgcagagcacgcactcgccggccctagttcatcagcgagtctgctctcggactcacgatcgtctgctaccaacacctcaccaaaagcataaagcgatgagatgcaatgcccctccggcatcatacctcagctctaggatgaatctactagaccgcatgctatacaactgaaccgagatgaccctccctaagaacaaagctgcttactgaactagctgtctccccctcacgtgccccagtgtctgaagacccgcctctgcaatcacctgcccagctcgagctggggtatcttcattgatatctgctgtacagtgacggcctctatgggctgtcactgcttgccgcctaacctgctccttactgcatgacccactgagtaccaccgcaggataccaccgattgcctcacataaccccttatcccatctcttcactgatatcacatctcctgactactccgccttggcaatggtccagtctcctcccaggggcaagtaaattcaatacacaacgacttttcttttg

SEQ ID NO: 61824 - DNA, 673 bp, Triticum aestivum
  unsure (1)..(673): unsure at all n locations
  Clone ID: PAT_TA_61824
tgtgcggcgctcaaggcggccgggtccaaattttgtttccctgtgtcaattctaatatagtgatgtgtaaataaatctgcgaattcacaagtgtttcgcatcttgcaaataaatctcatgtgtgtactttgttggatatttatatggctttaaacatttattcaaaaaaaaaaaaaaaaaaaaaaccttggatggggtgaacctgccacagaacgaaaggcgcattacttccagttccttctgtacgctactgccgtgctctcgcttgttcgtttcttcggtttcttgtggttcctcggcaggactggtatcatgtgctgtttctcaagaaattaagcggcgtccgtatctgcgcatgttgcattcgacactctctccttttctggagaggccaactacgaaaaagtattggcacttgtcacgttagacaagctggatttttgtatcggatacctttgttatgtaacgtacgctgggttttgagtatttaatggaggcacatcaacaaaagagcacatnttggagtgaaggntattcgggggcggtcctagatacgcgcaggtgtattctctatttagtctttttcagattggcatctgcccctgagggtttatgacgcatttgaatgatatgatttttgtaaatatcaaaaaaaaaaaaaaaaaggccccta

SEQ ID NO: 61825 - DNA, 245 bp, Triticum aestivum
  unsure (1)..(245): unsure at all n locations
  Clone ID: PAT_TA_61825
accgctcgagccctagggccttttncttcttttattttggataaataagcaccatttttatttcacaagataatgaaacagtgtgctggcacncnacaagnagagggtacnctgtgacntggtccgaacagctaacgagtaggattacaaagaaccatagaaagaaccaaaaagaaacgagaacaaaatatgtaaagaagaggggaacttggggaagggcttggtggcgtcggagaaggcgtgct

SEQ ID NO: 61826 - DNA, 507 bp, Triticum aestivum
  Clone ID: PAT_TA_61826
cttaaattgtgacacagcaaaatggcgttcctaagcatacaagtatcttacaaccgatctatattacagaagcgcagatacattcaacgagacgaaggaattctaaagagaagctgaagcagagtaagccgagtcgtccgtcagggtcaggtaaacaggatgcagcaaccgcgtcgcttgacgcgctccgctcctcaaccgccgcccccaccgcccccgtggccgcctccaccaccgcagccgccgccgccggcgccatcacctccgtagccggcgccgctgccgctgccccagcgctcgcggcggcgtcgcttggccctcccgtcgtcggcgcagccgaacgccgcgatggccacgacggcgaccgcgcccacgaggacgaagagcagacccactacggcgccgggcgcgcgctgcacggagccggctgcggcggcggcgaagcctctcgccgcggcgagatccaacgccctcaccatttcagctgctggaggctacgccttttgt

SEQ ID NO: 61827 - DNA, 650 bp, Triticum aestivum
  Clone ID: PAT_TA_61827
cctagggccttttttttcaaaattggcttttttttttttttttttttttttttttttttttttttttttttttttttttttttttttttaaaagggaaatggtttattataatcaccaatttatcatcaacatttaattttggagggacggattaaatttcaagtttttcaaagattatccgaaaaatcaaatcgaaggggccgagttaattttttattccgggaaaaccgatttccatggggaatccatccaccagggggttattttttgaggaattccaccaggggctcctggagcctgacgccctccccggagcccagttggtcaaaatggaagggggggccgacgcccttggactcaaaaatttcgatttcgccggggtaaccggtggccctgagttcgggggggaaccaaagggcgggttctttgagaaggaagtcgtcctcggggaagaaaaccaaaaggggttcgaaggggatcccgggcaggggggggggggcctcgtcggggacaaaggggttcacgttggggtcgtccaggccgagggagcccgggaacacaaagcgccagggggggtccatgaaatcgcgcacgtggggggagaaaggggcctccgggcccacgggttttttgcccgggaaaaaggggg

SEQ ID NO: 61828 - DNA, 463 bp, Triticum aestivum
  unsure (1)..(463): unsure at all n locations
  Clone ID: PAT_TA_61828
ngagtacaatcagctcccccttccctcgaggcctcactagttagccactagccactgaacactagcagcagggaggaatcagaaggcnnnnnnnnnnnnnnnnnnnnnnnnnctgccatgaggcaaggagggggcggaggcggaggcgacggggtgagccccggcaatgtcccggtgtgctactacggcgcgggcgggcgcgtgtcggccaccctggagcggcgggtgcgcgccgccgaggtgctcctgcggtgcgcggcgtgccgcctcgtcgcggtcctccctggattcccctgtgattggcaagtcatccacatcttttctcccccaccatctccagcgacgtgagcaccatcattttttctctcccacttcctgctcgccctttggctagattcttttggtcttttgcatgttttctgatttagaggttggtgattgnaaaattactntggtggttttt

SEQ ID NO: 61829 - DNA, 658 bp, Triticum aestivum
  unsure (1)..(658): unsure at all n locations
  Clone ID: PAT_TA_61829
ggccggcctggccgggcatccccaaaccccatccatcactctcgcctctcttgactcctccttggaagcacagagagagaggagagcatggcgtcgtccgnnnnnnnnnnnnnnnnnnnnnnnnngtggcaagctcttcaccctggaggaggtcgccaagcacagctccaaggacgactgctggctagtcatcggcggcaaggtgtacaatgtgaccaagtttctcgatgaccaccctggaggcgacgacgtcttgctgtcttcaacagccaaggatgcgaccgacgacttcgaggacgtggggcacagcacgaccgcccgggcgatgatggacgagtactacgtgggcgagatcgacgcgaccacgatacccaccaaggtcaagtacacgccgcccaagcagccgcactacaaccaggacaagacccccgagttcgtcatcaagatcctccagttcttggtccccctcgcgatactgggcctggccgtcgccgtacggatctacaccaaggcggagtctgtctagcaccgtcgtcttataccagtcagtcagtcagtcattcggaagtgtccaagagctgaataagttttagtggggatttgcatattttgtgtaccagcgtcaccgtcctgtcatggaatctgggaactgctctcg

SEQ ID NO: 61830 - DNA, 808 bp, Triticum aestivum
  unsure (1)..(808): unsure at all n locations
  Clone ID: PAT_TA_61830
tccagccaagcaatttcacacatcgggccactccccgaatcctctcctcaccaccagcgcagcagctggggggggggggggggnnnnnnnnttcgtcatggacgcctcagccaccgtagccaccgggaaggggaagaagggcgcggccgggcgcaaggggggcggncccaggaagaagtcngtgtcgcggtccggcgagggcggggttcaggggggggtgcggcggcgtggggggtggctggggggggggcgcctccccgccccccggccctcggcccgccgcctccggcggcgggggtcttttggcgngcgcggcgggggggggggcgtntntcnntttttgtcgccggcgcggccgcgggggggggggggcgggggggggggggggggggggggggggggggggggggggcggggggggggggcgggggggggcgggcggccggccgcgggcgggggcggcggtggcgggaggtccccggggggggtgcgggcggccggggggcgggggtggggggggcgccgccgggcgggggggcgcgcggacgggggggcgcgcgcggggggggggggggccggggcggggcgggcgggggggggggggggcggcgcgggcgacggggggggcgtgcggggggcgtgccggcccggggcggggggggaggggggggggggggggggcgggggggggggggccgcgggggcgcgggcccgggggggggggggggccggggcgcggggcgggcggggctcggcgcggggcgggggggcgggcggggggggggggggggggggggggggggggggg

SEQ ID NO: 61831 - DNA, 613 bp, Triticum aestivum
  unsure (1)..(613): unsure at all n locations
  Clone ID: PAT_TA_61831
ggccggccgggccggggttcaccattgcgagacttgccactgcgagtgcgagagtgagcaaggagtagaccaaacgtacgtacgacgacggccannnnnnnnnnnnnnnnnnnnnnnnatgccgatgaggaaggaggtcctgctggtggccatgatgctggcgctggttgtggcggcgccgggcggggcgcgtgccgcgtgcgaggtggggcagctgacggtgtgcatgccggcgatcaccaccggcgccaagccgagcggcgcgtgctgcggcaacctgcgcgcgcagcaggcgtgcttctgccagtacgccaaggacccctccctcgctcgctacatcaccagcccccacgcccgcgagaccctcgtctcgtgcggcctcgccgtcccgcactgctaggctaggcgccagctcgcctagcgcgtatggctcagctataggtaggctacctccgtcgtccatgagagatgagagagactataatagcttagcctagctgagacctgagagagggcatgctgcgtccatgcacgcacgcatgtttctgtccgatccatgatgctgcaataaaatgttgggtgatgatcggtgcttgaataaaatgagttttcc

SEQ ID NO: 61832 - DNA, 545 bp, Triticum aestivum
  unsure (1)..(545): unsure at all n locations
  Clone ID: PAT_TA_61832
cctcaccggcgaagcattctcacccaaaccctagcctccggctccgatggcccgcacgaagcagacggcgcgcaaatcnnnnnnnnnnnnnnnannnnnnnnnccaccggcggcaaggcgccccgcaagcagctggctaccaaggcggcgcgcaagtcggccccggccaccggcggcgtgaagaagccccaccgcttccgcccggggaccgtcgcgctccgggagatccgcaagtaccagaagagcacggagctgctcatccgcaagctccccttccagcgccttgtgggggagatcgcgcaggacttcaagaccgacctcaggttccagagctctgccgtctccgccctgcaggaggccgccgaggcgtacctggtggggctgttcgaggacaccaacctgtgcgccatccacgccaagcgcgtcaccatcatgcccaaggacatccagctcgcccgccgcatccgtggggagcgcgcccaggatttcggttgccgacggtgaaactgggtagaagctgctcgagtctggggtcttatgtctgt

SEQ ID NO: 61833 - DNA, 601 bp, Triticum aestivum
  Clone ID: PAT_TA_61833
gaaaaaaaaaaaaaaaccaaacactctcatacaaagacttgacaactcagacaactcagttctactcaaccataaacattatcaacaaccgtttacatctcaactcttacaaacaaacaactaccacccactctcttacaaccgcaaccatgagctccccttataccgtccagatccaccagagcaccaaggagccttcaatctccagttcctacagctattcttctggttcgtacagctcttcaaccagcacaacacctcgatctctttctcctggcgagtaccgcgagtacggggctgacaagcacactacacaagtcgccaaatctggtcgcaacttggttattaaccacaacaaagtctcatacgaaaaggactccccggcaccgacatacgcaggcgcatatacacgaacctaatcgatacttcacacttttttgtcttgatttaatattcccttcgcccaattgaattgaacagcgatatacaacggatacggcctagaatatggactggcgttttattttatttttggagactttgaagcacagttattatgcccacccaggcgatgtaattatggaccactacagagcttgga

SEQ ID NO: 61834 - DNA, 357 bp, Triticum aestivum
  Clone ID: PAT_TA_61834
ggccgatgttttccgaaagagagggagatcaagggcggccggagggcgatcgttccgcctattatatctcctcctaatctcatacataactttatgcaggcatggtgccgaactgcactcaacactcacccaaaacatatcataagaatataataacacctccaagacgacgcccagaggacgcctcacgctcgccgctatggcgagggtcgggccaacgccgaccgtactgcaagcgggcaagaagctcggaagacgagctgccagcgacgaggcagccaacatggtgtaaacaacggagaaaggagcgacaatggagggagcccggggggcgaccgagagagttccgtgactggc

SEQ ID NO: 61835 - DNA, 210 bp, Triticum aestivum
  Clone ID: PAT_TA_61835
agtacgcatcagctcccccttccctcgaggcctcagtagttagccactagccactgaacactagcagcagggaggaatcagaaggctgccatgaggcaaggagggggcggaggcggaggcgacggggtgagccccggcaatgtcccggtgtgctactacggcgcgggcgggcgcgtgtcggtcaccctggagcggcggctgcgcgccgtc

SEQ ID NO: 61836 - DNA, 546 bp, Triticum aestivum
  Clone ID: PAT_TA_61836
ttggtctgaaaagatcttctccctaccactgccatctcgaactccactcaaacaccagcagccgtccaaggcatggggtccgcttgttccctgggaacaaatccagatgcctagcgatgcaaaaattctatttatgcgatccttcaatgagcgccaaataactttggtggtgtatgaaagtgcacaggacaactgcccctactttctcctacgaacgttccacatgggcacaccttggttctcgcttcgtggggcacatgagcttgttgtcgatcgcaacggaagttgtcttcaattctggcgatggagcgagagcgaccgatgcaccaagaggtgggcgaccctttgcttcctgacatgggaagaaatggtcttggtatattgctgctttctgtcattcaagactcgtgacagccaaactcttccaatggcggcaaacgaagacctcagtctttggggtgaacgcaagttattccaagcccgaattgtggatgacaattttatgcactcccctatcgcccatgaggactttgccccccagggcct

SEQ ID NO: 61837 - DNA, 467 bp, Triticum aestivum
  unsure (1)..(467): unsure at all n locations
  Clone ID: PAT_TA_61837
aagccaaaagcaagaagcgcccaggaaagaacacacacaggcacaggcacaggcagagaggagaggcaatggcgaccactaagatggcggtggtggcgatcctggcggcgctgctgctgatggcagctgtggagccggcttcggccacgccgcccagcatgctggcggcaagaaagttgcagatgcctcgcctcatggatgtcgtcttggcagagtctatgctggcttgcctcccagcaggcggcccttgcctgttccctcctatttttctgctcccccccctgcggttgctcctctcctgcccccccccccgccccctcccccccccgccgccgcccgctcccccccccccccctccctcccccctcccccccccccctcccccccccccgccgncccccgccccccccccccccccccccccccatcccccccccccccccctcctctccccccccccctccccc

SEQ ID NO: 61838 - DNA, 233 bp, Triticum aestivum
  unsure (1)..(233): unsure at all n locations
  Clone ID: PAT_TA_61838
cggcncgctcgaggcccggccgggcgcggagcaccaaccgaccaccangcgccctcccactcgccagccctccgcctcaccccgaagcaaagccacgctagccacgcacgcgccgcgatgcgccggccgccgaccatgggacgctcgtccctcccccggccgatggcacgcgcactcccggccgaaggccctccaggcgcgcgccgcccttccggcgcagggcccgccctcac

SEQ ID NO: 61839 - DNA, 299 bp, Triticum aestivum
  Clone ID: PAT_TA_61839
ctgtcatttgctgttcttcatcccgcatctcagcttttctcctctaacaaatcgccagcaacggcatggctacccaccgccctctgccacccgtagccggcaggcaaggtcgtcggtgtcgactcaactgaggctgcgtgctgcaacccgccacgacggacagccgctagcctggggcgacggcctggccgtgcgccaccacaccccgtgtcctcttgcgtttgcgctgcacgctccgaccaggccttgctatgagtggcgaccggtccccggagactggcacagaggcgaggcgtgct

SEQ ID NO: 61840 - DNA, 698 bp, Triticum aestivum
  Clone ID: PAT_TA_61840
ccccaccgccgctccagaacggaacgaacgaaaaatccccaaccaatctcgtcgccgatcaaccctaggctcgtcgaatcctcctcccccaccgcataagatgcagatctttgtgaagacattgactggcaagaccatcacccttgaggtggagtcgtctgacacaatcgataatgtcaaggccaagatccaggacaaggagggcatccctccggaccagcagcgtctcatctttgctggcaagcagcttgaggatggcaggacccttgctgactacaacatccagaaggagtccacccttcaccttgtcctccgccttaggggaggcatgcagatcttcgtcaagacgttgactggcaagaccatcacccttgaggtggagtcgtctggcaccattgacaacgtcaaggccaagatccaggacaaggagggcatccctccggaccagcagcgcctcatctttgctggcaagcagctcgaggatggcaggacccttgctgactacaacatccagaaggagtccacccttcaccttgtcctccgccttagaggaggcatgcagattctcgtgaagaccctcactggcaagaccataacacttgaggtggaatcctccgacaccaacgacaacgtcaagtccaagatccaggacaagggagggcattcccccggaccagcagcgcctcatctttgctggc

SEQ ID NO: 61841 - DNA, 457 bp, Triticum aestivum
  Clone ID: PAT_TA_61841
aactcgagctccctgaccgcaaccactcaaccacccagcaggcccagcaccaccgcgtctaagcaggtgccgcctccgcctccgcgtccttgtctgcggcggctgcaatggccgaccgcgtctaccccgccgccaagcccactccgccgcccccaatggccaacggaggcggcggcccggcggcgcccaagccgcagatgtaccagcgccccatctacaggccgcaggggcaggcgaagagcaggcgcgggcggtcctgccggtgcagcttgtgctgctgcttctgctgggcactgctggtggtcgtcctcctcgcgctagtcgccgcggccgcgggcggcgccttctacgtgctctaccggccgcaacgccccagcttcaccgtctcctctgtccgcctcagcacgttcaacctctcctcctccaccatcgcgcccgtcctcaccgactccatcca

SEQ ID NO: 61842 - DNA, 522 bp, Triticum aestivum
  Clone ID: PAT_TA_61842
acggcgacgccccctacaagctccgcctcaaccgcttcggcgacatgaccgcggacgagttccgccgcgcctacgcctcctcccgcgtctctcaccaccgcatgttcagccgtaaggagggcgatggcggcttcatgcacgggagcgctcgggacgtgccgccttcggtggactggcggcagaagggcgcggtgaccgccgtcaaggaccaggggcagtgcggcagctgctgggctttctccacgatcgcggccgtggagggcgtcaacgcgatccgcaccaagaacctcacgtctctgtccgagcagcagctcgtggactgcgacaccaagtccaacgccggctgcaacggcggcctcatggactacgccttccagtacatcgccaagcacggcggggtcgccgccgaggacgcgtacccctacaaggcccggcaggcctcctcctgcaacaagaagccgtccgccgtggtcaccatcgacgggtacgaggacgtgccggccaacgacgagacggtgtctg

SEQ ID NO: 61843 - DNA, 193 bp, Triticum aestivum
  Clone ID: PAT_TA_61843
gccgccaggccggcgggcgggaccaaccagcaaccaacacccacagccccaacaacccacggcgaacaccgcacccccccccggagaagcagaaggaccgacggccccaaggcggagaacaaacggcggccgcggagaagacaccagaggcggacaagccacggcggagaaaaacaccaagggcaagaagagg

SEQ ID NO: 61844 - DNA, 756 bp, Triticum aestivum
  Clone ID: PAT_TA_61844
acatccgatccgatccatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatgggcgcaccttggcggactacacattcagaaggagtcaacccttcac

SEQ ID NO: 61845 - DNA, 218 bp, Triticum aestivum
  unsure (1)..(218): unsure at all n locations
  Clone ID: PAT_TA_61845
cggccgctcgagcgcctgcccggttcgcgccgcccctctgcatcttcgtcctgcaagcncgccgccgccttcaccggctcgagctccagccttcccttcaaccatggcggacgtcgatgtcgatcccgaggtgtcggccgccggtcccaagaagaggacgttccgtaagttcagttaccgtggngtggacctcgatgttctcatggaatgtataatga

SEQ ID NO: 61846 - DNA, 526 bp, Triticum aestivum
  Clone ID: PAT_TA_61846
ccgtctgttttggcacaccggcctgggccgcgaccgtgggagcgtcgtcatctccgctatgggagccacaccgaagggcgccgctgcctccagggccggagggccagccgagggtcgttgcctcgggcgccgcctgcacggatgcaagccgagggctgcggcgtcgcctcagtcttctgcgccgcgtcgcgtcgcggttgggtgccgccttcgcgggcgccgaggctgtcgtctgcagcgtgcgtagtgggagagcgtctcgccatgcgcgtgtgcgctgggcatcgccgcggtcaagctttaggcggcctcgcgccgaggccgcgccgccacatcatggctggtgcgtcggagggcgttgcctgttgaacatgtgtacatgtaagtagtccgggttctatacgcagtacctgtagtatctgtctttctctgtatgtacgtgtatcttagaaaacaagataccagtcacaccccttatacctatatatttgtgcctagtgcacgattaatcaattatcgatgcatt

SEQ ID NO: 61847 - DNA, 580 bp, Triticum aestivum
  Clone ID: PAT_TA_61847
cggccgctcaggcggcgggcgggaccctcaactccccagcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggagcttaatgtctatgttgatggagtgctcatacgatactgatgagctacg

SEQ ID NO: 61848 - DNA, 580 bp, Triticum aestivum
  Clone ID: PAT_TA_61848
ggccgggcccgggaatattcaattggtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcct

SEQ ID NO: 61849 - DNA, 265 bp, Triticum aestivum
  unsure (1)..(265): unsure at all n locations
  Clone ID: PAT_TA_61849
gccgctcgagccgcggcccgccatcatcagttcgctagcacacgtcacaacaccaaactagctatagcagttgtcctgatcatgacgatggccgcacgcctgatgctggtggcgtgctgttgtgttgcgggttgagttatgatttattgaatttttgatattaattagaaaaaaaaaaataanataaaaatatgtattaaatataatttttattattaaattttaaataatgttttaatgtaattattttgttgttttatatcta

SEQ ID NO: 61850 - DNA, 705 bp, Triticum aestivum
  Clone ID: PAT_TA_61850
agacccatcccgtcccgtcccaacccccctctatttcaccgtcgcccacgctccttttccctttccgcatccgcagcaacgaaagcgagcgcaaaccaaacccaccccacaacgcaacgcaccccccgaccccgaacaccagcgcaaaccccgctgttccgcctcgtcccgcccccctcctccgacgattcgaggccccgggctcccgcgcggcggcggcggaggaagcatgaggacggcggctgcggcggcggaggcgcaccagtcgcgcctgctctacgagctgggcgcgctgctgctcaccatcctccggtcgccgctcgggccgggggaggagccgcggcaggtgacggcggccggggtggcgtccatgatgctgggcgcctccatggcgctcatgctctgcggctccgtcaccttcatgctcggcttcttcctcatgccctgggtcgtcggcctcgcctgcgtcttcctcttcgtcggcttcctcaccaacctctccgggatctggagggccatcctctgctgggccgccgcatgctcctcctcctcgcccataaggacgcctccacatgtacgtgatccccttttctccgcgtcatccccgaggggaacggattgtatttcctgagatctgggatgttttatatttatattatatttcgggtaaagttaaagtaattggtaaaaaaaataggattgttg

SEQ ID NO: 61851 - DNA, 215 bp, Triticum aestivum
  Clone ID: PAT_TA_61851
gtcgtcgtcgtcccaccctcctggcccccgatgcggcgtgctgcatgcaccgtcatgtttgacgagtcctcagccttcgccatcacagacatgctcagcatcagccgcaggaacagggagctctaagcagaactctatcagaatatgcaacagcatcactatgtagatactaagcattgtaataatgttttgctgtctagtcaagtattacagcg

SEQ ID NO: 61852 - DNA, 410 bp, Triticum aestivum
  unsure (1)..(410): unsure at all n locations
  Clone ID: PAT_TA_61852
aggttcaagcgacgccgccgccgcaagccgtccgcctcgctcttctcccgagcctggtcctcatcctctcgcctctctccccccacacaggcttagcaatctagcgttagcgcctccgtccatctcgtagctgcttcgatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggngactccatcgtgctcatgggnaagaacaccctcatccgacgatgtatcaaggtgtactcggagaagaccggaaataaggacttccttgagttcagaaatcttctcgttggtaatgttggtct

SEQ ID NO: 61853 - DNA, 616 bp, Triticum aestivum
  Clone ID: PAT_TA_61853
gagcgcgagcgaggagaccgacctagcgcatcagcgcctccctctgctgctgttccatccggcagcaatggcggcctccaccacaatggcgctctcctcccccgcgatcaagctcgccggagcctcgtacgcgctcggcggcggccgcgtcaccatgcgcaaggccgcgcccaaggccgccgcctccaacagcccctggtacggccccgaccgcgtgctctacctcggcccgctctctggcgagcccccgagctacctcagcggcgagttcccgggcgactacgggtgggacaccgcgggcctctccgccgacccggagaccttcgccaagaaccgcgagctcgaggtgatccactgccgctgggacatgctcggcgcgctcggctgcgtcttccccgagctgctcgcccgcaacggcgttaagttctgtgaggtcgtctgtttcaaggactgattaccatatattaagcgagggcgggctccagtacctcggtaacccttatcttgctccacgctcataacatccttgacatttggagttgaccacaaaaagctcatggacgtatttaaagaccctaaattatatatttaatacaaatataaaaaaaaaaacaaa

SEQ ID NO: 61854 - DNA, 717 bp, Triticum aestivum
  Clone ID: PAT_TA_61854
aaaaccctaactccagccccttctcacgcatcccacagcccacccctttgccactgctcctcggcttcggccctccatgcgccgcgccgccgccccacccaccctgcatgcccctcctcaccaccacgcggaattgcacgccgacctccatgctcatctagatggtcttgagacggacgtgcatcctagacttgccgatctcgatgcgggatcgcacaccatcctctcccaccgtgagcaagcgtggctgcacgatgtgggcatcggattggacggccttgacgctaatcagattctccttcaattgggattgcatgcgcagctgcacctacgacacacccttacgcgcggctgcaagtacgccgccggcgcaggaaaacgtaccagttgtgccatatgggatgacggaacgccggcctgcacgcaagcgttggacaggcgcacccagagtagcgagtgttgcacgttggcctctgaagattcgcggtgcactacaggcagcattgcaaattccgcgtgcattgcaaattcaaagtatgtcctttgttttctcactttcatggagataaagtcctttgtgttgtccatgtataaattgctagctgcatgtataggatacatatctacaatatgatgccaaaagaattacctggagttacgacacatgtgtaagaatgtgaacgttgtaaatatgttataatttatttgtagtacctg

SEQ ID NO: 61855 - DNA, 454 bp, Triticum aestivum
  unsure (1)..(454): unsure at all n locations
  Clone ID: PAT_TA_61855
ggcccgctcgaggcnncggccgggccccgggggaagtaccaacaataggagaaaaagaatagtgtgtaccccctccccatggcgcttctcaagaacaacccaggggttttgtgcttggcggcccttcttgtgatatccgccaccttcttatcatgtgatgcatcctacgggatcagagatggagaaggttttaacaagttctgtgtgggttgggaccaagcctgcaaggacccggtgaatggaatccctagtcagtgtcagatttactgcagagataacggttttgtcttagagaaaggcaaatgtgcaccggacagtggaaagcccaaccgcatgtgcttctgctataagtagacacttgtgtgtgaatcaaccgcatgtgctgctgctataagtagacacttgtgtgtgaattcgtggaagagtgcaaaactttttctgtatgagagatctc

SEQ ID NO: 61856 - DNA, 686 bp, Triticum aestivum
  Clone ID: PAT_TA_61856
tcgaggggccggccgggccccgggaaatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaagggcccccaaggggccccaagggcgcccgcaaaacaaggaacctacccccttaaaaaaggttttttgggggcccgggggggcccaaaaagggaaaccccggaacccaaaaaggggcccccccaatttaagggttttgcgggggaaaaacccgggggaaaagagggcaaaaaaggaaagggaaaaaaagggccaccggcgggggggcctttgggggccttgtgaacaacaaaaggggtaaccccatcccacaaaaacccccacacccccacaggggtttaagaggggggcataatggggggcgaaaatgtgggccaattttcccggaaaaggggcccccaacccccctatttttttattttttcataaaaaaattacaaaaattgaccccccctaaaaaaaaaaaaaaccgggaaaaaaggttctaatattttgtaaaaaggaaaacctgggggcttcccaattcccccgggggccccctttttcccctttttggggcattttccccaaccggcttgggaccccc

SEQ ID NO: 61857 - DNA, 652 bp, Triticum aestivum
  Clone ID: PAT_TA_61857
cggccgctcgaggcggccggccgggtttttccctggttaccgtccgcaattctacatgcggactactgatgtcacggggaatgtgacaaacattatgaacgacaaggatgaggaggcaaagatgtgcatgccgggtgaccgtatcaagatggttgtggagctcatccagcctgtggcttgtgagcagggaatgaggtttgccatccgtgaaggtggcaagaccgtcggtgccggtgtcatcaataatatcattcagtaatgtggatggaggatatccaccgtgagaattttcctcatttactcttttgcgaaatgctatgtagttgttattatgcgtttagggaaggctcttgtgaaattgtagtatggcacatttttcttcaagtgaaattgcatactttgtaaaaaaaaaaaaaaaaaaaaaaaaaaaaaaaaaaaaaaaaaaaaaaaaaaaaaaaaaaaaaaacccccaaaaaaaaacaaaaacccccaaaaaaagaccaaccccccccccttttttttttataaaagaaaacgagccccaaaaaaaaacttcagagtcttaattggagcacccaattttttcctttgtcgccaaagggggccccctattgggaaaaccccccaaaaaaatttttttgggggggggggg

SEQ ID NO: 61858 - DNA, 587 bp, Triticum aestivum
  unsure (1)..(587): unsure at all n locations
  Clone ID: PAT_TA_61858
acacatcgcagcatccgcatccccatcccctctcagacacaccttccaaccaaactccaccgccgtcgaagcacccatggcacccaaggcggagaagaagccggcgccggagaagaccccggcggggaagaagccggcggcggagaagaggcccgcggccgggaagacggcgtccaaggagggcggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacctcccgggagatccagacctccgtccgcctcgtcctccccggcgagctcgccaagcacgccgtctccgagggcaccaaggccgtcaccaagttcacctcagcctaggcgtcttcctcgtttcatgagctgatggcggcgttctgtgtgtagttagcagtgcgatgttacaatctctgntagaattgtgctgcttgtt

SEQ ID NO: 61859 - DNA, 161 bp, Triticum aestivum
  Clone ID: PAT_TA_61859
aaaaaaaaaaaaaaaaacttagaatgttttacgatacttgcagcatatctctgttatagattcacagcatcgtttgaattatacatttggcagtctgctggtggcagccatatatatcttgtaccatgattgttctgtcaagaaacgaactaatatcgagt

SEQ ID NO: 61860 - DNA, 501 bp, Triticum aestivum
  Clone ID: PAT_TA_61860
aaaaaaaaaaaaaaaaaaaaaaaaaaaaatattgatttgtcgttgtgattaataagaacccttcttgccggagggcttcactgagaggttaatcactactacatcggggtggtaaaaaaccccggtaataagatcgatccagctcgcgcgcggttaaaatgaagagaagagcgtgtgcttgttactttcgtcaatttggtgcatacggctactgccccacagtgtggtactgtacgtgctgcaatggaacggtgaaaaatgaaaaaggatcgacggtactggcctgcaggccatgaggaagaaggtgctggagcatatgcggattttttttcctttttatcttctatatattttttctttcgaaattacccaaattgtccattatgtattaccgagcttttcttcttcttaccaactgtttttactgaactattacagtgtatacttgtgacatactatatcctatattcttgctgtgcttgcaccagcattcttctgagc

SEQ ID NO: 61861 - DNA, 702 bp, Triticum aestivum
  Clone ID: PAT_TA_61861
aaaatacatccaattcctcacatctcgtggtataatatcctccgaccgatcgaagccaaggcctcatccccctcctcctccggatgtacaaactttgtcaagaacctcaatgccttcaacatcaaccttgatgatgaactctcagacactaacgacaaaccctcctgtaagaatcaggacaaggacgcaatacctccacatcatgatgggcactgctgcgatgtttagccctgccaatatgccctgaccactgactgactactacattgactctgcatccataccgccaactagcgtaatagctcaccaacggcatgcaatatttctcgaatgccctcccctaacataccttctgccgtgaggatatgcctacagatcccactgactccgtgaaggccaatatacgatacaactgctatattcacctctatccacaccgtctcgtcttctctgtaaaccaattcgactaggtactcacgaatctgccactatgcatacagagagcaaccaacctcacacactcgcgattagcgctccgatgtgtggatgagaatcgtacgccagactctcactgtgaacaccctctgagtgatcgtggagtctccggaccccaatgactgtgactaggatgacagccctcactaggtaccaattgcaacggcaaattggtttctcgtctctgtcggctagacgcttgaagat

SEQ ID NO: 61862 - DNA, 814 bp, Triticum aestivum
  Clone ID: PAT_TA_61862
aaattcaaagaacatggctatggggcgggagaggcgcatcaagcttctcgtggcagtcgtcctgctcctcaccttggcgaaagggagcaacggcaacaggacatgcaccgtggcggacctggagatacggcatatccgggtggacagctacaagcaggacggcggccgcacgcacgagcaagagcagcagcacatgaactccggcggcggcggcgggcgcaagctgaagcagatgccgatgatcatggcggtgtgggtgtacaaccactgcccgtgcatggtggacaacgtggtgatctacgcgccccacggcttctccaccatctacgccaacgggaccgacgagaggatcttctccaaggtgcgggagcacctctacctcatccacaacgccggcccgctcctgccagcggcgagctgcccgcgtttcccaccctctccgccctctgccgccggcccggtcgatgggaaggcgcaaactcaagattttagctgcccgtccaccgctttcttctatacctggtacgaggagatcgagctcaagcctgccttcctcgtgcctcactgctagactgctagcttagcttgctacaagaaattccatgcatctcgatccacatggatttccgtccgtatgataaaataagtttagctgtagagtttgggatgatgaggaccagaccagtcccaaatctactcttctcttcacggatgtgtaatcctctcaaggatcaatcaagtatttgcagaattaatgttttgtgcttttggtgagtttgtgttaacgatgacacacatcgacttcatttgttct

SEQ ID NO: 61863 - DNA, 244 bp, Triticum aestivum
  Clone ID: PAT_TA_61863
attttcaactacccttgagcttctgaaggatgtgaaacacagcggcgcaaaggtcactatagaaacctgtcctcattacctcgcattttcggcggaggaagttccagatggggacactcgtttcaagtgctctcctcccatacgcgacgccgccaacaaggataacctctgggaggctctacttgacgggcacatcgacatgctaagctcggaccactcgccgtcgacccctgatctcaagcta

SEQ ID NO: 61864 - DNA, 727 bp, Triticum aestivum
  Clone ID: PAT_TA_61864
aattccccgaagcgaaaggcaatgcccgatccccacagaaatccccatctcaaaaccctagacctcatccccgatcccggggagcgaaatggccaacccgagggagttcttcgacatgaccgtcggcggcgcgccggccgagcgcatcgagatggagctgtacaaggacgcggggccgcggacggaggagaacttccgcgcgctgagcaccggcgagaagggcgtcggcaagagcggcaagccgctgcactacaagggcagcgccttccaccgcgtgatccccgacttcatgtgccagggcggcgacttcacccggcgcaacggcaccggcggagagtccatctacgacgagaagttcgccgacgagaagttcgtccacaagcacaccaagcccgggatcctctccatgggcaacgcggggcccaacaccaacggctcccagctcttcatctgcaccgtcccctgcaattggctcgacggcaagcacgtggtcttcggcgaggtcgtcaagggcatggacgtcgtcaagaacatcgagaaggtgggctcccgcagcggcacctgctccaagcaggtggtcatcgccgactgcggacagctctagatccgcccgtgcgcgggtcgcctttcgccgtcatcgacgacgctccgtgtgtcccgtgtcgtgtcgtcgatctaaataagagagacgtgtgtagtgtcgtgacttcccctggtacgtccgatg

SEQ ID NO: 61865 - DNA, 562 bp, Triticum aestivum
  Clone ID: PAT_TA_61865
cggaaatacaaaaaaaaaaaaaaaaaaaaaaaaaaaaattaaaaaaaaaaaaaaaaaaaaaaaaagaaaaaatgggaattaagagggcccgaaagacgtaaaaccgtcaaccttaaccctaatttttgcctttatgggggccttttggcgctaaggcgccaccctaaactatacccgcaccctaaagtttgcccctgaatgccggctcccggggaaaataccggagaacgagaaggaaaagggcgggagcactggggcgtggggggggtgttaaggtcctggtgagcgtaaccgccacccccgaccgcagtcaatgcttcctgtgcggttaaggcgggggtcacttgtcccgttaagtgggaatttccccccaaatggctatttttcccaaattctgtttaatttggaacctgcttccgaaactggatccgttatccctgctttatgcttgttgaaagcggaaaagggaggagaattgggcattcccgggttcgcccgaattccctatgcccgcgctttttggcttttttgtttcttttcgccccccaccccttgcgcacgc

SEQ ID NO: 61866 - DNA, 737 bp, Triticum aestivum
  Clone ID: PAT_TA_61866
acagagcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagatctccg

SEQ ID NO: 61867 - DNA, 584 bp, Triticum aestivum
  Clone ID: PAT_TA_61867
attcattcaattgtgctcatcatcatccccgataccaaagcccatcttcttctccttgaaatctttttgggtcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagtt

SEQ ID NO: 61868 - DNA, 534 bp, Triticum aestivum
  Clone ID: PAT_TA_61868
gtcagatcagatctggaggggatccaatccaacaccatggaaggcaaaccctagcctagccgcctctctctcctgctcctgctcctctcctcctcagatctcctaccaccatggccgtcggctcctccttccaagcccccatggaagcaaaccctagcctagccgcctctctctcctgctcctgctcctgtcctcctcagatctcctaccaccatggcctcgttcttccttcaacccccctgcgaccttccatggcgacatggatctagccagccgggttgaggccgctggccggacggcagcaacgtgcgtcggtacggtggcaaccgggccgctcccggagaccgccggcgtgtgaaaccgcttgttcgtctgatgggtttgttggttggatctctagtacagttttttagtatgttattattatagatggatataggaaaacgaatatcttagtatttcgcgtcaagccctgttcgtctccgggagttgaacgttttttttaaatcttctgtatgtatatcacccgaggac

SEQ ID NO: 61869 - DNA, 564 bp, Triticum aestivum
  Clone ID: PAT_TA_61869
aaacttttccccgcaccaccgctacccctgtcccgatgatcacaatgagggcacagctcgctccggccctcctcctcctcctcctcacggttgccgccgcgccgcccgtatcggcgatgactgctgaggaggaaaccaaggagaaattgctacagggcgcccacaaagaggacctcgccaataaactcagtatcgcgagtgtcgacccagacgcttatgcagccgagcagaaattagttgggcccgatagcaagaagcatgccgctaaggatgtcgtcgataacacaagctatattatgggtgttgtgcctgagaagaaacctgaaagtaagagtgacgagaagaaactcaaggaggaggccaaggtcatcgctcaagtcaaaggacagatgaactacgaggatgccgtcgctgagaagaatgccaaggaggagaagaaatccaaactcaagggtgacatctccgaggacgatgatgctgagaagaaggagaagaaatcaaaaaacaaagacggcgacaaggaggaggacaaagagaagaaatctaaaaataaggatgatgact

SEQ ID NO: 61870 - DNA, 788 bp, Triticum aestivum
  unsure (1)..(788): unsure at all n locations
  Clone ID: PAT_TA_61870
ccctactccctcctctcctctgctctcgagagtcaccaatctcactcccccacccaaccaaaagccaaaacgcacaccgccacggcgagctatggacgccggcgcgctccagctcgccgccgccgccgttgccatcgtcgtcgtcgccgcgttggtatgcagatggttccttgtggcgtgcgcggtcggggtccggaagcagagaccgcggctcccgccgggcagcacggggctgcccctgatcggcgagacgctgcggctgatctctgcatacaagacgcccaacccggagcccttcattgacgagcgcgtggcgcggcacgggggcgtcttcaccacccacatcttcggcgagcgcaccgtcttctccgccgacccggccttcaaccgcctcctcctcgccgccgagggccgcgccgtgagctgcagctacccttcctccatcaccacgctcctcggcgcgcactccctgctcctcaaacggggcaccgcccacaagcgcctccactcgctcaccctcacccgcctcgggcgccccgcctcgcagcccctgctcgcgcacatcgagcgcctcgtgctcgccaccatggcgccagtgggagcccaccgccaccgtgcgtctcctcgacgaggcanagaagatcaccttcaacctcaccgtcaagcagctcgtcagcatcgagcccgggccatggaccgagagcctccgccgcgaatacgtcaagctcatcgatggcttcttctccatccctttcctttcgcctcattcctccccttcacccactacg

SEQ ID NO: 61871 - DNA, 729 bp, Triticum aestivum
  unsure (1)..(729): unsure at all n locations
  Clone ID: PAT_TA_61871
tcgaggcnncggccgggcccgaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggccccaagggccccagggggccgcccaacgggaacccccccccaaataaagtttttgggggccagggggccgaaaagaacaaaatggaaacccaaaggggaccccccatttaaaattttgaggggaaaacccggaaaacgggggaaaaaaggaaggaaaaaaaggaaaggggggggggctaagggcgttggaaagggaaggggccaccttggggaaaacccccacccccgccgggttaaagggcccctaaaggggggggcaagggggaatttttcgggaaaaggggggggaaaccccaattggttaatttttcaaaaaacatccaaaaaggaacccccccaggaaaaaaaaacccggaaaaaggctccaaaaaaatggaaaagggaaaagttggggttttcaaatttcccggggcccccttatcccctttttgggggaatttggcctcccggttttggcccccccaaaaacgcgggggaaagaaaaaaaggcgaaaaatcagtggggggcacaagggggtaacatcaaacgggatcccaaagggggaaaaaccctggaaagtttcccccccaaaaaaggtttcccaa

SEQ ID NO: 61872 - DNA, 687 bp, Triticum aestivum
  unsure (1)..(687): unsure at all n locations
  Clone ID: PAT_TA_61872
gttcacccttcctaccctagcctccattccaccccgccgcccagcccaaacccaaccccgccgccgccactgccgtcgccgccgcagcgcgcggaggcgaccaccccgccttcgccaagatgcagatcttcgtgaagaccctgacgggcaacaccatcacgctggaggtggagtcctcggacaccatccacaacgtcaaggctcaagatccaggacaaggaggggatcccgccgcaccatcagcgatctcatcttcgccgggaagcaggtcgaggcacggccgcacccttntccgactacaacatccagaaggagtccaccctacacctggtgctccgtctccgcggtggcgccaaggaaagcaagaagaagacgtacaccaagcccaggaagcaaaagcactagcacaagaaggtgtagttcgccgaactccagttctacgaggtcgactacgacaccggctaggcaaccaggctcaggaaggagcgccccttcgccgattgtggcgccggaaacctcttggccaaccactttgaccgccactactgaggtaagcgcggactcacctatgactacaaccacaatgcttacagggggattgcgattgctctgctcttttacctatcgaggatagaactactttatatgtggtccctggttgcccttgaaacctgaaaccttggagga

SEQ ID NO: 61873 - DNA, 538 bp, Triticum aestivum
  unsure (1)..(538): unsure at all n locations
  Clone ID: PAT_TA_61873
catcagttttcatctctatcttttcgttgagaagaaaagtttgtcttttncaaaaaaaaaaaaaaaaaaaaaaaaaaaaaaaaaaaaaaaaaaaaaaaatcataaaaccttattaaaccaaaaaaaaaaaacaaaaaaacaaaaacaagccgcctttttcggcatcggagatggccaagtcccagaaccacacggcgcacaaggggctcggtaaaggggcccaggaacggaattaagaggtccaagcccccgcgcaagggcctccacccaggggttgttaccaaacttccggacgcacctgagcccctccccaaaagcacaacgccgaagttgcccgagggaacaggtggacacacaacaaggtgcgcgcttcggggcgcgggaaaggactggtgtaaaggtaggaccttcggttttgagcttaatcaattgctctgtatatcccaagaatctctaggtctgaacctaagcctgggcttggtggggcattgaaaatgatatgtgcacccctaaggtgaactttgttatctataaaggg

SEQ ID NO: 61874 - DNA, 553 bp, Triticum aestivum
  unsure (1)..(553): unsure at all n locations
  Clone ID: PAT_TA_61874
nactctgcaccagcctcctcctgctccagcatcctctcactccttagcttccttccctcgccaccacccacagccaaggctggctgtcttggcggcggcggcaactgcgcgtgcggcgccgtctgcaagtggggcaacggcggcgccgggtgcaagatgttccccgacgtggaggccaccgccggcgctccgcatggtatgccaccgccgccacaaggcgagctccagcgggttcgagatggccgccgcggaggccggcggctgcgactgcaccacctgcgagtgcggcaccgcgtgcggctcctcctgctgcagctgcnactgagcccggcgcacaggaggccggccggcagaggcgagcacgaggatgaggaggagaagcaagcaatcatcatcaccaccaccaccacccagcgtatcagtaccactagccgcngcntgcgctcgcgcgcgcgctaaataaaataaaaccgtcatgtgttccttagttctgtacgaccagtgtccctcctcatgcctccacttctaatgaatatatggcgcctcaactttg

SEQ ID NO: 61875 - DNA, 517 bp, Triticum aestivum
  Clone ID: PAT_TA_61875
attctcgtctcgtatataatcattccctcttatggcctctaacatatcgaatcccagtataatgagatcgtgataatcgtacgagaccccgataccaatgagtctctatgcgcaggttgaaccagcacgccaatagggccaagacactgccccatagccacgcacacgacgcagagaaatctactgcctctaacggcctctacaagctctgtaccgacgtgcgcgtctactgcatccgccccgatggcctcttctgtattgctggcagggccaagcgctatgcttgcaactgcgcccgatgccacatcaaggaagaggtcatggtgcactacatctacaaggtgaattagctgctgtaggatgctatcgccgtattcgcttaatcttagggcacaagaccataatcgctattgctatcctagtggtgcagacatgtgtgccagcaatcacaaataaatttcgagtactagttgttgccaatcttatcgctcaacgtgtgtgctattacgatgaacca

SEQ ID NO: 61876 - DNA, 574 bp, Triticum aestivum
  unsure (1)..(574): unsure at all n locations
  Clone ID: PAT_TA_61876
atctcattcccatccncaccaccttttctgagcaagcaaaagcagcgaagcggacgaaaacaaaatccatctcatctcctctactctgaattgcgaattaaacccacccgtaaaccctccgattcttcttcttcctctcgcggcgcgaagcaaccaatcaatggcggtggcgtcggggcccgcggccacgttctccgcccgccccgcggcgccgggcgccggccggctctgctcgtgcgctgccgcggccaccggcggggcgaggttccgcggcgccgacgggaagtggtgggcaccgctgctgggttggtcgggccagcccgactacatcgacgctcagccggcgccggaggaggagcgagctgctggtgcagcaggggcgaggcggttcggggtgctgacggaggagaaggcgcggcagctgcggatgcggatgatggagacggagagcttccacgacgccatgtaccactccgccatcgcctcccgcctcgcctccgccgcgcgcgacggcgacgccaagccgtagagcgaacatctcagctccccggccggcgcgagcgcggagccatgc

SEQ ID NO: 61877 - DNA, 357 bp, Triticum aestivum
  Clone ID: PAT_TA_61877
atgtttattcacaggctgcattgtacgcagcatctgctcgactcagaacaccgcggaggagcagcagcggtgggcgggggaaacagtgtcatggagaaggagggataggaccgcgagtactggcagtgctgcgaccaggtgcgcctctggacggccgcacttctacggcctctccatcggcgactccatgtgctgcgacgtcatcgactccgagatcagcgctggcagggagaagcgccgatcccgctggctggggatcgacagcatcgcgacggattaggcgatgcgccagatgatcgaggacgtgaacggtcagtacctgaacggtcgctacatcatcgtcaacgaggcggagac

SEQ ID NO: 61878 - DNA, 510 bp, Triticum aestivum
  unsure (1)..(510): unsure at all n locations
  Clone ID: PAT_TA_61878
cgggactccagncgagaagcacacaagcaagctcatagccattcaaatgctcttcatctccgaagctccaacccaaccgaggacgtcttgctgcggaggaaactgcggctgcgacaccgcctgcaagtgcggcaacggctgcggcggctgcaacatgtacccagaggccgaggccgccggcgacaccctcctcgtctccgacaccgccacccacaaggcgagctccggcggcatggagatggcggcggagaacggcggctgcggctgcacccagcgcaagtgcggaaccagctgcggatgctcctgctgcagctgctagatcgatcatcgaccatatgcatgcaccgtgccgtgcgcgcatcatcgatcatatcgatctactactaccataccatgtaaccgcaacctgatcgagggcctctatctatgcacctgagctgcatcagcagngaggtggcatgccatgattgaaaacagggccgcctaaataaaattccccctgattaaccg

SEQ ID NO: 61879 - DNA, 583 bp, Triticum aestivum
  Clone ID: PAT_TA_61879
atcgacatccgtgtgattcaccgttcatcatgaggccgatcagagaaggcgaggcgctggtgggggtcgccggggctccggcggcgctcggccacggcgcacccggcgttctggatgacgccgacgccgtacatcttcatcggcttcacgctcatgatggggatcatcgccgtggcgctgctcgtgctcgtctgcacgcaccgcgagccgtccgggtcgtcgcgccgggggagcgccgccgaggaggcgtcggcgcgcgggatggcgccgctcgacagggagcccaaggtcgtcgtcagcatgcccggcgacgacttgccgtccttcctcgccagcgccaggccgttcgcgttccctgacgtcgtcgagccgccacgccaggcggacgtggcctaagcgcgcgcgccgcgcgcacccgtgcgccctgcgggacgcgggaccagttttgttcatcaatcggatttctaggatttaccctaagtaattttgtcagtactagtagtagtatcttgtcgaggaaatagccggcgggcacgacgtgagctgagatctgtgaaagagaatgaagtttcggcttttgcac

SEQ ID NO: 61880 - DNA, 195 bp, Triticum aestivum
  Clone ID: PAT_TA_61880
aaaaaaaaaaaaaaaaaaaaaaaaaaaaaaaaaaaaaaaaattttttttttttcttctcggcgactccgcggggcggtcgcggctttctccggtagcagcaccagcacggatccgcggcagcaccagcgatggcagagttctcgtggctcacggagctagggttcgtcttcctgaccttcaactccggcatggcc

SEQ ID NO: 61881 - DNA, 597 bp, Triticum aestivum
  Clone ID: PAT_TA_61881
gtcgtctatcagcgccgcggctcacccccatgcgaccctagcttcgctcgctctccggcgtagcttctcccttttccctgccgcggcggatctgcgtcggcatttgacggcggtatctccgcctcttcttcatctctcctcatcgtttctagggggagctgacattacaggcctggtctgcaccaatggaggcaatgcgcaaaaaggaggcaacagcaacggcttgttctgaagacaaccgtaaaggtgtacatggtgtatccatgaatgggctatacgatccttggaatcctgcctaccctccacgtgatcctagtccatgcgatgctgacatggctgctcatatcgcatcagtcaaggagtggatggacaaaacacaggctatacttgctaactccagagcaaccaatataatcataccagatcgtactccgcagttcgtaaatgatgtgctcttcgatatattacccgccttggtgccaatcttggaaaaggataatgtcagatctttccttcgcttcttcaatgagaatggaagggccatgtcttggggtttcatcatcacgccagaaactttaaccagataatcgtgtccaa

SEQ ID NO: 61882 - DNA, 163 bp, Triticum aestivum
  unsure (1)..(163): unsure at all n locations
  Clone ID: PAT_TA_61882
actactncacttgcggtcaaaactaatggggaagttcatagatagttgcttcagtttttcaaaatcaacaaacaaatacattgaaatattacagatgttgctacatttaatgaagccaagcctgtacaggcttgcgcaaacgtaatgcatttttgtttggctg

SEQ ID NO: 61883 - DNA, 446 bp, Triticum aestivum
  Clone ID: PAT_TA_61883
cgggataacaaaaaaaagaaaaaaaaaaaaaaaaaaatataaaaaaaaaaaaaaaaaaaaaaaaaaaccaggcaaccaccactggctcctcctccaatcccacattcggtcgcagttcgaaccaaggagggatcgtcagccatgtccgggcgcggcaagggaggcaaggggctcggaaagggcggcgccaagcggcacaggaaggggttgcgcgacaacatccagggcatcaccaagccggcgatccggcgcctggagaggaggggcggcgtgaagcgcatctcggggttcttctacgaggaaacccggggcgggctcaaaatcttcctcaaaaacgtcatccgttacgccgtcccctacaccgagcacgccctccgaaaaaccgtcaccgccatgaaggcgctccacgcgttccagcatcatgtccgcacctttaaaggtttcgt

SEQ ID NO: 61884 - DNA, 516 bp, Triticum aestivum
  unsure (1)..(516): unsure at all n locations
  Clone ID: PAT_TA_61884
nctccttaaatctttttgggttcacagattttgcggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcct

SEQ ID NO: 61885 - DNA, 453 bp, Triticum aestivum
  Clone ID: PAT_TA_61885
cggcagtcacgtctagtctccacccccgccggccgagtcaaccgacgcccggacccccctcgtctcgtcatggcggccgcgacggcgacggcgacggcggcggacgatgaggcgcgcctgctgcggctggaggagcaggcggagcacggcggcggcggcgcctgggagtacctctccctcgcccgcaggctccgcgcgcgccgccccgcccccgtcctccgcctcggcctctccctcctcaacgacgcctccgcccgctcccgcctcgcctccgagcagtggacgctctacgagcaggtggcggtgcccgccatgttctgccaccgtcttgatgtcgcacaggcttgtattggagtcctctccacgcagtttcctgccagcgttcgtgtttggtcgctagaagccctgatgtttccagcaaagggtgattgtgctgaatctgcaagagcttac

SEQ ID NO: 61886 - DNA, 404 bp, Triticum aestivum
  Clone ID: PAT_TA_61886
cggccgctcgagccggccgggcgggtattcttattctgatgtggcgctaaatcttgttgctgaaactgtccgagaattcaatgaatgaacagagttgttctagtataggtggaaataaacagttaaatttctgctgcagcaccggcagcatctcacggacacaacacgaacacgtccagtccaggatcatcttggccgctccgtgaagacaaggtctgcacggtttgctcaaccactagagtagatggttagtgttttggtcgtctggacctagcgcacgagtgtaccatagtttccacagcattttgttcatttgttcaatggtgtattcacccctaaaaggattgttcttttttgtataaacagtttgatatgtcatacataaatttaaatttgttgtttcg

SEQ ID NO: 61887 - DNA, 380 bp, Triticum aestivum
  Clone ID: PAT_TA_61887
cgaggggccggccgggcccggaaatacaaaaaaaaaaaaaaaaaaaaaaaaaaaaataaaaaaaaaaaaaaaaaaaaaaaaaaaaaaaaaaaaaaaaaaaagataagtattttttatgaaagaacggaggacagctcgattccatgaatgccgtgggacgataactcggactggaaaaatataggaaggtgatgtttttcttctctgaatgctggtatgacttccttcccatgttcctaaggtacatattcttgtttcatgcagaagggccaaaagttacattgctggcaccaagctacccacgggggctcgtttgggataatgaactcggcatctggtacatttgctggacaaagaataaatcttgttactggcctggg

SEQ ID NO: 61888 - DNA, 365 bp, Triticum aestivum
  Clone ID: PAT_TA_61888
tggatgtctcgacgacggcgactcgggggagggggcagtctgctcgagttaacccgcaatctttctctgctcgagttaacccgaatggatctaacttcttgcaggcttcatatgccaccaacactttcttttcactggcagaggtaagttaaccatcaatggcttgtcttcggttggggaaatggggtgcgtggtatgtctgcgattattttcggcaaaacttactgtgattttactagttagaaatctggaattgctctaatcagtaaatattgttcgtctgatatttgcactgtttggcaacaagtctatgtatacctgaatgtgtattactgacagatatcatataattgatcattgtttgc

SEQ ID NO: 61889 - DNA, 613 bp, Triticum aestivum
  Clone ID: PAT_TA_61889
aataaaaaaaaaaaaaaaaaaaaagaagcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaatc

SEQ ID NO: 61890 - DNA, 664 bp, Triticum aestivum
  unsure (1)..(664): unsure at all n locations
  Clone ID: PAT_TA_61890
tcgagggcnncggccgggccccggaataacaaaaaaaaaaaaaaaaaaaaaaaaaaaatataaaaaaaaaaaaaaaaaaaaaaaaaaaaaaaaaaaaaaaaaaaggacacaaaaaaaataaaaaaaaaaaaaaaaaaaggaactaaagccctaagggggttttttggcgggaaggggccccaaaacaaaaattttgggagactaaggggcctcaaagatttaaagctgaacgggaaaggcagccccccattaagagcttgcagggtaaaaccgggaaaggggaagacgatggaaggctggaaagagaagggggaaaaatgtagggggctggacaccgggggggtttaatgggggggaacaccatacgcgaagagcctaaatgccccgcaaaagggggcggaacggaaaatttttcagagaagtggctactggaacaaatatttgcccatttgccaaaataccccctattaaaaagccccttcaagagggaacccccctgagaggggcctcctgaattttcggggtggaacatgttgccttttttgggtttgggggcctccctgtttcccgtttaccccgaaattttggttaaaggatttttggcccccaaaagtttggccgccacttagggttgctgaaaactggttctgggaaaaggggggtt

SEQ ID NO: 61891 - DNA, 463 bp, Triticum aestivum
  Clone ID: PAT_TA_61891
acctccaatttccgccgagacaaaaaaagcatcgtctcgcttgaggaagcaacagacatgggcggcgataacgcgcataactccaagatggcgactcacaggaaccaccagaagctgaaccacgacaaggacagccaggtcgacgccaacaagaaggccatgacacatccacggcaagatatgcatgcacacttgcatctgcaccacctctgaagcaaagtgcaacgagcatgcgtgaggcgaaacatccgaagagagacctcgtgcaccgcttcccccacctcaagcagtgatatctgcccaatcagatgcagacagagataaaagatacagacaacctgtcataatccacctagtattatcatgctctcgcaatgactgattgttgacctaagcttcgagctgaactctggtgagctgctgacccagctgctctgattgagagcccatctagtatgtaatc

SEQ ID NO: 61892 - DNA, 563 bp, Triticum aestivum
  unsure (1)..(563): unsure at all n locations
  Clone ID: PAT_TA_61892
ngaatcccaaacaaaggaaaaaaaaaaaaaaaattataacaaaaaaaaaaaaaaacatatgaaaaaaaaaataaaaaaaaaaaaaaaaagaaaaaaaaatgcatgtaggctattttttggtttaaaaaggcctgccctggaactgggggtggggccaaatgtcctgttaatgatgtttccgtaccccctcctcctcctctatcggatcctcggatatcttggccgaaaccgtcatctcctcctataatcaaaacaagtggaggggggtcctcgcattggcccaaccaaaaagaacaaaaccccttggattgtcctacctgtgggcactttcctccatctgagaccctgctggttgggagggggatccaaagtagacttggttggccctcaaagttatccccaccaaacttcgggaataccccgaatctgccctcgctgtccatccccctggatctcggtcgtccacgacctgggttcgcctaacgagaaaggtgttagtggccgacctcggcaacggaaacaacactcaaaggacggtgtcggaaaagaatatcttcctcctc

SEQ ID NO: 61893 - DNA, 648 bp, Triticum aestivum
  Clone ID: PAT_TA_61893
aatctcctggttcctatccccctctgcctcactctccaatctccagagcgagctcgcgcagagcacgcacgccggtgcagacacaggaacgtcaaccatggctgcgccgccggccgagcgctcgttcgacgtcatcgtggtgggcgcgggcatcattggcagctgtgcggcgcacgcggtggcgtcccggggcgcgagcgtgctcctgctcgagcgcttcgacctgctgcaccagcgcggctcgtcgcacggcgagtcccgcaccacccgccccacctacacgcggccgcagtaccctcccatggtccggctcgcgcaccgcctctggcacgaagccgagcgcgacgccgggtacaccgtgctcacgcccaccccgcacctcgacctggggccccgggacgcgccggccttcgtcgccgccatggccaacggcggcgccaccgagctcgccccggcgggggacgcttcgcggccggcgtgggcggaggcgttcagggtgcccgaggggtgggccgcggcgaccagcgggccggccggtgtgataaaggcgaccaaggccatggtcatgtttcaaacgctcgccgccaagatgggcgccgtcgtgagggacagaagaggtggtcgacgtccccaggcaaggagaaggaa

SEQ ID NO: 61894 - DNA, 235 bp, Triticum aestivum
  Clone ID: PAT_TA_61894
cccccccgcctgccgctcaccagatcccgtctgccatgtcgacggagaagaagtaggtgatccacatgtcgcatatcaatgtgcagacagtcttcctcaacttctcccactgtgagagcggaaatcgcctcacgcgcgactctaatgtgctcccgcatctgaccgcaccgtgactagggttctccacggttaggtaaactggccggcccccccgtatccgtcctaaagagaatat

SEQ ID NO: 61895 - DNA, 737 bp, Triticum aestivum
  Clone ID: PAT_TA_61895
cactgcgcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagatctccg

SEQ ID NO: 61896 - DNA, 799 bp, Triticum aestivum
  Clone ID: PAT_TA_61896
attctcccagtctccaagtcgccgccgacgccaccagcagcagcgcggccgagatggggggcggggacgcgggcccggaggcggcggcggagcagggggggcaggaggcgaagcgggcggcggcggctgcctacgactacgaggcggacccgcgctgggccgactactggtccaacgtcctcgtcccgccgcacctcgccgcccgccccgacgtcgtcgcccacttccgccgcaagttctaccaacgcttcatcgatcgtgatttggtggttgagcctatgtcaaccactggttccactcagccgagcaggccagacataaggtcttcaccttcagcatccactgagagtgtcagggctcgcaattcaggttctagttccagatcagctgccccgccaccagcagcaccacaagcaggggctgcaagccctttacgtttcgatgcaaagactatacatttctccgtaaatgcctgggtactggttgttgctggtctgggaatgcttccaatcttgccaaaacatcttgcagacagagcttgcaagctttcgttgctgggaacagtcctctcctcaggatactctttatacagtacttatgggaaaccaagagaattgaacatggctgcaattcagggttggttgcagtcagtacttggagccaaggattttatccatttaatgttctctttgttgctcgtcacatctcagctgcacttaaagattgctgcgctacctgtgttctgctgggcccttgatcatgttgccagattcctaaggcgtaacttttcccgctcatc

SEQ ID NO: 61897 - DNA, 650 bp, Triticum aestivum
  Clone ID: PAT_TA_61897
aatgcgctttctcaggggttggcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggcttcggcggcggcggtggcggctacgggggccagcgccgtgagggcggaggcggcggcggctacggcggcggcggcggcggctacggaggtggccgcagcggcggcggcggcggctacggcagccgtgacggcggcggctacggaggcggcggcggcggcggctacggcgggagccgcggcggctccggcggcggcaactggagggagtgaatggtggggcccctagctggccagtatcctagttaccgatccctttttttac

SEQ ID NO: 61898 - DNA, 462 bp, Triticum aestivum
  Clone ID: PAT_TA_61898
gaccaagaagagaagagaagagaagggaagagaagagagatgggagggttccagcggcaggtgaaggagcggaccatggaggtgaaggtggcggtgctcaagggcgtcagggtcgtcggcgacttcggcaagaagacgtggaacaaggtcaaggccatcaagcgctgatcgatccatccatcgcatcaccccggccgtctgcttcccttcgctccagtccaatagttgcttcatgtagtactgcctgataggatagccgtctggcctcgctctctttttctcggttgtggttgtgatttggtttgttggatctgttttgaggcaacttttgatgcatgtgaaaattcgcctgtcagcataggcttatatttagccttcttatattcccttgtttattattattatttctccttcttgttcttcctccttacctcaagtttatggtgaatttctgatagatcc

SEQ ID NO: 61899 - DNA, 583 bp, Triticum aestivum
  unsure (1)..(583): unsure at all n locations
  Clone ID: PAT_TA_61899
aaaaataccaannaaaaaaaaaaaaaaaaaaaaaaaaaaaaaaaaaaaaaaaaaaaaaaaaaaaaaaaccaaagataaccataaatcccccgttttccccgggttactcccattatcccccggttaacagtgattccatagaatttccaagggatgtctagggggtggaaaggcggggaaaggcaattcgcaaaggcaaggggccaatcccccaccgtaacggggctccgccaaaccttccatgccatcaccaagccggaaatccggaatttggggagtattcgagattataaacgaatttagcctcttcatttaccaggaaacccccggggacctcaaaaccttcctcaagaacgtaatccgaaaccccgccacctaagaccggcacccccatggcaagcccgtaacccccagggacgccgggtacgcccttaagcggctgggccccaccctctacgtttttgtggttggagatccctcagttcgctggttgaccctgctgttccttgccgagttttgaagacttatcccccttgccaagatttattggcgatggttatcattgttattcaagtttgtctag

SEQ ID NO: 61900 - DNA, 395 bp, Triticum aestivum
  Clone ID: PAT_TA_61900
ccgtcgtcgctgctccagctaggggttctcgcccccgccctcccgccccaccgccggccccgtccgccatgtcgaagtaaggaggaaaggccaagccgctcaagcaggccaaggtcgccgagaaggactacgacgagaatgacctggcatacctccacaagaagaaggatgagcaaaaggccctgaaggagctgaaggtcaaggcgggccagaagggtgcgctgggaggatctgttctccagaagagtgggaagaaatgagtctgcccacccattcgtaatacccacaaagtgatactcgatctatctacttatcggagaagggattgattatctgtaggagtaatagattatttttaaatgtgtcgagcattgcgtatcgccgcagtctgtccc

SEQ ID NO: 61901 - DNA, 717 bp, Triticum aestivum
  unsure (1)..(717): unsure at all n locations
  Clone ID: PAT_TA_61901
gggacatagcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggncagctctagatccgcccgcccgccggtcgnctttcgccgtcgtcgccgttcgccccgtgtgtcccgtgtcgtgtcgtcgatctaaataagagagtcgtgtgtcgtgtgtcgtgtcttccc

SEQ ID NO: 61902 - DNA, 383 bp, Triticum aestivum
  Clone ID: PAT_TA_61902
tatacaggaaagttggtgaagttttttgtgtacagaagctactgcagaatttatcttctcctgtttttctttgcatggagaaatcaggaagagcttcttacagaagaagacagaagtaggccatcagtatgagcaagacaaatgtacagcatttgactggtctgcatcagatgctgattggcaaattagaagaacttttttgcttggttttgcattaatatattttagattgaaccgtaaaataggcgctagccccttttgctttatatagtttgatgtaatgtgacagtgagttcaaatttttggtctgccgtgaaatctgtacataacttagaacatgaagaagagcaagaaagaatgaaaattttacccattacgcctgc

SEQ ID NO: 61903 - DNA, 478 bp, Triticum aestivum
  Clone ID: PAT_TA_61903
tcttctcggaggagcagttcgccgggacgttcgagggcaggcggccgtgctacttcaacaccggcgtgatggtgctcgacctggcgcggtggcggcgcgcgggctacacccggcgcatcgagcggtggatggagatacagaagtcgccgcctgggcgcatctacgagctggggtcgctgccgccgttcctgctggtgttcgcggggcaggtggcggcgatcgagcaccggtggaaccagcacggcctgggcggcgacaacatcctgggcagctgccgcgacctccacccggggccggtgagcctgctgcattggtcggggtccggcaagccgtgggcgcggctgggcggcggtcggccgtgcccgctggacgcgctctgggcgcgcttcgacctgtacggcccggacgccgtggagccgtaccggcaaccaaccgcccgcacacagactactactactactaagattcttttccttct

SEQ ID NO: 61904 - DNA, 585 bp, Triticum aestivum
  Clone ID: PAT_TA_61904
aagtaaaaaaatcccacacagttagatctcgaggccccctctcccggcagcccctccccattaatcagatgccctactcccatcttcatgagcaggatattcttggacaaggcgacctggatgtgggatgtgatcgtcctcgacgtgctgagcagtcgcgacactctcaacgctagaaacatcaccactacggatgctgtcgacgccattaaggacccgccctaggactccattaccttcccgcccttcaacctgctcccaaagatcccaccggcttttcacaactgctgcatgatgacgggattcgctctccccggcaaaatcggcgccgccacgcttttcaaccgtcatcgttaccttgcccttcctcggagactcttcccccgggctcttgatgtcaccctcactcgaggttttcggagagcatgccgcatatcccctctgtcactgcttgcaacgaattgcatgagaatgcgagactcttgaggagcgacaattatatctaccttcgctggtgtgtgtgaagcaatgacagcaattatggttgatatctacgacatggactactcgtagtcgtcatgcatg

SEQ ID NO: 61905 - DNA, 747 bp, Triticum aestivum
  unsure (1)..(747): unsure at all n locations
  Clone ID: PAT_TA_61905
ttcgtccgccatctccttaagttacagttctctctcctcctccggactccagagctctgctaatggcgtcgccaggttccacgagcaccagatggggtctcgcgcgctgacgacccccgcatgatgatcaatccatcatctaccgctgaactctgttgcactcgatgaggtccacgtcaatgccaagatctgtcacttgctgaagaatgtcaaccaatgtgagataacgcctaacggaccagtagtgctctcccatcanacggagcatctgtatgagacagaactccacacccaccaatcaatgaactacgcgttatctgacctgagagtaccatgagaaggacactgttacctcaatatgtaccaagatgaccgggacacgacccgctacggtctaccggtagcatcatgtacacgcagatggcgctctgtgcaccgctggtgtgacccctgcatccagatcatctggactgcaacgcaggacttgaagctgtgctacatgtacaactgcatatagtgccactactcgaaatatctagttcccgctgtggcaccataacgctcgcccacccacccgcaagatcaagactacctactggttgacgaggtccatcctcttcgtgagagtgactccctactctactgcactgtgtgtcttagcgtgcaacagtttaaagattattgaatgagcaagaattggtacaccactatgatgatgaccctcgctgctaaggatgctgctggtta

SEQ ID NO: 61906 - DNA, 740 bp, Triticum aestivum
  Clone ID: PAT_TA_61906
accaacaatccatcccctctccgcgatctcaccgagaaaatcctcgaccgatcggaagacaagcgcccctcacgctccttcaagatgcagatcttcgtgaagaccctcaccggcaagaccatcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggataaggagggcatccctccggaccagcagcgcctcatcttcgccggcaagcagctggaggatggccgcaccctggctgactataacatccagaaggagtctaccctccacctggtgctcaggcttcgtggaggcatgcagattttcgtcaagaccctcaccggcaagaccatcaccttgggaggtggagtcctcggacaccattgacaatgtgaaggcgaagatccaggacaaggagggcattcccccggaccagcagcgtctgatctttgccggcaagcagcttgaggatggccgcaccctgccagactacaacatccagaaggagtctaccc

SEQ ID NO: 61907 - DNA, 635 bp, Triticum aestivum
  unsure (1)..(635): unsure at all n locations
  Clone ID: PAT_TA_61907
ctcgaggggccggccgggcccgggaatacaaaaaangaaaaaaaaaaaaaaaaaaaagaaaaaaaaaaaaaaaaaaaaaaaaaaaaaaaaaaataaaaaaaaaaaaaaaaaaaaaataaaaaaaaaaaaaaaaaaaaaaaaccccaaacgaacccaaaaagaacgaaataaaaggaaccaaaaaacaaaaaaatttttttcctaaaagaaaaaccaaaaattccctctttgcgggcccctagggggccccccccgatttacacctcgccaaaaaattttttggggcgggggggggggggaaggaaattatgcggaccccgcgggggcccccccctttttatgtgttgctgaaagccccgttccagcgtccaaaacgggggggtttaaagggccgtgggggggggccccgggggggttttttttgctaaatgcgtgcgaaaaccccccccccccccccctttttaattactgtccaatgtggggcggctcttgaaacatttttcgggaaaaagggccccacccccctgatgatgttattccctaaaaagcccacatttgcgcgcccggcctagaccattctccgcggatgtttgccttcctattttcggaaacccagataggtgttttaaagtttt

SEQ ID NO: 61908 - DNA, 350 bp, Triticum aestivum
  Clone ID: PAT_TA_61908
cggccgctcaggcggcgggcgggaataaaaaaaaaatcacatatgacagcgagctcaccgtcgaccatgtgacatacagatgtatcttctgatggatccgtttggtttccatgggatgaaggttgctgtaagctgttagccaaaactgcctcatggctaatgtacttgccctaccgtgttatcttctgttaggcctcgcgacaatgtagttagaaaacctggtagtcagtttcagatgttacttagaaagtctggcacaagtttgtttccagtgtaccatggtcgctgcatgtctttgaaaactgaaatgtgttgcggagaatcgctcaaaatgtgcttgtgaggttgcc

SEQ ID NO: 61909 - DNA, 652 bp, Triticum aestivum
  unsure (1)..(652): unsure at all n locations
  Clone ID: PAT_TA_61909
aatccaccccactctcccccaccccaccccacccacagcctcactcgcagcgcccctaccacgcgcagcgcgcagagctagatcgagatggcgacggagctgacggcggcgcagctgcgggcgtacgacggcaccgacgcgtccaagccgatctacgtcgccatccgcggcaaggtcttcgacgtctcggccgggcgcggcttctacgggcccggcggcgactacgcgctcttcgccggccgcgaggccgcccgcgcgctcgccaagatgtccaaggacgccgccgacgtctccggcgacctctccggcctctccgacaaggagctcggcgtgctcgccgactgggagtccaagttccaggccaagtaccccgtcgtcgcccgcctcgccgcctgatgtcaatgaagtcaattccgccaccgtcaccgtcctcaactagtatcgtatcctcctagctccaccgtgtgtgtctgtatcctgttgctccctgcgtatgaccgtcaaataataataatttgagggcgtgtttgttggcgacaattggtgaactgaaataatagtactgtggtctgttgttaagatcaatggagcaattgatgattgatccttataaaaaaaaaaaaaaaaaaannnnnnnnnnnnnnnannaccc

SEQ ID NO: 61910 - DNA, 587 bp, Triticum aestivum
  Clone ID: PAT_TA_61910
gccgcttcgagccggccgggccgggatctcacagcctcctcactcctcacagcatctctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggcgcacaggaggccggccggcagaggcgagcacgaggatgaggaggagaagcaagcaatcatcatcaccaccaccaccacccagcgtatcagtaccactagccgccgcatgcgctcgcgcgcgcgctaaataaaataaaaccgtcatgtgttccttagttctgtacgaccagtgtccctcctcatgcctccacttctaatgaatatatggcgcctcaactttgaacgatac

SEQ ID NO: 61911 - DNA, 640 bp, Triticum aestivum
  Clone ID: PAT_TA_61911
atctatctccattcccaaccccaatcccaaatcccaatcccagagataacgaagatgaggaaccagaagagccgtgttcaggagtgcaaggtcgagcacatcgacctcatcccgggcatgccggacgacgtcgccgtcgactgcctggcgcgcgtcccgcacgcctccttccgctcgatgcggggcgtgtgccgcggctggaacagcgccgccaccgcgccggacttcgcgctggcgcgcgccgaggccggcgccaacgaggatctcgtctacctgctgcagttcgggaacccggcggccgcggacgcggacggggtcgcgccggagaacgcccaggcgtacggggtgtcggtgtacaacgtcaccaccggggagtggcgccgcgagggcgccgcgccgcccgtgccgatgttcgcgcagtgcgcggccgtggggagccgcctcgccgtgctgggcgggtgggaccccaagaccttcgagcccgtggcggacgtgcacgtgctcgacgcgtccaccggcgtgtggcgccgcggcgcaccgatgcggtcggcgcggcccttcttcgcctgcgccgaggcggacggcaagatctacgtcgcgggaggccaccacaagctcaagaacgcgctgaagacggcgg

SEQ ID NO: 61912 - DNA, 501 bp, Triticum aestivum
  Clone ID: PAT_TA_61912
taactccaagaagacacaagaagctcatagctaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactaa

SEQ ID NO: 61913 - DNA, 556 bp, Triticum aestivum
  Clone ID: PAT_TA_61913
aattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaact

SEQ ID NO: 61914 - DNA, 602 bp, Triticum aestivum
  unsure (1)..(602): unsure at all n locations
  Clone ID: PAT_TA_61914
ggcccgctcgaggccggcnncgggccgggaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttcttttttttggggaaaaagtttcccccttaacctggatcccccccgggggccccaggggtgtccttctggggggggccggaaaataaggggacccccaggggtgggaattttgggaaaagctcccccccggggggccttttaaaccggttgggcttcccaccgaacccaaaaaagggggggtttttaaggggaagggaaataaaaaaggggggggggccatggttcccagggggggtttttttatccagggcaaaggacccggggggggcccctttgaaaaacgggggggggaccttaaggacccctttggaaaaaaacgggttaccggttttttcggggcccccaaaagggggccccacctgggaagtggccctttattgcccccccccccccgcccgtttgttagggaacccctcgcgggaaatgcgccaaaagaaatatttgggggggggggatttttccggggaaaa

SEQ ID NO: 61915 - DNA, 541 bp, Triticum aestivum
  Clone ID: PAT_TA_61915
aagctagcaagcaagaagcacaaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcgagggtctttgtatgtatgtaagcacctgccagcatgagcagagcaggtgcactcccatgcatgcaaaccgacccctaaataaaatcccccgcgcccccccctcaaaaaaatatccccaaccacaaaacacgcccc

SEQ ID NO: 61916 - DNA, 595 bp, Triticum aestivum
  Clone ID: PAT_TA_61916
ataccaattcatagattcctctcgacccatgcaccaccgcctgtacacatcaccacacctacgagagccctcgtctgccggagaagcaggcaagcaagcaagatggccgggaggaagggcggagagaggaagaaggaggtgacccggtccgtgaaggtcgggctccagttccccgtcggccgcatcgggcgcttcctcaagatagggccgctacgcgcagcgcgtcggctccggcgaccccgtctacctcgtcgccgtcctcgagtacctcgccgccgagggactggagctggtcggtaacacgaactacgacaacaaggaatacgctcatcgtgatgagcaagctgctgatggatgatctcaaggagcattagctcggtaggttggtgtacgaagtccacattccatatttggtggatctcaatgacatacaggaagtgattgtgatttggatttataaccaacacgagtgcgaaaatgatgctaccctgattggaacgatactgaatgcttatgcaaaagcgcccccaaagacgacagtgccatccataagaagtgaggtcatggactcgactgctacgccgagggaccgtgt

SEQ ID NO: 61917 - DNA, 552 bp, Triticum aestivum
  Clone ID: PAT_TA_61917
aattcattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacct

SEQ ID NO: 61918 - DNA, 375 bp, Triticum aestivum
  Clone ID: PAT_TA_61918
accactctaacacagatatcttctatcatccgatccgtaagaaagaagtgagagtcgttagactagaagtgcatcagcagaccatgaagggcaccaaagtcgcggagatcctcatcctccagagcgcactggtcatgggagacctctgacaggtgaacgccgactatttccccaagtgctgcaacaactgcaggtccttctccggggacgaagattgccacgaccgccaccacatgtgaaccacggggtggtcgatgtgccccgaggtgtcgacaagacccaaaatgtggcgctgtacggatatgaaatccaccgaaaacagtgcctgcatcgagatttggaagaatgattgctcgtgtcaaggcgccatggtat

SEQ ID NO: 61919 - DNA, 481 bp, Triticum aestivum
  unsure (1)..(481): unsure at all n locations
  Clone ID: PAT_TA_61919
tactcaaaaagggggnnnnnnaaaaaaaaataacaaaaaaaaagtgagcatgtcatgcgacaagagccggtcgaaagccatgacgatggtcgccaaagcgaacggggtgagctcggtggggataaccggcgacagcaaggacatgctggaggtggtcggcaacggcgtcgacccggtgtgcctcgtcggctgcctccgcaagaagtaccacgacgttcacctcgtcaaggtggaggaggtgaaggacgacaagaagaaggatgagaagaaggaggacccgccgccgtactggtaccaccacccatatgggccatacccgcctcacatggtcgtgtgcgacgagcccaccaccccctgcgccatcatgtaattgccaaatagccagatgcccagttcgccatttggagaggccgcaagtttatccaccatttcaggctattggcaaattggaagaaataaagaaacgtataccccagatccg

SEQ ID NO: 61920 - DNA, 466 bp, Triticum aestivum
  Clone ID: PAT_TA_61920
agtatcccatccaaccgagccgcccccagattactcactcccctcctcgccgatcctccgatctactcgcaaagtcgcaagctacagagcaaggtcgtgaactcgtgaatcgtgatggctacacgagtcgccgtgctgctcctggccgtggccgtcttctttgcctctgcgtccgcacaggacttcatggcgccttcctcggcccccgctccagcgcctgacgttggcgcggccgccagcgtgtccgcgttggccttggtgtcctcggcactggtgtcctttgtcgcggcggcgatgatgcagtagatgagtgttgctggctcttgcctctcgtttgtccgacattctttttattatgtgtctatatatagtgttatgattaaagtttgttggttcttgataatcttgtgtgaatatctcccggcaaaaagagcttaattatatgcgtatgtgtttgatctttccc

SEQ ID NO: 61921 - DNA, 817 bp, Triticum aestivum
  unsure (1)..(817): unsure at all n locations
  Clone ID: PAT_TA_61921
acatttccaagtcaccaacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggcggcagcttcgaccccctgggcctcgccgaggaccccgaggcgttcgcggagctcaagggtgaggagatcaagaacggccgcctcgccatgttctccatgttcggcttcttcgtgcaggccatcgtcaccggcaagggcccgctcgagaacctcgncnngacactcgnncgacccgtc

SEQ ID NO: 61922 - DNA, 508 bp, Triticum aestivum
  Clone ID: PAT_TA_61922
cgggaagtcagcaagcaagaagcacacaggaagctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaactt

SEQ ID NO: 61923 - DNA, 707 bp, Triticum aestivum
  Clone ID: PAT_TA_61923
gattcacatcaaacccctccaccgctcgcccgcgcgcgccacggacgcagcaatggccgccctcaccgcctccatcgccacctccagcgccttcgccgcgaagccgcgcctggcccgcccgccggcgcgcctctccgtctcctgctccgcgtccagcggcgacaacaacaccccctcgctctccgcctccatcaagaccttctcggccgcgctggagctctcgtccgtgctcctctcctccgccgccacctccccgccgccggcggccgccgacatcgacggcctgaccccgtgcaaggagtccaaggggttcgccaagcgggagaagcagtcggtgaagaagctcaactcgtcgctcaagaagtacgcccccgactcggcccccgcgctcggcatccaggccaccatcgagaagaccaagcgccggctcgagaactacggtaagttcggcctgctctgcggctccgacggcctgccccacctcatcgtcagcggcgaccagcggagactaggggcgagttcatcaccccacggcgtgctcttcctctacatcgccggctgaatcgagtgaccacgtccggagatacctcatcgtcggcagcggagagaacaagaccgtcatgccgaagatcgtcatcggcgtccagctcgccgacaggatcatgcccaggggctatatctggtgccgactcgcctaccgcgagatc

SEQ ID NO: 61924 - DNA, 670 bp, Triticum aestivum
  unsure (1)..(670): unsure at all n locations
  Clone ID: PAT_TA_61924
ctctcgccgtccgccgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcntatctatgggtgtcagtcgactctcct

SEQ ID NO: 61925 - DNA, 762 bp, Triticum aestivum
  unsure (1)..(762): unsure at all n locations
  Clone ID: PAT_TA_61925
tcgaggggccggccgggccgggggaaaaaaaaaaaaaaaaaaaaaaaaaaaaagttcttccgctcccgacgaccgccatggccgctcagagcctcctctttgccgccgccgcgcctctcttccaggctcctgcctctgcccgccctttccagtcgctccgaattgtctgcaccccagaaggcgccaccgccgccgccagggcgctcgtcgtcgccgacgccaccaagaaggcagtcgcggtgctcaagggcacctcgcaggtcgagggcgtcgtcacgctcacccaggaagacgacggtcctacgacggtgaacgttcgtatcactggacttgctcctggacttcatggcttccacctccatgagtttggtgacacgactaatggatgcatatcaacaggtccacattttaacccaaacggcctgacacatagtgcaccagaagatgaagtccgtcatgcgggtgacctgggaaacattgttgccaatgctgaaggggttctgtcttttaattgtggtggtttaggtgtggcggagacaaccattgtcgatagccagattcctttgactggccctaatgcagttgttgggagagcgtttgttgttcatgagcttgaagatgacttgggaaaaggtgggcatgagctcagcctcagtactggaaatgctggtggaagattgcatgttggtgttgttggcctgaccccgttgtangtcgctggtttccatctctggttttgcatctccagtcatactggtttcc

SEQ ID NO: 61926 - DNA, 601 bp, Triticum aestivum
  Clone ID: PAT_TA_61926
gcttttcttcagacagagttggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtacgtaacgcagttaccac

SEQ ID NO: 61927 - DNA, 827 bp, Triticum aestivum
  Clone ID: PAT_TA_61927
aggcatgcctatggtcctataaacgctgttctgtacaccgtcgagtttcagaagttcctggtattcctgtgaagtatgtttttagaccagtggaaggtcatttaatgattaagtttacaaagtgcactgaacttgtggagagaactgaaatggaagcagagttccccttctgtacttatgcattgactccaacagctcagctccctaggcctacagatatgcctccctaggcctacagatatgcctgaacgctttacaaatgtcattggagtgattgctggaatctctgaagctgttccgtatgttagtgcaaaatctcagtgcgttctttttaaagacaaagcagtttgttgacacagacaaagagagcttgtctgatcagttaatgagtctgtcactgaaaaggaaaattcaccacagcttggcagttccatggagaaggataacttaccgttgcctgatcagacctccgatgcaaaaaggccccaaccatctgtccctgtcgatgctcgaagcaatccgagcaagcggggcagatagaagtagaaacatcgcctggtaggcgagtcatcttttggagatccaagactttttgttaacgttgctgtaaatggacggtttcttattagtatgcctgtacgagcgagtcccgtgcttgagcttcggctcgtaggcacttaccgccacatcacttggttgcttatgggcaacaatggcaactatcacaatcatgtttctgtccatccggactatcaggctacttggctagaagctgtatttttgtcaggactgcagggtatgagatcgatgtatacatgcatgcccct

SEQ ID NO: 61928 - DNA, 495 bp, Triticum aestivum
  Clone ID: PAT_TA_61928
aagtcagcaagcaagaagcacacaggaagctcctagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgtggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatttatgtacgcacctgcctgcatgagcagagcgggtgccatgccatgcatgtaaacccctaaataaaatctcccgtggttttgctt

SEQ ID NO: 61929 - DNA, 802 bp, Triticum aestivum
  Clone ID: PAT_TA_61929
atccaccattcttctgttgccctgattgattgtttcttgtggacgccatggccgcccacggcaagcccaagcccaagccgcccggtgcccccgcgccgccgccgcccccaccaccgccgccgacggcggcagaggcgaagaagggcttcatgcgccggatgttccccttcctcctcgccgtcaacgccttcgtcggcgcctacgtgctcgtcaggacctactacaaggactccccggccaagaccgccgactctgcttccgccactgcaacggcgtccacatcgtctgccgccgccgccgccgagtccactgacccgccggtggcaacgcccgccaaggtgctcccgccgatccccgaggacgagcagcgccgggtctacaagtggatgctggaggagaagcgcaaggtgaggccgcgcgacgccgccgagaagaagaggctcgacgacgacaaggccctgctcaagcagatcatccgcgccgacaccctcccggtgctctgagaccggatgcgtggatgggtggatgaagctcaccgccagattgatcgatgttgctgcttgcgtctgtcattgctttgcctcatgtctctcttctctgctaaagagaatggtttgcttggactctttagttagttaattgtgtcgtgtggcactgttattatcatcatcttatataagttagtacgacgccgagaggcccatctcgagctgttttattttagttgtgtggatgcagacagggctggtctgttgcttgtgttgccctgtgcttcttcatataaggatttgattcgtctcaa

SEQ ID NO: 61930 - DNA, 593 bp, Triticum aestivum
  Clone ID: PAT_TA_61930
accaagaagacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaact

SEQ ID NO: 61931 - DNA, 821 bp, Triticum aestivum
  unsure (1)..(821): unsure at all n locations
  Clone ID: PAT_TA_61931
acacatccgatccgatccaatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccaccctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactacaacattcagaaggagtcaacccttcacttggtgctcccgtctcccgtggtggncagtaagctcctggncatggagctgcttttgtctc

SEQ ID NO: 61932 - DNA, 777 bp, Triticum aestivum
  Clone ID: PAT_TA_61932
acagagcccgaagcgaaaggaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagatctccgtggttggtttaggagggttttaggtggactctttgggctgct

SEQ ID NO: 61933 - DNA, 606 bp, Triticum aestivum
  unsure (1)..(606): unsure at all n locations
  Clone ID: PAT_TA_61933
cggccgctcgagcgccngccgggcttctctctnactccccgtcgccgggctcaccaccgccgccgcctcctccccccgcccgtcgcctcctcaccgtcggccccagccacgccgcgcccctccgcatcctctgctctccgcccgtacagatccgtccggcgagcatcctcggcccgctcccgacgggctcgccgccgccaggacctcaccgcccgccctcctcactacgaagagaaccgaggtccgccgcccaagctccaatttttcgtccggggaaccgaacccaaccgtccgccgccttctctgctcaactgaagagaccgtgattcctcgctgcttggacgacgtacatttgcgcccgtctggtcaccagcgagcccccatgtcggggctagaggagttaaagaagaagctgcagcccttgctgttcgacgactcggacaagggcggcgtcagcacccgagttcccttcccggaggacacatgcgattcctatgtggtgtctgatggtggaacaataaatttactgagtagatcgtttggtgagtataacatcaatgagcatggctttcatcacccacgtactgggccagaagagccagatac

SEQ ID NO: 61934 - DNA, 681 bp, Triticum aestivum
  Clone ID: PAT_TA_61934
cactctttcctctcactcacacaagcagacaccaccagcatcatcattcatcagcgagctcgccggtctttatgcagaagtgcagatcggtgccgcacgagcacgcagcggcggcgtactacgggtgcggtggcgggtacgactacgaggacgtgagccggggcacggcggtcaagtcgtacagcttcaacggccccagcgccggcgaggacccggaggcgaagcggcggcggcgggtggcgtcgtacaacgtgttcgcgtcgcaggcccggatcaagtcctccgtccgcggcagcttcaagtggctcaagtccaagctctccgacgtccgctacggtggcctctgaaacttttttaccctcaacctcccacgaaaactgaacctctactatatatatgcgtgcatatgcatgaagaagtgtgtatgtgagtgtgctactactgctgctgctgccgttgctatacgaggagggatggccccccaagttgctgcacacatgggggtactgcctaattgcatggcggcattatgcatgtatgaaccgctgatgtgagagtgatgccaaggggccggagggctaaccgctagatccctcccgggaccggactaaggggccttggggggctttatgagagaacaaacgggggtccggaccaaaaaaaaaaaaaaacaaaggcccc

SEQ ID NO: 61935 - DNA, 528 bp, Triticum aestivum
  unsure (1)..(528): unsure at all n locations
  Clone ID: PAT_TA_61935
acgttcaacatgacgcccgccaaagcagttcctcnccttcctaatcacactctctcggagcggcgatgtccgggcgcggcaagggcggtaaggggctgggaaagggcggcgccaagcgccaccggaaggtcctccgggacaacatccagggcatcaccaagccggcgatccgcaggctggcgaggagaggcggcgtgaagcgcatctccggcctcatctacgaggagacccgcggcgtcctcaagatcttcctcgagaacgtcatccgtgacgccgtcacctacaccgagcacgcccgccgcaagaccgtcactgccatggacgtcgtctacgcgctcaagcgccagggccgcaccctctacggcttcggaggctagattcgtgtagtggagcaactccctcgtttgctttgtgtgatatgtgctgtggtggattgatttactgatttggcgtgggccgttgtattctgtcttgggttcagtagtctgtgtaataccctgttctgttcaatgcaatcagttcgattct

SEQ ID NO: 61936 - DNA, 351 bp, Triticum aestivum
  unsure (1)..(351): unsure at all n locations
  Clone ID: PAT_TA_61936
agagacactatgccanaaaacagcaccagcaccgccaggaagggcagnagncgacgcagcngagcttggcccgccgcacggcccncanccncgccgcgcnccnccccgncgcccgggccgncgcgccgnnggacaacgccaagaaggccgccaaggacaaggaggagaaggccnccgacgcccccacgcacgacgcgccggccgacgacacgaccgcggaggggccccccgaaggaccggaggcagcccccgggacagagggcaacgacggacacacgaccgacaacgacgacaacgacgacaagagaacccgagagcaaggccgaaaggaagggaccgaacgaagccgac

SEQ ID NO: 61937 - DNA, 347 bp, Triticum aestivum
  unsure (1)..(347): unsure at all n locations
  Clone ID: PAT_TA_61937
cacccacagccaaggaggacgncttgctgcggcggcaactgcgggtgcggcgccggctgcaagtgcggcaacggctgcggcgggtgcaagatgttccccaacgtggaggccaccgccggcgcggccgccatggccatgcccaccgcctcccacaaggggagctccggagggtaccaaatgaccgacggggagaccggtggctgcgactgcaccacctgcaagtgcggcacctcgtgcggctgcccctgctgcacccgcaactgagccgccgcacaagaggccgaccggcagaggagagcaccacgatgaggaggagaaccaaggaatcatcatcaccaccaccacca

SEQ ID NO: 61938 - DNA, 234 bp, Triticum aestivum
  unsure (1)..(234): unsure at all n locations
  Clone ID: PAT_TA_61938
cggcgggccggggnctcccggagtgcggatgacgtggcgccccttccgcctccggggcaccacctcactaagccgcccgacaccaccggactccgacctttgaacccccttttagcagcttccaaaccctagaaggggagcacgcggagcagcgcacaggccagcattcgaggagcgccgagatggccaacgcgcgcaaccagaagccggaagggggcgccggccgcggcccca

SEQ ID NO: 61939 - DNA, 482 bp, Triticum aestivum
  Clone ID: PAT_TA_61939
cgggccggcttacctttacctgaattggaaaaaaaaaaaaataacaaaaaaaagaggggaaaaaaaaaaaaaaaaaaaaaaaaaaacaaaaaaaaaaaataataaccccaaaaaaaaaaaaaccccccccaaaaaccgacccacacgcccaaacaaaaaataaaccctccccccaaccctttatttcctcaaagaggcgcccaaaaaaaaaacaacccaaacaaagagccccccaaaaaatataaactggacccaacaaacctctccaagttacaaaaagggcgggaaaaaaaaccacagcccattttttttacccccccgcaaaaaaaaaccgccccccggggcgaaaaccaccccccccaccgcattgggggggcaactacacccctaactggggggtacatcccccaaaaaggggggcgacaacattcttttttaattcacaccccctcccaaaaaaatacttcccaaaaggggcaaaa

SEQ ID NO: 61940 - DNA, 645 bp, Triticum aestivum
  Clone ID: PAT_TA_61940
cttgttgttgtaagtgtggttgtgcgttgtaagccgattgacatcacttgtatggtttttgggtccggttttccttataaactggaccgaccttctatctactcaatgaatttagcagtgatcctgctaacattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccccaaagacccaaaaggggccaaaaaaaaagaaaaaccccccaaaaaaaattttttggggaaaaggggcaaaaaaaaaaaaaaaggaaaccaaaaaggggacccccctattaaaaaggggggggaaaaagccgaaaaaagggggaaaaaaaaaaaaaaaaaagccaaaggggggggccaaaaggggggggaaaaaggagggaacaccttggggaaaaaacccaaaacccccggcttaaaaaggccccaaaaggggggcaaaaaggggaacctttttgggaaaaaaaaggccggaaaaacccgaatggtaaatatttaaaaaaaaaaaacaaaaaaggatccccccatt

SEQ ID NO: 61941 - DNA, 274 bp, Triticum aestivum
  unsure (1)..(274): unsure at all n locations
  Clone ID: PAT_TA_61941
agatcacaatcccaaatcaccaaccaaatcccctcccctcctctcccgcggcacgacgagcaccagccaccggacatggacgncctcagccaccggagccggagcgaaggcgaagaagggcgcggccgggcgcaaggccggcggccccaggaagaagtcggtgacgaggtccgtcaagggccgggctccagtttccctggtcggnnncgcatcgggcgctacccctccagaagggcccggtacgcccaagcgcgtcgggaacgggggggccccc

SEQ ID NO: 61942 - DNA, 512 bp, Triticum aestivum
  Clone ID: PAT_TA_61942
gtgtgcgctggaactgatggtcgcagctgccggctgcaagtgctgcaacggcatgataccatggcgacacaatgtctgccccgacgatgcaggccagccgtcgcaatgcgccggcatgctactgctcgccgactttctcgcagcatatttcccaccctgtccaaatactgcttcctcataccatccggtttgagtgttccccatggcacagacctctccagtgccaattgtcatggtgcaactgtgaatgaacccatccacatgaatgcattcgagagagtcgatgacgcagtgatcgtagcgatgacattgatatattatctgctctatgaacaacacccagatgatcagtaccactgaatgcatgtatgtgctcgcgagtgcctctacattaacatatgacactgtgtgtaacttactactattaccatcactgcaacatattactgattacactgctaatgcatcactatgcatcctatgactgttcgaccaccctttgaatatgaaaa

SEQ ID NO: 61943 - DNA, 339 bp, Triticum aestivum
  unsure (1)..(339): unsure at all n locations
  Clone ID: PAT_TA_61943
ganttgcgaaaaaaaaaaaaaaaaaaaaaaaaaaaattaccaaaacagaaataaacacacacgaaacagcaacggaaagtagacgggaggttgtctattgccagcagcatgcattttgaagtgctcgtaggaggttccttgggaactcggggtacctgaattgtcaatgaccgggctctctcctagctcaaaaaaaggccaaaaaaaggccccagaggggctacctggggcggccctacgggcaaacataagcccgtcctcaagtctttttggaggttaatggggctaaaaagggccctcatacgggaaccctatatgtgttgcccccgagttcgccac

SEQ ID NO: 61944 - DNA, 377 bp, Triticum aestivum
  Clone ID: PAT_TA_61944
tcttgtcacatttggccgggaattacactccatgaagaagttcatggacaaatcatgcagcgtcatggactcatcttctatagcacataagtaggcgcgcatgccagattggttcctccactacctagctgatgttgtttgtacccagactacccacagtgcctgatgaagctacaagacttgcaaatagacgagcccacggagaaacaacatccttgtgtatcttgagctgctgcatcacttgatggaacgagatatggtgtcgggaacacagcaggattagcaagtaatttcgagagtaatcttgtatgcgccctgggctcagtttgcgccgtgataaattgttttcaacatgtaatacatttgttatactcgcg

SEQ ID NO: 61945 - DNA, 558 bp, Triticum aestivum
  Clone ID: PAT_TA_61945
cggccgggccgggaattaccaacaaggacaatcctcctctgcttcccgatccccaagagcatcacctgcaagcaatggacgtttcgggcaccggagcttgcgccaagggcaagaagggcgcggccgggcgcaaggccggcggccccaggaagaagtcggtgacgcggtccgtcaaggccgggctccagttccccgtcggccgcatcgggcgctacctcaagaagggccgctacgcccagcgcgtgggcaccggcgcccccgtctacctcgccgccgtcctcgagtacctcgccgccgagctgctggagctcgccggaaacgccgccaaggacaacaagaagagccgcattatcccgcgccacctgctgctcgccgtcaggaacgacgaggagctcggaaagctgctggcgggcgtcaccatcgcgcacggcggtgtgatccccaagatcaacccgggtgctcctccccaagaggaccgccgagaaggaggccaaggagcccaagaagacgaccaagtcccctaagaaggccaccaaggcttagatcgatccattccat

SEQ ID NO: 61946 - DNA, 807 bp, Triticum aestivum
  Clone ID: PAT_TA_61946
ttccgctcgagtccggcgggccgggtcttcctaactcatccagatctctctctccatccccttccctacctagaaggtacaacggccgctgtgcttcctcctgttgcacgtggctggacatcaaaatccacctatcctacccagctgtctccttctccaccctcaccacctcaccgcgctgaccttggggtcctgccaccaccacgacctcaccgtcctgcccagctggacatcaaaatccacctatcctgcccagctgtctccttctccaccctcaccacctcaccgcgctgaccttggggtcctgccaccaccacgacctcaccgtcccgtggcagggctgaaggtgtcggcgagtaggaaggagcgggaagaagcggcagagcatgtgtggcagggaggcagcgaggagcgagagcgcggcggccggatcgacatggcagtagaagagtaggtgcttgacggggccggtgaagagccaggaagcttcgaagaagatgatgggaaactctacggaagacatgggcagggccgaccccgggttgatccgctccagcaggcacacttccgccacggattgggtggatgctcgctggctggctcgggtgggtcagttgtcgatctgatctagctcctgcccacataccgctgccagtatatgcacctgctttaatctgcccacctacatttggattattgggactctctttatttcgacttgattatagaaccgcctggccttatgtacatttgtactgaaatttttcctattcgtgcgggacaaaaaaaaaaaaaaaaaggccccta

SEQ ID NO: 61947 - DNA, 595 bp, Triticum aestivum
  unsure (1)..(595): unsure at all n locations
  Clone ID: PAT_TA_61947
cttgcaactgtggatccggntgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggtcgccgggcagtccggcgagggctgcagctgcggcgacaactgcaagtgcaacccctgcaactggtaagctgcatgtactcgtacgtacgtgtgttggtgtgagagtatacgtgaataacgagcgtctgatctgatggagtcaagcaagggtgcgtgtgcgtgtgcgtgtggattgcttgctcgctctcccatgctctgcccatggtgtcccctgtgtgcacgcgcgtgcgcatgtgtccctgtaattgcttcatctatcccccctacggatgggagcgatgaatatgcaacaatgaaagatttacctaataaacaacccccaaaacccctactttcccgaacacacaaaaaaaaaaaaatgactccttagggcccctcatagtggggtgcaccacccacgcaacccaccaccccaaaatcaaggtttttttggggggc

SEQ ID NO: 61948 - DNA, 165 bp, Triticum aestivum
  unsure (1)..(165): unsure at all n locations
  Clone ID: PAT_TA_61948
ttgtttttgatcttagcatggatgaattcttctgttcttnacattcttcttgttcttagactgagactggttaattagttcccggggactcggtatcacccgaaatccccactttatttttcccccgtttaatatgtggaagaatcgatctgtttatcttgaagc

SEQ ID NO: 61949 - DNA, 590 bp, Triticum aestivum
  Clone ID: PAT_TA_61949
cctcgcagccgcagtcccagcacacctctccctcctccctgaagacagcgccgccgtcggcgagagcacttgatggcgaccgtgcccgctcccgcagccgagaccgcggcctccacggcgcgcacggtgaaggatgtcaacccccacgagctcgtcaaggcctactccgcgcacctcaagcgctccggcaagatggagcttccgcagtgggacgacattgtcatgactgcaaggttcaaggagcttccaccttctgatgatgactggaacaacatcagggctgcctcgacggcaacgaagcaccacctgacgcagggaattgggatcggcggcttccagaagatctacggagtccgacagaagaatggttcccgcccgcctcgcttctggcatagcagcggagcatgtgccctgaaacaatcgccaatatgtgcacaactatgcccattcaagatgtgtgccccaaagcagcaaggatcatcacttcccattgaaggcatgccctgcatcagaatgtacaaactggccctgccgaatactcatcagatgaacccccctccatcgcctcatgggtacattgtacaatgtgg

SEQ ID NO: 61950 - DNA, 382 bp, Triticum aestivum
  Clone ID: PAT_TA_61950
aaaaaaaaaaataacaaaaaaaaggaaaaaaaaaaaagggggataagggaataaaaagggaagaactattattaaacataaaaaaaaaaaaaaaaaaaagggggcccgggggggcaaaggggggaatcggaagggaaaagggagcccacgatttatatttggacggggggggccgtaaaaggtgaagagaaaggcaggaaggaagcccccaggttagggtgttagggggatagtaagggaaatgggcgggatgggggaggcaaaaaaaccagaggagcttaatgtgggggtttgggaagggaaaggtggaacttgtcgggaaaatgtgcgcgcaccccgtatagggggatttttctggggcggttaggggggattttggggg

SEQ ID NO: 61951 - DNA, 154 bp, Triticum aestivum
  Clone ID: PAT_TA_61951
cggccgctcgaggcggcgggcgggagctctctcccctcgtcaccatctctcgacaagtccgaagatgcagcgactgcagcgggcaggtgagcggctcacaggggggcctactccccgaagggtgacgacactgcagttacaaacgtgatccaga

SEQ ID NO: 61952 - DNA, 337 bp, Triticum aestivum
  Clone ID: PAT_TA_61952
cgcgaacatcgagtctttgaacgaagttggtgacaagctcgcgggttcggcccaaactttcaatggcggcaattctctctatcgtgagctccaagtgtttgtcaaagccaggctcggagcatatttctctgaacgcgcgatgcattgctgtcaaggtctcgaataaagtcgcatctcgtcataatttgttgagcgatatggaatttgtacgttgggagcttatgaccttcgatcgggtcaaatgtctcgtggttcgccatatcgtcttctttgtcgaccaaagccttagccagactcatagcaccagccttgtagttagttagcaaattgtttccct

SEQ ID NO: 61953 - DNA, 471 bp, Triticum aestivum
  Clone ID: PAT_TA_61953
catccccgaacctaacgtcatcttcttctccttgaaatctttttgggttcacagatttggaggattgtttgccactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggtcgccgggcagtttggtgagggctgcagctgcggcgacaactgcaagtgtaacccctgcaactgttaagctgcatgcactcgtacgtacgtgtgttgctgcgagagtatacgtgaataccgagcgtctgatctgatggactccatcaatggcgcgtgtgcctgtgagtgtggtttgcttgctcgctctcccatggtctgcccatgctgaccttctgtgtatgcgcgcgtgcctgtgtccctgcaattg

SEQ ID NO: 61954 - DNA, 472 bp, Triticum aestivum
  Clone ID: PAT_TA_61954
gtgtcgtgcaggagcagcagcagagcagccgggggtgggacggcagcaccctctccaaggaagagatgggcgccgtgatgaggagcagggaggaagccgccatcaagcgcgtgcgcgcgctgcagtacgcctccatccagaacgagaagatcggcatcaggaggcagcccatgtccagggacgagatggagacgctcaaccagcgctggagctggctggaggagtgggtcggctcgcagcccttcgacaaggacgtggccgtcgacgtggtcacccacccccacccgccgccgcctcgctccagggactccctcgcctgcctcgaggacgacgacgaccatgatgacgacggctatggcaggcggctcggctactcgtccaggcggtccttcggccgcgccaggcgcacgccagggagggggagcgtcgacgacgggctgcaggcctgctcgccggcggtggctttcccggg

SEQ ID NO: 61955 - DNA, 328 bp, Triticum aestivum
  unsure (1)..(328): unsure at all n locations
  Clone ID: PAT_TA_61955
gagagcagncgcagcgccagcctacccaaaacgaggtctncgancccgccgncgccgccgccgccgccgccgcagttatgccgcccaccccgggacccgacaccggcaagagcacccncgcccncgagggcagggacnccgccgccggcgacggccacgncgacggcnccggcaagcgcggcaaccacaagacgaccaagcccaaggaagaagcagcagcccaacaccgaggacaagaagcgcccgcggaaagacgccggagaaccacaacgaaccacgaccccgcaagcggagagaagacccccggccccccgggcggaaacccaaa

SEQ ID NO: 61956 - DNA, 406 bp, Triticum aestivum
  Clone ID: PAT_TA_61956
atcttttctccttatctctgaaggttgtgttgagatgaattccaagcatgctatcaccattgccattctcctggctatgtccgtcacatcactcccttttgttgctgcacgacggctcccagaactgaaccatggcctaccagagagaaaggtgctggcaatcagcacgccggtgaaaggagcaaaagaacggatgtatgccagagacgagaaaatcattatcggcctacccaataccatgatccttccacgccctccctctccgtcgtgcaaggccaaggcgtgttaggatgatactatcgcggcccacatggaggaatatatgctctggacgagaatgtgtctgcttcgtattgaataattgagcttgtcactcgtgtgtgttaaaataaagagcttgcaactc

SEQ ID NO: 61957 - DNA, 375 bp, Triticum aestivum
  unsure (1)..(375): unsure at all n locations
  Clone ID: PAT_TA_61957
caaccagnccncgaccaancgagaagaaggccacctcttccacccgcacacgggggtggagctggcggcgctggacgccggagcgaagtgcgccgcgagggagaagacgacggcggagaaggggaccgacaaaaagaagccggcgcccaagaacgaccacacaaggccaggcgacagccagacagaggaggagccccggcagcacggctcagaggagcggcagccgacgaccaacaagggcgacccgcgggaggccccgcgccccaagccaccggacgacccccccaacaaccgcatccagaccaagaacggcaagaagaacggcagcaacgaggaccaccccaccgaacaccagaacggcaaaacccaccaacc

SEQ ID NO: 61958 - DNA, 481 bp, Triticum aestivum
  Clone ID: PAT_TA_61958
atacatacagtggccgtcgcctcttgccgtcgtgcttcgcgtctcactctcgatcacacacgggctcacactcacaattttttctgccaagatgacgaggacggctaccctgtcgacgctgctcctcctgcctctcgcattcctcctcctcctcccagtgccggtaccagctccgcggggcactatctgcactagccagatcatcaggaacaccatctctccgtgtgaccgcgagggatgtttattctgggtagcctacgcccagatagggtgccctactggtgcggtctgcgactggaacggcgtgtgcagcaggcatgactgcaacttcaccttgtgcaagaattatgggaaccaccctgcagctgcaaccaccttacttccctaagaaaagattatagcatgtcgatctagctagctaggagaataaccattatacgtacctgaaacaatatataacaacccgtacagctatgcaacg

SEQ ID NO: 61959 - DNA, 636 bp, Triticum aestivum
  Clone ID: PAT_TA_61959
caactcataaccctaaccctagctacgatccccttctgaacccggtcgtgtctcagggcgcatcgccgaaggccaagccctccctccctagcagcgcccggacccatcgatcccggcgggacgcgccgtcggcgccccaggctcaagctccatcgcgcgctcgacggcgagggatggatccgatggacatcgtgggcaagtccaaggaggacgtctccctccccaaatcaacaatgaccaagattattaaggagatgctaccgcctgatgttcgagtagcaagagatacacaagatcttcttgttgaatgctgtgtagagttcatcaatcttctttcttcggaatccaatgacgtgtgcagccgggacgacaagaagactattgctcctgaacatgttatgatgtttctgggaaagtcttgtacaagtggagctcgcgcaaaacaaactacttccagccctccatctatgtcactgcagaatgagggagatgcagatcatggcaggagaattagtttggtagtgctatttgtgaaaaaaattgaatgtgccactgtggtaacagtggtaaaggtaatagattggtatttagtatggtgtgtggttcagcgctgaagaaatattgaactggttgtgg

SEQ ID NO: 61960 - DNA, 259 bp, Triticum aestivum
  Clone ID: PAT_TA_61960
cttaatctgagtagatttgctcctcgtgcttagtcacaaaaaaaaaaaaaaaaaaaaaaaaaaaaaaaaaaaaaaaagaaaaaaaaaaaaaaaaaaaaaaaaaaaaaaaaactaaataaaatccctccaaacgaacaaaaaaaaaaacatccccgaaactccgaagaaaaaaaaagagggcccggcccgaggtgcaccctttgttcgcggcaacggacgtggtcatcgccatcggcggctttaacctccttcccaacat

SEQ ID NO: 61961 - DNA, 527 bp, Triticum aestivum
  Clone ID: PAT_TA_61961
gatagtcttagccgggcgctcgccttctcgcctgcccgacctccgccgcgccggccgtacgtacccaatcgatggagatgaagaaggtgttcttcgccgctcttgttgtcgctgcctcggcgaccgcggtgctcgcctccgaggcgcccaccggcgcccccggcgcccccggcggcgcccctggccccgccgccagcggcgcttctgcctccaccgccgtgaccgcccccgtcgcgctcgtcgtctccttcctcgcctactacctccaccactgattgacgcggcgttgtatgtctctgttcgttcgttcgttctaggttgctgctgctgtgatgatggagaagagggggaggagggggcagcgtcgcattggtggcacgcgcgcgcttgcatgcatgtatgggcgtgaacgatgcggcgctgtttttattttattattattattatctgattcgcgtcatgtttattcattatatgtagcgcctgtctgatattaatcctattatacatgaatcgagtggttttct

SEQ ID NO: 61962 - DNA, 676 bp, Triticum aestivum
  Clone ID: PAT_TA_61962
gtctccattacaccgggccgctctccaatttccactgtgtcgctcactgtcgccatcggcggcggcggaacgggcgtaggcgacactcccatggccgccaagatggacatgttcgagaagaccctgatggtcacgaccatcacgctggagcgtggagttctcgcgacccatccacaatcccaaggtcaccatccaccacaaagaggggatcccgccgaagcagaagcgcctcatcttcctctgaaaaccatgtcgaggacgggcgctcacctcgacgattaccatatcaagcatatgagtccacactccaccctggagatcctgctccgagtcgacgccatcatccgcaagacgaaaagctacaccttaccctgtaagcagaaatcactattacaaaatggtgaagctcggcgccctcctattctacgaagtcaacaacgccaccgcgaacgtcaccaagatcatgtaggagtgcccctccgactagagcaaccacgtgaccttcgtgggctagctctacaagcgacgctactggggttagtgcggactcacctacgtctaccaccagaaggtttagaggtggctctgcgtttgctctgctacaatccaactcatttatatgtgtaccggtcgtctttgataactgaaatcctgtagaattatgctatgattcctg

SEQ ID NO: 61963 - DNA, 242 bp, Triticum aestivum
  Clone ID: PAT_TA_61963
aaaaggggggggctaagctcacgcaaacacaactactccccaggggccaacaactcggaaccccccggaccaagcaagcaagggcaaagggccgcgccgacgcgctccggctgctggtcctggtcgcgtccagggacgccggggctgctgcccgtcctgcaaaagcacccgccgaaaaaaaggctgtggtgcccgggatgccgagggacccccctgggctccccgggactgccaggcccccc

SEQ ID NO: 61964 - DNA, 299 bp, Triticum aestivum
  unsure (1)..(299): unsure at all n locations
  Clone ID: PAT_TA_61964
ccagngagaagggaggggagacgcngcggcggccgtttggccccgcaagacagcgcgcgcgcgcgagggcgccgggagcgagggaacggccggcgagacgacgccggcgaggaagcgccggacgcgcgacaacaagcgcccgcagcaggacccgcccgccggcaacagcggcgcgccgcacgacaacaacancacccacaggaacgccgacaaaagagggccggacgacacgccgagggaaggaggaaccgacaagccgaccccgcaaaacacagaagagaaccccaacaagccaccaa

SEQ ID NO: 61965 - DNA, 385 bp, Triticum aestivum
  unsure (1)..(385): unsure at all n locations
  Clone ID: PAT_TA_61965
gcagcnnaaggaacnagcnggcttttagccacccaaggctcggcncaacagcaaggcngnggcggccgccgaggacccggcggcggcggagcaganganggccggcagggaggccacggcggcgcgggcgagcgggcaggaggacnccaagcacgcgccgagcgaggcgaacgngacggggagggcgnccccgaccagcaaggagggcagccccggcgagcaggggcagaacggccgggcccgcagcacaccggaccgcaagatagcgtgcaggtgcctcaagagcctcgccaccagcatcaagcccatcaacatgggcaaggactccggagggcccgccaagagcggcgtaagcgtgaccttccccatcagcatgcgcaccaac

SEQ ID NO: 61966 - DNA, 455 bp, Triticum aestivum
  unsure (1)..(455): unsure at all n locations
  Clone ID: PAT_TA_61966
aacancancagaaaccgcaancaggggnatttcgcgcgactcncgacacaagcgcnccgccaccggagccaagcgggccaacnacaggaagaagcgcgcnnncgaggcgggncgccagggggccaacacccgaaaaggccccaagcgcgnccacaccgnccgaacccgagggggnaaccacaagnaccgggcccnccgacncgacaccggaaacaacgccgggggacccgagggcccgacccgcaagacccggggcanngccgacgcccaccacccanccaacaacgagnaggaccgaaccaacacccccaccaagagcgccgacgaccagggagaagccgcaaccnaccgacagaggaacgaggacccacgacggccaggccacaggccgaagacgccagaaagccccaggccgccaaggagggnaagaaccgaggagggaggcaagaaggcca

SEQ ID NO: 61967 - DNA, 459 bp, Triticum aestivum
  Clone ID: PAT_TA_61967
cggacgggccggtttttgttatcgcccgccgcccagcccatttccacaaagccgccgccactgccgtcgccgccgcagcgcgcggaggcgaccatttcgccttcgccaagatgcagatcttcgtgaagaccctgacgggcaagaccatcacgctggaggtggagtcctcggacaccatcgacaacgtcaaggccaagatccaggacaaggaggggatcccgccggaccagcagcgtctcatcttctccggcaagcagctcgaggacggccgcaccctcgccgactacaacatccataaggaatccaccctccacctggtgctccgcctccgcggtggtgtcatgaatctgccagaataacacgtactccaagctcatgaagtaaaacgacaagcacaataaggtgatcctcgccgccctccacttctactagctcacgacgtccccggctatgtaacca

SEQ ID NO: 61968 - DNA, 543 bp, Triticum aestivum
  Clone ID: PAT_TA_61968
ctctccgcaaccgccgatgtctctgcctattcttctctatcagtcactctgctacctccggcggagatgacgagtcctccccgcaactccgatgtccaggaagaggatgaggcccgaggtggagccgctgtgcgcaaggacagcaagaggacgtaggcgtctgagccttcaaactactccggaagatcaccgtgaaaccagaagtgaggagaaaaaagatggtgaaatcagcagatagcgatgagagaagcatagaggaaggcatggcgctacgccatagcactgaactcatgatactaggtgcacgagaagagaccccgagatcgtgccatgaatcaacaaactcaacaccgatcggaaaagaggcactttaaggtatctgtgactcgcgaatagcaactgatacggaccaatgtcagcatattgcatatatagagaagtgtagccgcgaccataattcagacgaaatcatagagcacctcttattgaaagaacgatgcgacggctgacggctaggtatatatgcgatggttgatggcttca

SEQ ID NO: 61969 - DNA, 781 bp, Triticum aestivum
  Clone ID: PAT_TA_61969
actcacacttttttcttttcttggtctttcgcatggatcacgcgagcagccggccacttctttctttccagtcgaatgcaccgggcagcggggccggctggcacgcgccgggtgcaggtggaggcggggcggcgagcaggaggacggcccgtccggatggggcaggagggggccggccgcggcgcgaggagtcagagccggcacgccaggagccggccagcagtccggcacgcgtgcgaggaggcggccgggtgcgacgagtcagctcggcatgcagcggaggcggccgagcgagttgtggggccggcttgcaggcgaggcggaggacgccggagtggcctcaggcgactgggccagaggcgcgcgggcgagccggctggccgggtgcgacgaggagctgcgggcgggtcgcgtggcaagccggcagacgcgctggggaagccggcggagcgcgggctctgcggaggcagccgcggacgggtccgacccgacggtgtggagcagccggcgcgacgagacggagccagccgcaagcggggcggggccaagcgccgggacggccagtacgcgcgggggcggagcaggcgaagccggtccaaccgccgggcggcgcggaggagcgcgaagggtcttcgggcgcagatattgtgcagcgacgcggcgttggcggggccgtgcaggctgggtcgatgcatgcccggtgggacgcggtatgcgtgacggcggacagagactacgggcgcaagtgcccctgatggagctgaacgctgcactttgttga

SEQ ID NO: 61970 - DNA, 622 bp, Triticum aestivum
  Clone ID: PAT_TA_61970
aacaaacacccatcctcctcatccctcgctgcagcctctcagtcctaacctgccttccctccacgccacccaccaaggaaaggaggatgtcttgatgcggcggcaactgcgggtgcggcgacggctgcaagagcacacaacagctgcggcgcgagcaagatgttccccaacgtggatgccaccgacggcgccgccggcatgtgcatgtccaccgcctcccacaaggagagctccgctgaatacgataatgacggcctagaccggagcctgagactgcaccacctgaaagcgttgcatcgcttgctgatgctcctagctgtacctgcaaatgagacgcctcccaagatgccgatcgataaaggcgaccacaatgacgacatggataagcaaaccagcaccatcatcaccacttcaccaccacccagttgatgatcaccagatgccgtatgtcctcggctacgcgcgcactgaataaaatatgaccaccgttcaagatcctgagatccttatgcccctggccctatgagttagaccagtactgtacttcctcgagcctccacttctaatgaatatatggcctctcatcttctccattgacaaatatataatgcccctgatggcg

SEQ ID NO: 61971 - DNA, 751 bp, Triticum aestivum
  Clone ID: PAT_TA_61971
atgtcggcagtcggagcggaccactgctctaccaacagcaggcgcaggcggtgggcgacggctgctacttctcttccatgtcctcccacttctcccacggggggatcagctccacctcctccagcccggcctccagcttctccgccgcgctcggcgccaccccgcccgctgcaccggcgatcgccgccgacatcacggcgcagtttgacatctccgagtacctcttcgaggagggcgcgttcgccgcgacgctcccgcccgtcgtctccgtgccggccgttggcgcggctgctgcaagttcggcgaccgcggtgactgcgaggagcgccgagtcggcggcggcggcagagcggccgcggacggagcgcatcgcgttccggacgaggacggagatcgagatcctcgacgacggctacaagtggcgcaagtacggcaagaagtccgtcaagaacagcccaaacccaaggaactactaccggtgctccacggaggggtgcagcgtgaagaagcgggtggagcgggaccgggacgacccggcgtacgtggtgaccacgtacgagggcacgcacagccacgtcagccccagcaccgtctactacgccagccaggacgccgcctccggccgcttcttcgtcgccggcacgcacccgccgccaggctcactcaactgagtaacctagccaccaacgacggagcacgtcgagatcagcacggggcttctatcttggccaagctagccagccaggtgcag

SEQ ID NO: 61972 - DNA, 396 bp, Triticum aestivum
  unsure (1)..(396): unsure at all n locations
  Clone ID: PAT_TA_61972
ccgctcgagtcggcncgggccgggagatacccacccgnagtgccgccgccgcgtaataccaccaagagggagccgngggagcncgccnccnccnccacccncnaccacncgatttcaccccggacggccagggcgcagaggaccgcgggcggccgacgccgacggacccncgggcgcgcgccgccgagaaccccgaggggccagagcaccagcgccaccacgccgggggagggagaggcggcgaccaaggggaggaggaacaagaagaagaaccggggcgacgaggcgncagaccggccggacgggggagacggagacagggncgacaagaccaccaggggcgaagncgccaaccagaaaaccaccacaaagaagggccacaggaaggcggggggg

SEQ ID NO: 61973 - DNA, 573 bp, Triticum aestivum
  Clone ID: PAT_TA_61973
cttagcttccttccctcgccgccacccaccaaggaaaggaggttgtctcgctgcggcggcaactgcgggtgcggcgccggctgcaagtgcggcaacggctgcggcgggtgcaagatgttccccgacgtggaggacaccgccggcgccgccgccatggtcatgcccaccgcctcccacaaggggagctccggagggttcgagacggccggggagaccggcggctgcgactgcaccacctgcaagtgcggtaccgcgtgcggttgctcctgctgcagctgcaactgagccggcgcccatcaggtcggccggcagaggcgagcacgaggatgaggaggacaagtaagtaagcaccatcaccaccagttgatgaccacccagtgtataatcaccatgtgtcgaatgacctcccgggcgcgcgcgctgaataaaaaaaaacgagagtttgggttcccgaaatctgtacgcccctgtcgcgtgtgaacaaccagaattgaccttcctcgtggctcaccttttaatgaaatatgggggctcaactttgaaaaaaaaaaaaaaaaaggctctatggcctaa

SEQ ID NO: 61974 - DNA, 683 bp, Triticum aestivum
  Clone ID: PAT_TA_61974
cggccgctcgaggcggcgggccgggacccttactcccaactctaactatcggcccaggcctccgccgccgccccgccttcaggtctctccttccttctccgatccaagatgaagttcattgctgcctatctgcttgtttacctctctggcaaccccagtccctctgcagaggacctgacatccattcttgatgctgctggttgtgaaatcgacaatgagaagatggaactcatgctggcccaagtgaatggcaaggacatcaccgatctcttggctgctggcagggacaagtttgctgtgcttccatctgcagctcgcggggtggatgtttcagctgctgcccctgctgctgtaggagctgctcgcacccatgcagctgagtcaaataaagaacacaatgtcgtggataacgaagatagtgatgatgcatcatgtctcttcactctgttcgactaagttgtgcatcaccttgctgtctgaactatctactccttggtcaagaaactacactcaatgcactgctttaccctttatttatgctgacctgagaaacactggcaagcacaatgtttctgatatgcaattcaccccctgaatgctggctgatttactgcagaaccatacctcttgctatccaattttggtcctttaaaaaatggacctcctccggaaccagctcaccg

SEQ ID NO: 61975 - DNA, 433 bp, Triticum aestivum
  Clone ID: PAT_TA_61975
tatcgctgccgtctcctccccacgactccactctcctctccctcctccgccgccgccgcagccgccgtgcgaatctatctcgagggtgggggagatggcggacgccctggacatgtccctcgacgacctcatctccaagaacaagtcatcctcccagcgcggccgtggccgccgcaacccggcctcgggctcgggctctggctccgcgtcggggggacccgcacccgccggccgccgcttccaggctcgcgccgccacccgcgctgccgccgcgccctaccaccaattcaacttccagcccccggcgccggcggtttttgcatatgctgcccagcaggcccatgcccatgcccacgcccaggcgatggccatggtggcgccgccataccgcgcgttatacgggcaccaagctgtacatctcagaccttgacta

SEQ ID NO: 61976 - DNA, 497 bp, Triticum aestivum
  Clone ID: PAT_TA_61976
aagttcagtactcgcatagccttcttcccaccgagcagcccctcacgaaccctagcttgctataaaccctactccttcccttccccgatggatccgcagcagccggagcctgtcagctatctgtgcggagttgttcaatatgaagctcgctgaagacaaggaacaaacatcattcactgttaagtgtgtgccctgagacaaagctactacaatggagaaatgtattaggcagtactcgctcataggtagtaatctttccattggatttggcttgaagtggtaaaaacttgtcaaacctgtattgagattttagacatttgaggattgagattatgcatctttgaaagctagattttaaaaaatggttattattgttgtcgccaggaataaggtgccctgttggttgcacgcaggctctggctgttatttgctgcctgtatcgttattactacctctgtaactattttaagacgtttttgtagttaaaattgaactgc

SEQ ID NO: 61977 - DNA, 588 bp, Triticum aestivum
  Clone ID: PAT_TA_61977
actctctcttccctcttcctcctgcggacctcccgacccaaagatctcttccgatccgccgccgcctcccctacagccgccgccgcgccgtgccttagcgccagccaccgccgacccttcagcccgctccccacccctcaccccacccccctcgtactcgcgcccatcgccgcccccggttgccctcatcgtcgcatcgggttcgcgcgctctccgcccctgctgcagtgtttgggtactgaggaatacataatggagatctggccaatggtagccctgcgtgctgccctagtaggaggtgtagctgtattcgctatgatggatgtggagatgaaagctgcaggcggcgagaaggatggtgtgatagatgtagccatgatagacgaagagacggttgccgtatcaggaaaagaggcgggtaatgataatcaaaaggctggggtataaagatgatatgtgaaatggatttgatggagaagcagagttctaaaatgcttctccatagcgtgtagagcagcattcagtggtttatcagtgacgaagaggtgtggaagctaatcgtggagttcgggaggaggctgaatttgc

SEQ ID NO: 61978 - DNA, 643 bp, Triticum aestivum
  Clone ID: PAT_TA_61978
agatagagttggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtacgtaacgcagttaccatatactcctacttcctactttggaaactgtaaaagggtggattcttggagccg

SEQ ID NO: 61979 - DNA, 440 bp, Triticum aestivum
  Clone ID: PAT_TA_61979
tctccgctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgcaactgagccggcgcccaggaggccggccggcgaggcgagcacgaggatgaggaggacaactggacaagcaaccaccaccaccaccaccaccatcactagccgctgcatgcgcccgcctgcgcgcgcgctgaataaaataaaaccgtcgtgtgttccttaactctgtacctgtacgcccgtgttttccaccagcagtgtccttgctcatgcctccaactctaatacatggcgcctcctctacgttgatgtt

SEQ ID NO: 61980 - DNA, 467 bp, Triticum aestivum
  Clone ID: PAT_TA_61980
attcacctccgcgcagtcgctccagcaaagatttcagagaccgaggcggacgaggagaggtaggtaggtaaaggtaggagacggacccgacccggccgccggcgagcatggacttcctcgcgctcccccgccgcgacctccaggcgctggccaagcgcaacggcgtccgcgccaacctgagcaacgccgccatcgccgacgccctcgccgcgctccccgcggtcgacgggatcgaggagtacgtcgagcagccggtcgttgtcgaagtggccaagccggcggttcaggcggtcgcggaggaggtgaagaagaagaagacgaagaagcaggaggcagaggagaagaagaaacaggaagcggaggagaagaagaggaagcaggaggaggaagaggagaaaaggaggcaggaggaggaagaggagaaaaggaggcaggaggaggaagaagagaaaaggaagcaggaggag

SEQ ID NO: 61981 - DNA, 567 bp, Triticum aestivum
  Clone ID: PAT_TA_61981
aatcaatcttatgacagctcgtgctccgacgtagcagagcatctccccactgatgcgagtgtagcaccatcgccgccgtctccattatcgacaactacccgggcgacaagatccgacctgctactgtccaaagaacggctctgctaccaacacctatcataactggcaagcaccatgcctctgtccacatcaacatcggcaatgccgatgccaatgaacatgtataatggtcagactcaacaaggtgtgccctctctgaatgtccctactctccagcgagaagatgaaagaaccttgtacatgctctgggagcacaagagctataacatgaaacaggaaatgatgtccctgagagagagtatgataagattgataattataaaaacaatatgaaccatatatgaagaatcagtgatgctagctaatgatttgccgatgaaagaactatgatgaaaccgtacacagcagatatcgataactggaaaccatacttggataaacattatatcatgtcgcccgtgaatggtctatgtatctacacaagaaacactacagccactgaaatat

SEQ ID NO: 61982 - DNA, 745 bp, Triticum aestivum
  unsure (1)..(745): unsure at all n locations
  Clone ID: PAT_TA_61982
ctcccctccacctcatcgccgccgcaggctttgactccatcgcctcctccctcctcctcttcgtctccggcaggccaggtagttaacagctccagcagccatgggaaaggagaagatccacatcagcattgtggtcattggccatgttgactctggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactnnggtggttttgaggctggtatctccaaggatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctngaagaaggtcggttacaaccctgacaaggttcccttcgttcccatctctgggttcgagggtgacacatgattgagaggtccaccaaacctgactggtacaagggcccca

SEQ ID NO: 61983 - DNA, 452 bp, Triticum aestivum
  Clone ID: PAT_TA_61983
cggccgctcgaggcggcgggcgggacagaggaacgagctagctagatagcatttggtacacagctacatacatatccggcacgagaggatgtcgttggtgaggttcttcgacaccctggccatggactcgtggaaccccttcggcaccatcttcggcaccacggcgtccagcggcaccgacgcctggctggccagcgacaccacggcgttcgccgacacctacatcgagacccgggagacggcggacgcctacgtcttcagcgccaggctccccgccggtgtcaccaaggaggaggtcaaggtggaggtggaggaggacggcaaggtgctggtcatcgccggcgagcggtgcctgcggagggaggccaagagagaggcgcgccaccacatcgagcgcagcgtcgccaccttcttcggtaggttccacctccccgacgacgccgtcttgggac

SEQ ID NO: 61984 - DNA, 802 bp, Triticum aestivum
  Clone ID: PAT_TA_61984
cggcggcgggttttcccatctgctgacccttgacttctataacgccatattgccctgatactcatccttgattatcttgtcactgctcgaattatacaactctactatacagcaaccatgcgagcttacttctacgatggccttccaggcgaccagcgcctcccccacaactctggaaagcccgtcagcgtcgatgatctcatgaacattggtgtttactactaccatcttcccgagctcgaacaggtcgataacctttcaaaggagcgcgaatataagaaccgtgacgagatcaccgtctctcctcaggccatgggcgacatttacgagacaaaggtcaagtctttcttcgccgagcacctacacgaggacgaggagatccgctacattcttggtggacgtggatactttgatgttcgaagcaaggacgatgactgggtgcgcgttttgctcgagaagaatgacttgcttattctccctcctggtatctaccaccgcttcaccactgacgagagcaacttcgtccatgccatgcgactgttcaaggaggaccccaagtggacaccactgaaccgcggccccgatgtcgacaagaacgagcaccgacaagaatacgtgaagcagttcattggcgagtctaccgaatcaaccacattaccggtccaactcaagagccagcaagcataaataccgctgctttgagattctgcgccgcaatggagagcccagcgttgacgtgacgaggagggccttttacgtcatttcgtgatttcaaacagcttacaactacgtacgatttgcg

SEQ ID NO: 61985 - DNA, 881 bp, Triticum aestivum
  unsure (1)..(881): unsure at all n locations
  Clone ID: PAT_TA_61985
cggccgctcaggcggcgggcgggaatctacccccgaaaaaatcattctgcgtcaacctcgatcgcgaatagtgtcactacatttgctctacaactacaattacgcttaacacacccttcaacccacgctcacgctcatcaataactgatcgggaacactcccagtcaaagcgcgcatctcaatgtctagaggaggtcgaggtggtgggcgtggtggacgcggcggcggaagaggtggatggcctaatgtgccgtgggatacaggtgatgagcctgatgcgcgaccctctgagctgtttcctccatacctcgtcccaaccccccgagaactagcctcgcacgagaaatccgccgtacaacatctcctacttctaaggcaccagatccactcctctcctctatatacatccaagcgtacagccctccacgatccgacagcgcctcggaagcactatggccaagcacagaagaatgctgtctttggtattaagagcaaggcttctgtagaccctttcaccgctgtacccacctactcccacaaattcgcccgtgaggagcgcgctcttccggattggtccaatcgcccagtttgccgcgagcttttccctagcgaactatacgaaactatcgatgctgcaaccaccaacagggccgacatgcctggtggctacaagcgccggaagctcgagctctctagcgttagtgcgctaccaagcacagaggaagctttcggtatggcaggcgatgttgaagatgagatgcagggccgaaatctcctcgaacgtctgcaagctctgaaggaaagagatggcgacnaggccggcgacctagaagacgagnagggcatggaagaagaagagcaggatgaagtttacgatgatg

SEQ ID NO: 61986 - DNA, 773 bp, Triticum aestivum
  Clone ID: PAT_TA_61986
gcccggctcgaaggccggccgggggccggggttccccttaatcacacaacacacatctcccaccttcttatactgtaaatatggccaaccctccacccattgtcctcgatggaggtaccggtttcctcaaggtcggatatgccgcgcagaacttccccgagcatcaatacccctccatcgtcggccggccgatcctgcgttcggaggagcagaccgatagcgatctcgtcatcaaggatatcatgtgcggtgacgaggccgccgccgcccgaaccatgctccagatcagctaccccatggagaacggtatcgtcaagaagtgggatgacatggagcatctttgggattacaccttttacgagaagctcaaggtcgaccctcagggccagaagatcctcttgacggagcctcccatgaacccgcttaagaaccgcgagaagatgtgcgaggttatgtttgatagatatggattcggcggtgtctacgttgcaatccaggccgttctggctctctacgcccaaggtctcagctcgggtgttgtcgtcgactctggtgacggtgtcacacacattgtccccgtctacgaatccgtggttctcaaccaccttacgaagcgattagacgttgccggccgagacgtcacacgcaacctgatcaagctgctgctgcgccgcggctacgctctcaaccgaaccgccgatttcgagaccgtccgccagatcagggagaagctatgctacgtgtcgtacgacctcgagctcgacaagcgcctg

SEQ ID NO: 61987 - DNA, 500 bp, Triticum aestivum
  Clone ID: PAT_TA_61987
agttccgcagctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatcctgg

SEQ ID NO: 61988 - DNA, 806 bp, Triticum aestivum
  Clone ID: PAT_TA_61988
acttcccccaaacctacccaagccccccggccaaccccgccgcccaccgcccaccccgcggggccacaacatccttcctcgccacaacccaccaccttcctcccgccgccacactaggctcccacaatcgccccaccttcttctaaccgccgccatggaacaccacctctgccccgatccaccttggtcctgtgcgccgccgtcggccgtggatcccgggcgacgcctcctgtctttggatcgcgacctccgccgcaggggtccccgagtgaagacgagcaagccgtgcatcccaggcaccgtctcctacctctgatcccgccggccgccaccggggtccccgactaaaggtgagcaacctcgctaccccacctcctcacggagcctcctcccttgtggggacacacccatcaccgtggcgctcaggccgttcaccacgaccagctcaggccgttccaccatagagctctcggatgttcaccgcttcagcgcccaaactccagccatccgaggatctccgccaaaactccccagctcgccgccccagcatcacctcctccgccctaaagatgtgcccaacctccctcctgctcaccgctgtgcacccggccgccggcacggactgcacccagtcgccaacacggactgctccgactactttagctccggaaagttggctccacgggctccgcctacgcgagtgttgattttggaacacttgctcaaaccaccatggagcaacgagtttgtgcaaaggccagccttaaacaagcagccaagtagcttaatcgatttcttggcttgct

SEQ ID NO: 61989 - DNA, 505 bp, Triticum aestivum
  Clone ID: PAT_TA_61989
taatgcgcgagcccgccccgtcgagtgcagctgccaccatcatcgtcatcatctatttaccaccgactgatccccggagccgtccgtccgtcagaccgaaggtcgtcgctcgcccgcgtgaagaggagggaggtcgcgcgccggtcgatggcggcagcggcggcaacctccgtgcgggggtgcggcccggcgtcggcgtcgtcggtggggctctcgccgcgtcgggcggtgcagcggtcgtccttcctgccgcccctgccgcggcgggcgtcgtcggcgcgcgcgctgcgggcggcggtcgcggacgccccgcaccgggggctggagctcctttttttgtgcggcacgaggcggggccgctggaggccgtgatcgggggcgacggcggggacgaggtggaggaggcggtcggggaggagcgggtggaggggtggatgccgcagtctatcgcggaaatcgtgcggcacgtcggggaggcgccgttcctggtgcacctgttcagcga

SEQ ID NO: 61990 - DNA, 692 bp, Triticum aestivum
  unsure (1)..(692): unsure at all n locations
  Clone ID: PAT_TA_61990
cnttccagacgccgggtaccaccccctcttcctgatgtcgaagcgagggcgcggaggttccgctggtaacaagttccggatgtcgctgggtctgccggtggcagccactgtcaactgtgctgacaacactggtgccaagaacctgtacatcatctccgtcaagggaatcaaggggcgcctcaacaggcttccttctgcctgcgttggtgacatggttatggccactgtcaagaagggaaagcctgacctcaggaagaaggtcatgccggctgtcattgtcaggcagcgcaagccatggcgccgaaaggatggtgtcttcatgtactttgaagacaatgctggagtcattgtgaacccaaagggagagatgaaaggttctgccatcactggaccgattgggaaggagtgtgccgacctgtggcccaggattgccagcgcagcgaacgccatcgtctgatctgatcgccggagcagctagatgatcaaagctttgatagcatgtccctcttttcttctagtttattacttgtggcccttgaggatgagtttcctggattatgtaacgctgctggattatggtctgttagcttaagattttgcactgtggtttggctacttaagatttggtgagtttgaacctgaaagagcttttgatcggatttatctctgntgtgtcaagtattcaccctgag

SEQ ID NO: 61991 - DNA, 743 bp, Triticum aestivum
  unsure (1)..(743): unsure at all n locations
  Clone ID: PAT_TA_61991
attcctccaagagtcattagaagttccctggacatatgtacacaacaaagcagaagagtacatcaacacaaacactaacacaacagctataacaactccaacatcttcattaccagcacagcaaacgcaaaccaatattcccgtattaaactgcaaagatccttaccgcgaacctggttatctttacatccccgccgacataaacggcaccaaccaatacaaaaagacacaatgggttcccttctccgataacctgctcgaagctgaagcgcccgattacgctgtctatcctgcggccggcgaggtcatctttaacgcgacggaaccggagcctgagtttgtcaagcactcgtccacaccgcgacaatggctacccgaggccatcgccgagagcgtccgtcgaaagaaggccatcaacgccaacgccgacaccaacgttgacgcctacgcacccatgaagaacgacggcgactttggctggctctggggtcgtcgcatcattctgttcagcgactctgtcgatcgattcatgatgcaattcttttgcagcgagttcaagcacaacatgaagcagcccaaggctcacaccatcgccagctgcagcatccccgagttcaacctgacgtttgtccactggcactttgccggttccatgacgtaccgaccggactggtggntggatggatgacatggggagagatgcctttgaggagcgctgngacaagtactggacccccatgtac

SEQ ID NO: 61992 - DNA, 755 bp, Triticum aestivum
  unsure (1)..(755): unsure at all n locations
  Clone ID: PAT_TA_61992
accttcgactaatctccctccacccacccaaccaccaatcaataccgcaaaaatggccggcggagttaccgttcgcgatgtcgatgtaggtgctccctaaagaattacacaggaaacgaaggaatcgattattcctggacaaaaaaaaacacaccccccgatctctactcgacgacttggcaacacaatttccacgagaaccgcttgccccccgcggtggcgttggctcagcgccgaaatattacatattaatactgaaaacgctgtgtcgactgctatgagctgtagggctgggtacaaatgggattgaggagcaggcgcgagggagtcgaaagacttctgacgacggaatcatgctaatgggttttgtgactgcaggcgcagaagttcatcactgcctactctgctttcttgaagcgtcagggcaagcttcccatccctggttgggtcgacaccgtcaagactggtcctgccaaggagctccctccccaggacattgactggttctacgtccgcgctgcctccatcgcccgccacgtctacctccgcaagactgtcggtgttggccgtctccgcaaggtccacggtaccgccaagaaccgcggcagccgtccctccaagcacgtcgatgcttccggctccgtcgaccgaaaggtcatgcagtctcttgaggaagatcggtgtccttgagcaggacgaaggagaaagggtggcgncgcatcacccagnncggtcagcgtgatttggaccgtatc

SEQ ID NO: 61993 - DNA, 731 bp, Triticum aestivum
  Clone ID: PAT_TA_61993
aatctcaaatgtagatcattcgagatattaaccacttcgggtgtcgttgtctggtcgcgcacatacactgccataaacccttcgatcatcaacaacttcatcgccgatacctttattgaagagaagagtggcgccattgccctcagcgactcgaggtcagcctctaccaatcctccttacaagagcgaccaacacactctcaagtggactctcgtcaaggaattgggcatcatcttcgtcgctgtctatcgatctctcctacacctctcatgggtggacaaactcgtcgacaatatcaagaccatcttcgtcaagctttacggcgagcaattaacgaagccgcacacgaccctcgtcgaatgtcatgcctttgatgaatactttgacgtacaaatcgaggagctcgaccaaactagtaccaaggtcccctccaccaccatcacagccggcgcaatcccattagaagaggaaatcatcccaagaaatatcggcgacgaacctcctgttgcgccaggtttaacataccgagggcgccacctcaatggacctcaagatgccctgtcggccgacgagtctacccccgccttgactccaaatggatcgcgacccggcacaccaagcaatcacatcctctccgcaaagggtggccctatcgcaaagatctcgcgacgtgcgcgcaaggcaaagaaccaaacatccgctcccgcctcttccggcgacgaagcgcccct

SEQ ID NO: 61994 - DNA, 721 bp, Triticum aestivum
  Clone ID: PAT_TA_61994
atatcccagagggcgaaggaaatcctctccattccaatccctcacacgaaatcgacatctccgaccctagcccgtccgatcccggcgagatgaccaacccgagggtgttcttcgacatgaccgtcggcggcgcgccggccggtcgcatcgtgatggagctgtacaaggacgcggtgccgcggacgggggataacttccgcgcgctctgcaccggggagaagggcggcggcaagagcggcaagccactgcactacgagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggacaacgcgggccccaacaccaacggctcccagttcttcatctgcaccgtcccctgcaattggctcgacggcaagcacgtggtcttcggcgagggcgtcgagggcatggacgtcgtcgagaacatcgagaaggtgggctcccgcagcgtcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttctccttgtccgtccgatgagatctccg

SEQ ID NO: 61995 - DNA, 403 bp, Triticum aestivum
  Clone ID: PAT_TA_61995
cggccgctcgagccgggccggccggggccttacattctctccgctcccatcgacgcccctgccggtctcctcccagcgccgccgccgccgccgacttccctccacaacattcttcccgccgcagcctcctccgccaagccgaggggacagggcgtgcagcagcgcaatgcggcagcggcaggagtgggtgggggactgggtccggagcaacgacacgctcgtccgcgccctccccatcctcgtcggcggagcctcactcctcgccgtcctcctcaaccgtgccgtttccggcatcgccgccgtctccgacgcctccagctcgcagtctaggtccgacataatcaccttgaccctctctgtatcttttatcctctcccccactagaacccctgtcttcctgccc

SEQ ID NO: 61996 - DNA, 592 bp, Triticum aestivum
  unsure (1)..(592): unsure at all n locations
  Clone ID: PAT_TA_61996
ngactacacacgacagcttaagtttctaagccttccagtgccggaacagagcagcatataagaatggcatccctgaaggccgtgaagccaaccggacttgacgggaaggccaaggagcctaccaaggttagtgccaccaagggacctgcaaagctcagtgccacggcgaccaagccagcagccgccaagggtggcatcaagaacgttgagtcaaagttacggcagcctaagaagagggtgtctactccaagctcgaccttcaacaacctgtcaacggcaggagcagacgagatgatggtgccggtctctcgatacggccacggccagtgtctgtatttttttttaactaagcaacgacaacaccggatacagggaaaacttcctggacctgctcgcatcgaagaacgtgacacaggagatgttcgaggacgtcccggccggccgttatgcctcagcaccagccgccctggcggcacggttcgaggcaggcaccaacgtttctccgatcaagtacgaggttgccgcctcgccgttgttcatgcggagcggttctaatgccgcgctcgaagcccaggggatgaacatgatgagc

SEQ ID NO: 61997 - DNA, 535 bp, Triticum aestivum
  Clone ID: PAT_TA_61997
gcctatcgcacctcgctgccttcttcttgttctctgtcctaccttgccatcctcgcctgataggagtataagaagggcaaggcatggcgaagacctatcctggcgccagtgccgatgcaccatcagggcgtcgagaaggccagtgagaagcttcgcgacctcatcgacgagaataattgctccccggtcatgctccgcctcgcagtgtcacatcggacggaaccttccaggtgacaccactgacatggtgctgccgtctcggccattatgtaagaagccgcggtggcaggcgcgcaccagccaacggcggatctgaacatctccgtgcggaagctcgagccaatgaaggtattgcatgctgcaccatatacgacagcgatatctaaagatagggtgagtgttctgaatgtctgattgcgcgggtatctcttcccatcatcatccgtgttactaccgtgaaattccaatttgtcttgaaagtttgatgcactaggctagctatgtattcgcctgatcctgggacccatacttgtat

SEQ ID NO: 61998 - DNA, 492 bp, Triticum aestivum
  Clone ID: PAT_TA_61998
gtctcttccccgtcccattccctccgctccccactccgcagcagttccgcaccgacgccctcgccctcaccctccccaaaggcctaaccgctcgcccgctccgccgtcatgaggtccaaggtcaacggagacaccgcgttctaggtctccggcaagaacaagacggccacctgcggtgtcgcctatacgaagtgagcccccacccacttcttcgtctttatggctgagctcaggctacagaacatggacaagcaccccgaggcaccgggcgacgagagcgtcaccaaggcggctggggataactggtgaattatgtctcctgaggataccggtaagtatgtggacatgaaggtcgatgctctgagcatagaatagaggtgaataatgaagccagcactatgttactgaatgtctagagtgacgtcgatcaaaaaggatgtgactactaagaaagagctatcgattatgtctccgcaatagaaaatgaaagaa

SEQ ID NO: 61999 - DNA, 756 bp, Triticum aestivum
  unsure (1)..(756): unsure at all n locations
  Clone ID: PAT_TA_61999
atcgtaacctcttctttgtcgttgtcactcgttactgagtggcatacatatatacagtcgcttcaatgatgcccccagctgatgagatcccggctgtgtccagaaacttcttcttaccgcccgccatcggggctaccagtacccttgatgcgaaaaagatccagacgacaaagctcttgcaagatgcgcacatgttacaacagctcgaacagtcttaccacatagaccaattcctcaacaacccgtcgccaattgatgagacaaccatcacttttgcggacaacatcacccaggcgctaggcgacgcgctacgatccacaccttatgagtacccttcgtcggatgctcccacattcaagagaccgcaccgtcgacccaagcgactatcgcgacacaacactgccttctgtaggaggaagctcggtgtctcgcaagtcgaagcgctgctacctatgtggcacgactgatacaccgcgctggcaagaggctgggcttggaagtcgtctgttctgcaatgtttgcggactgttgcactccaagaaattaaccatgcgcaagcatcttgctcagtccagtcgcggggataccatgtcgaccaccgacagcgcttggtcgtgactatctattaattgttgcccgatgtcgctgtttatttaatgtnatataagccggagtttgggtctttttttttggtctatcgcactgggtttagagtatatagagggttgcgatatcgaattaatacagcaattaatt

SEQ ID NO: 62000 - DNA, 587 bp, Triticum aestivum
  Clone ID: PAT_TA_62000
gctctatcgatcccctcgctggtcgccgcggccgaaacaaaaaaaacacccgctcaatcgatcccctcgctggtcgccgcggccgtcgatttcccgggcgagggtgcttagatccggcgacttggtaattgtggcgccaacttctagatcctgtcggagtcgtcgctgcctggggtttccgtgcccaactgtcgacgagccggccgccggcccccattgccgcggcgacgagccgacggccgcccaccattgctgtgcgtacgagccagccaccgcccgcaatttcttcagcagtcactccccgttgttccccgactcaacgccggccggcagctagattcaagtggtgccattaaaaaacaatttccagtggttcggtgtgttcctcgtattggacctctgaacctatggatagactttggatttgtggcacactattctctcgggagtacatcgatggtgtcaaagagtttatgaacttcactcaagcaaaattcagcgaggatgaagaaatactctgcccatgtagacaatgccttaatcacaaatactggcatcaggccattgtgaacaagcacatattgacg

SEQ ID NO: 62001 - DNA, 816 bp, Triticum aestivum
  unsure (1)..(816): unsure at all n locations
  Clone ID: PAT_TA_62001
atctctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcggngccctccagttatcgatctatctaccatctcgtcgtcttcgtcagcaagttatcttcagttcctgtgtcagtcagtctgagtcgtcgtgtgtgtcgttgagtcctgtggtgtttttgatcgcgagctcgagtgtcgctctgtccggggttaattagagctg

SEQ ID NO: 62002 - DNA, 747 bp, Triticum aestivum
  Clone ID: PAT_TA_62002
aaaaaaaatccggacccatccgaaagcacctgcccatcagccttccttctcctagctttgtctcggttgtcttctggtcttgcgctctgctcttggactaatggcccatgggaagaggtctaggcagcaggccgagtcgacctcggtcagcctgctggacctggacagcggcgacatggcgcgcatcctgctgctcttctccggccaccaccagcaccacgcccactacgggccttcgtcgcccgagagggtgttcgagtgcaagacctgcagccggcggttcccgaccttccaggcgctcggcgggcaccgtgctagccacaagaagccgcgcctggcggacggcgccggcgctgagccgcccaagcccaaggtgcacggctgctccatctgcgggctcgagttcgccgtcggccaggcgctcggcggccacatgcgccgccaccgcgccgtcgcggcggcagggcccggcgtcgggcttggcctcagcctcggcctcgggccgaacgaggacggcaacaagaaggcggcggcggcggccgagctggcgctcgacctgaacgagccggcactggaggaggagccggccgatcgcgccatgcttgggctcgccgtgggattccccgtggtgggtgactttcgacgttaggttgaacagaagaaatttgcgcctgaaccatacaaaattttgtactagttcaatacgtatttcgcactgacctgctgcacaagcccaccgacccttgg

SEQ ID NO: 62003 - DNA, 748 bp, Triticum aestivum
  unsure (1)..(748): unsure at all n locations
  Clone ID: PAT_TA_62003
gggtttccccccaatcttttgccctgccgtgccgcgccgccgcgcgcagtgccattctcaaccaacacacgaggtggcaggcggccacgagcggcaaatcagccagcccaccaccacgttccgtgctcagctctcctctacgccgcgccgtgctggagcagcggccccgcgggagtcacgggcgcgccgaggggcgacggcgtgcacgggctcctctgccgcggggtcgccccgagcctgggcgggccggcgccggcgcgcggggacaggctaacctgctccagcgatcggaactgcagctccggcgggtagtcgcgcacgcacccgatccgcgggccggcgccggtcgtccaccggagcgacagctgctgcccgagctggtacgacttgtgcgccatcttggagttgatccggtgcatgatcatctcctgcggcaccgccggcacctcggccccctccccgccctccgcgccgcgccccgtgaacaggttcgccttgcagaagtccagccggtcgccgaacgagccggcgtccggctccgccgcgtccttgcccagacggttcttgctcaccgtcagcctcggcggccgcttgcgctgcagccgggtgcccgacgaggaccgcttcatccccggcgagccggcgactgcctcgccngctggtggaaggtggcgccgccggcacggccggtttgatcttctttttgtcaccgcgagggggttgggccctggtgtctccttgcttcccc

SEQ ID NO: 62004 - DNA, 590 bp, Triticum aestivum
  Clone ID: PAT_TA_62004
acccctcggtcgagctactctcccccacgatctcctcgccgccgctgcccacgccggcacgctcgtcgccgctgcaaccgcccacgccggcacgctcgtcgtcgtcgccgtcgtatcgggatctacctcctcatcggcttcctctcccccatggtcgaccccgagctcgacccctccgccgcccacgacgggcacgccctccccaaccgcggatcttgcgagttcaagcacttcatcaggaggctcccggagttcaagttctggggtcatcgacatggactactgcggcctagtgggcatcatgctattcaaccactcggaggcggacttcgtcgtgaagcccggcgaccgcgccgaacatatgatcgtccaggtcattgcgacgccggaggtcgccgaggtgaaggacctcgacgccatcgtctggcgggagggagtgctctgagccttggtagatacatctagagaagtggtctagttgtttgcgtctgatgttaaattggatctcgagatctcgagttaagatgttcaatgctgtatccatgaatgctgcaagtgctaagatggttctgtgaacttagtttatttgc

SEQ ID NO: 62005 - DNA, 775 bp, Triticum aestivum
  Clone ID: PAT_TA_62005
aatttccccttcgaacagccaccaattgagtgtcgcgacaacaccacaagaatcctcaaaagacttcaaaatggcctcaattgcgcgttcctctctgcttaggcagaccgctatggcttctcgattggccactgctgctatcccagcgacccggagcacttccatgcctagcatccgaactcagcttaagggcgttgctgctttccacaacacgacccgacgatctgctattctccctcccggacctcagcgcattgagggtggaatcaacgaacctgctcccgttcccgagcccagctccacccacggttcttaccactggactttcgagcgtttcctcgctgccggcctcgtccccttgaccgtcgctccctttgctgctggctctctcaaccctaccctcgacgccatcctctgcagtgtcctcctcctccactcccatatgggcttccagcaggtcgtcatcgactacatcccctcaaggacctaccccggtctccgcaagactttcaactggcttctcaacattgctacggttcttgtcggcgtgggactgtacgagttcgagaccaacgacgttggtatcaccgaggctgtccgacgagtctggaaggcgtaagttggtagatggctaattgatgtatgtatatgaagggagcatattattggcagttttacttgccgcgcaggtttatgactgcgggcatctgtatagaaaatttcctttgagttacagaagattgcgtcaatttcaaacaagacgattccctttttc

SEQ ID NO: 62006 - DNA, 783 bp, Triticum aestivum
  unsure (1)..(783): unsure at all n locations
  Clone ID: PAT_TA_62006
agactccagcgacccaatccccatccccatccccatcccgacctcccggcgccgactgtccgccgctccgctccccttccaaggagcgccgcgggctactctgctgcatctccttccacgagcaagcacgcgtcgacctgggcggccgccgctcctgctaccgctcccagcatccctccattccgacggccgtggccgctccggaggagctggactgccggggccgccgatcgcgactggtgtgatatggtggtcatggcaatgcatcctcaggctgctttactcctcaccctcatcctcctcctcctggctaccggagatggcagcctcgccgtcggcactccgtcggcgatcatcagaacgacatgcgccactgtcgaccgagccggcggggaagtgggttacgacacctgtgtgggcttgctctcggccgacccggcggccgcggccgccaaggacgcacgccagctcgccgtcgtcgccaccaacctcaccgtggccaacgtcacatcaacggtgctcgtcctcaaggacctcgtcaagaacctcggggactgcctccgctactacagggacatgaacaagaccctggaggccgcgctcggtgacctccgtgctgngcgcgtccaagcggcgtcggacaaactgttggatgcctcccacctgcccgacgactgcgacatcctcttgttccaggggagcgcgnggaaagacccgatgagcaaggagacaccgacgccgatttgctgtcccgactggcatacgccattactgacttgcagc

SEQ ID NO: 62007 - DNA, 531 bp, Triticum aestivum
  Clone ID: PAT_TA_62007
acatacaccaagtctgtctacctgcccaacctcgccataaagtgtttgttttgggcaatcaccttggcttgattacctgcatttcttccttcttgcaaggtatatgtagcgacttgactttttacttttggaaagctctctgcagctcgagtgacaccagccataccttgttttgcactcggacacgccgtcggtctccaaaaacgtcatcttttgtttgtttgtttctcctttctgcccaaggtagagagatatagagactcgactcgactcggccgagtctatttcagacccaacaatcttcatctcgcatcatcgcgatttgcagccgctcaggccgcttccatcatcgcaacgcattgattgttcgactttctaggcactgcaccgtgacattggcatgcccggcattcccagtttcttcacttgtccagctacttcgagaacagtgatagggacattttgcgtctgatcgcattcttgcacccgagtcttctccattgcttctttttttatttattcattttacgg

SEQ ID NO: 62008 - DNA, 486 bp, Triticum aestivum
  Clone ID: PAT_TA_62008
cgtgtcaggctcctcttttctgctgcttccatgcaacggtggtagcggtggtgctgtttggcattggctacaaaaaacacccacggttttcaagggggtttcgtttatgatagccatggagcaggaaaaccggcatgctactaaagctaagatggttatgagaagatatgctgctggaaagatgctcttagcaaactggaagggctgcaaccaaatccaatcgacaacatggcagtggtctctgaatatctaagctagtgatcatctttttagcgattccttttctgtttggccttctcataggtagtgtacattagttgtttgttggagttgtgatggcagtatatcttttttgttgcttcgctgtcgtttgatatagatggcattcttttagttgctgctgcttatgtatagataatctgatgaagatgtaactgtaagagatgatatatgattgtacggcgaaacaaatattgctttgatagc

SEQ ID NO: 62009 - DNA, 699 bp, Triticum aestivum
  Clone ID: PAT_TA_62009
agagcgtagcagtcagcgtgtgagagagagagagatggcagcaggaacggcttgggcggggtgccatctcgcccgcctcccccacattcccatctcggtcagcatccccgtggccggcgctggcgctagcagcaggaggaggcggcccgggttagcggcggcggcgggggcagcagcagcagcagcgacagacgggcgggtgctgggccggcgccccgtggaggacgtgtacaaggtgcgcgtggtgcgcggcgcggcggcgcaggagcgggtggaggcgctgcgggcgatggagacgtggtcgacgtggcgcacgggcggccgctgccgcctggcctgggactggcaggtggaccagctcgtgtacatcgtcgccggcgaggtccgcgtgctccccgcgggtgccaccaccggcgaggagtacatgcacttcgtcgccggcgagctggtccggtaccccaagtggccggaggcggacctccacttcgacgggccctacgaggagcgctaccgcttcctcgcctacggcgacgacaactgaaccgctcctcctggacgaatcctgcctgtatcgtcagtagcctagctagctccttagtcctactagttcactgaagctttcgttcgagttcctgcctggatgatttccttttgtttaccatatactcctagcctgggacaacaaggagtacgtatttc

SEQ ID NO: 62010 - DNA, 239 bp, Triticum aestivum
  Clone ID: PAT_TA_62010
tcagcgggactacccgctgagtttaagatataaataagcggaggagaagaaacttacaaggattcccctagtaacggcgagcgatccggccgtagcccacgtcggcaggcggtgctcgccctgaacacctacctcagacagtaccgcgttggagatatggtctccattaaggcgaacggggccgtccacaagggaatgcccttcaaggtctaccacggaaagactggagtaatctacaa

SEQ ID NO: 62011 - DNA, 702 bp, Triticum aestivum
  Clone ID: PAT_TA_62011
agcagcaagctaagctaggcagcatcgagaagctagtgagctcactcactcaatcgcgctcgccatggccgcgtccaccgccgtcagctgtctctgcctcctcctcgtcgccgccgtgaccttctccgtcgcggccgcggcgccggcgccggcaccacccccgccgttccggacggtgtacgcgttcggggactcgttcacggacacgggcaacacgcactccacgacggggccctactcgtacggctacgtctccaacccgccctacggcgccaccttcttccaccgctccaccaaccgctactccgacggccgcctcgtcgtcgacttcctcgccaccgacgcgctggcgctgccctccttcctcccgccctacctctccctcgccgcccccaacgccagcagcaagagtagcaagtactacggcgccaacttcgcggtggccggcgcgacggccatcgagcacgacttcttcgccaagaacaacctgagcatcgacatcacgccgcagtccatcatgacggagctggggtggttcgacgcgcacctcaagacgcgccaagccaagaaggaggagatcggcgaggcgctctactgggtgggcgagatcggcgccaacgactacgcctacagcttcatgggcgccgactccatcccgccggagcgcatccggaacatggtcgtagacaggttcaccacctt

SEQ ID NO: 62012 - DNA, 526 bp, Triticum aestivum
  Clone ID: PAT_TA_62012
cccctttctcctccctgcaaccgctgttcggaaaagcgtattccccttccaccttttcctcccaggcgacgcgaatggagaagggctccggcgccgccgcaggaagcagcgcgcggccgccgccgatgccgcagtttgacgagttcccgttcgaggggaagaagcccgtcaagaaccccttcgtccccatcggtgcattggtcactgcgggcgtcctgacagctggcctggtcagcttccggtacgggaattctcggctgggtcagaagctgatgagggcccgtgtggttgctcaaggcgttacggttgctctgatggtcggcagcgcatactactatggtgaccaaatcaagttgttcaagaaagggtctagcccatgaacttgactggatagtggttgtggtgtacggaatggcatatcttatgtactgaagtttcacctggggctctgctgttcgattgcctcctggtcctggggattaactattgtcattcacgcttggctaactagaagtaattttggcgc

SEQ ID NO: 62013 - DNA, 540 bp, Triticum aestivum
  Clone ID: PAT_TA_62013
actactccattcacgcctcgtcgctgtccacgcggtcgcttgccatgctgctccggccagatcacggcctccgcgcgccgccagcgaccgcggccgcccctgcccgcgcctccgtctccgtctccacggcggcgctccccgccgtctcccgcctccctcgcggcgcgctcaggctcccccgcgcggcttctacgctcaggggcaaaacgtcgagcgccctgcgcgcgtcggccggcccggcggagccggcgggcatgccgtccgtggcgcaccgggaggtggcgcgggccgtggcgggagaggcggaggcgcggctgggcgcccggctgctgccctcggccgtgcccgccgacgtcgccgagttccgcaacggcgacgggaccgccctcggctccctggacgtgcgccacggcgcgcccggctcctcgatcgatttcatgctgcagtcgtcgcttcactgcaaagtccccaatggtgcgatcgacatcacgtctctcttcatcaacctgaacgccttgatggacgcgccgcatttcgtca

SEQ ID NO: 62014 - DNA, 732 bp, Triticum aestivum
  unsure (1)..(732): unsure at all n locations
  Clone ID: PAT_TA_62014
attctaccntttggccaaagaaagagctcatctctccccagacacacacgcttctccgtctccaaaaccctctctgcacgggcacgccatggacaatcctccagccggcaacgcggccaatcctctggcagcggcggcggtggccaatcctcctccggcggcggcggcggcagcaccagcagcagcaaacaacgtgctcgatcatctggcggcggcggaggcagcagcagcaaacaacgtggccaattttctggcgcagcaagcagcagcggctgcagcggcggcggcagcggcggatgctgctgtagcggctgccgctgcagcgcaggagcggcgccgcaaggaagacaaggattgtgcgtgcttgtgctgtgtgtacatcttgggcgtgctgctcttctttgcagtgatgattctgctgacatcgaagccatggaatcgaggctagagagcacgaacgtgccgtacgtgatgatatctggagcatcgacttccttggaactaattaatgacttaccaggtggttttctctagtagtagtactaccattgtgtccgagatcaggtaatctgttggtgggaaagaagaactagtaccgtctagagtggtgggtagatttgatcatgtaaaaagccgagtaagatttcagtttatgtgacgcctagtactgcagtctttgagnttgagggtgtgcaaaacttgagtgagatatatattagcgcaacttcaccg

SEQ ID NO: 62015 - DNA, 486 bp, Triticum aestivum
  Clone ID: PAT_TA_62015
aaatccatggattgttttgcttatctgcgttctctctttagcacgcatcacacggacctcaaagcacctcacagaaggacgctggaatcaacagtttctaggctgaggtgaggcacatcgagcgccctgttgcaccagaggagtctcgaggggtgcgagatagtatacagcctatgaagtgatatttggtgtactcaaggatggttccagcagtcacagtgaacagttataagaaacaactactatagagggtttgagaccaaagagtagacaaaggatgattgctccaagttcgccagtaaagagaagcacaatcgtggagtaggcaagggttgaagaacttcataatcttcagccaattcatcaccattgttgtttgcagttatattgtgagtgtatataacatgcaacagagcatcaattagagtggtagcctgtaagctcaccacattggtgtgcaagataacgacatagtgccatatgtgt

SEQ ID NO: 62016 - DNA, 718 bp, Triticum aestivum
  unsure (1)..(718): unsure at all n locations
  Clone ID: PAT_TA_62016
cggccgctcaggcggcgggcgggacctaaccgagcaccataccagcagcagcgcactcgagtaccttctaggctctccgccgctgaccgccgccggctgcgcgacgggccgtcgcccgcgcctcccaccacagcacgccggtgagccccgcctcgcgttgcctctctttcggttgctctcctatctcatctctctctctgcctctccttgcagcaatggaggccgagcgcccatggcgtcacccgaggacaccttcgagccgccgttctccttcaaattcgtcgggatccagcctgatccggacggatccggatgccggcggcccattcccgacctccctgcctcgcctggtttgtcggccactccgatgttgtcatctttgtcacgggatccagcgctaccgatggctggcctcctcctcgcctggatgtgaccccccacgctgtcgcctccaatccaagcagcggcagcgaacacctcgacaagggcagtttgccagatcagtggccagagaaaagccatggcgatgaagtctgattgatgatccgcgagcgctcggcggcgcttgatgtggtggatgcagaatagtatagctccgggtagagtactaggccagatctggaaaaaaatctgtacttccattttttgttgtgtatttcttccttttttgataaagaagttatgtatatggnatatatatatatatatgcnaactcct

SEQ ID NO: 62017 - DNA, 825 bp, Triticum aestivum
  Clone ID: PAT_TA_62017
accctcgctccaccaagctcctccaaccccccatcccaacaccacaaattccacaatgttcgcctcccgccgagcattcttcgccgcccgaagacaggcccctctcatctccaaccgctcaattgtccccgctctacgatcctactccgtcgacgcagacatcacccagcaaaacccttccgaggacatcacagaagggaaccaggaagatgccgccgcaaagccaaagtacgcacgcaccaccgctgccaaaccctcgactgccacaaagccagctcccgtgagagcttccaccgccgcaaagccagctacccccgctgctaccagggcagcaacgacgtcgagttttcctcccaaatccggtagcaagcttgcgaacccccacacgcctgtttccgtgtccaagagcacgttgagcgagtccagcgagacggatgtcgagagcacgcacgatattaattgggagacgagctggtttggtctcggagtcaagcctgttacccttgagcagaacgaggttctgtcgagacccattgatgtggaggatgtcgaggttaagcctgatggaatcgtctatctgcccgaagtcaagtaccgaagacgcttgaatgaggcttttggacctatgggatggggtatggttcatcgtggggatgtcgtcgtgggacagaacattgtcacgcgagagtacgctctgattgtcaacggccgcatcgtctctcaatctcaaggtgtaaacaactttttcagcccccgaggtgtccccgccgctatcgagggtgccaagtccaacgctctgatgcgttgctgcaaggatctcggtat

SEQ ID NO: 62018 - DNA, 712 bp, Triticum aestivum
  unsure (1)..(712): unsure at all n locations
  Clone ID: PAT_TA_62018
ccggccgggnnccgggaaggtatancggttcatcaacaacaccgcaaccatggattttcttcagcgcctcgcgcgcttcctcgatcgcccgctcttcccatggaagaagctcatcatgggcttctcagtcggccaatacctcttcgaatcgttcctcaccctccgtcaataccgtgtcctccagaaaaccagtccccccgccgtcctctccaaggaagtctcccaggaagtctttgacaagtcgcaggcctatggccgcgccaaggcaaagttcgaaatcatcaatggtctctactctcaggttcaaaacatcgccttcatgcacttcgacgtcctccccaagctttggtcctggaccggtgatcttcttctcaaatgggcacctgcgcgcttcaccggcgaaatcagccataccattgtcttcgtcttaacatttaccgtcatcagccagcttcttcgtctcccctcttcgatctaccagacatttgtgctcgaggagaagttcggtttcaacaagcagacgcccaagctctttatcactgatatggtcaagacccaggccctcaccttggtcctcgcacctcctttcctcgctggtttcctcaagatcatccagaagactggcaaccagtttttctactacctgtggctcttcttcattgctctccaggtcttcatgatcaccatctaccccgtcgctatcctgcctctg

SEQ ID NO: 62019 - DNA, 575 bp, Triticum aestivum
  Clone ID: PAT_TA_62019
gccctcccgtccgtccgtcgcccccatcccctctcggcgattctcctagggttagcgccaccgccgcccgcctccgccgtcgccccgtctccttctcctccgccccacctgcccgtcccgccgctcgagccgtgccacgggggctgctcgccggccgcctccgccccggccccctcgtcgaccgcggtcgccccgtgaagtgccgccctcgcccgccagtcgcagccaagctgccccctccccctctccggccctgccccgcacgcactgctctgatttcagatggttgatccctcaaattctgaaatgcttacccaagggaggagagttgcctttttttttgaacacatgcctgcacattatgcatttgggccacatgaggatgatgcgattatcaaacatcggcttctgactaggatcccaactaccaggggtgaaccacccctaaagaagctccaaaagaagttcatgtccttcgccaccgaggtagacaaggatgcagacaatacaagtgactgtgagaggctgcacaaggccttttctgctagacattaacacttttggacgctgcctcc

SEQ ID NO: 62020 - DNA, 594 bp, Triticum aestivum
  Clone ID: PAT_TA_62020
acaatcaagcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaatg

SEQ ID NO: 62021 - DNA, 817 bp, Triticum aestivum
  Clone ID: PAT_TA_62021
gacatttcgggattttcccccgctcagttagggtttcagcctcccagcgtgccacgatgcgagatccaccacgccgccgtcacgctgctcgcctccggcgaacgtagctagcaggtcccgagataggcgccctgtggatccccctctcctcttccatgggacctcaaccagcagctcccatcgccatcacgactcccccgcatcgccatcgccatcacgactcctctgcagctcccatcgccgacgaccggagctgctccccatcgccataccttgctgcagcagcacaagagttgcggccctcttcctctaccagcatcggagctgcgccaatcttcctctcacggcatcggagccccgcatcttttctccatcgccgacgacaggtgttgcttgccgccgccacccttccgccagcagcagtacggcggctccatcctctacctcctactccgacgaacggcagcagctaacacgccatcccttctccagctgtcctacatcttgggtgatcacaacaaggtgatcaggtccggagaaggactacaaggtgatcacaatagccatggagagcaagatggatgggaggctagataccaagttgcagatggcagcattcagttagtactgtgtgttgttggctagcagcctactgccttattttggttgtgacttgtgaccacttatgagagaataagagagctaagaactatcttattttggttgattgggtgtttggctgtttggctagcaagtagtaactagtgtaagactaagaagttgaagtagatgtgtagaagtagaactaagcttattt

SEQ ID NO: 62022 - DNA, 819 bp, Triticum aestivum
  Clone ID: PAT_TA_62022
acgtctgccaccaccaccaccaccagcgcaccatcgtcctcacacttgcctctcatcctccctgccgtgccgagaccgcagcggtcagcaggcggcgcggacgcttctccttggcaaggcgagcgacaggcatgggcttcccggtcggctactccgagctgctgctccccaagcagctgctccacctcctcctcctgctcggctacctccgccgcttcctcctctgggccttcgacgccgtcggcctcggcgacctgctggatctcggggacgagcacctggcgcaggagcacgcgcgcgccgaccacgccgccgcggcgcaccacgcgctgctgctgcagcaccgccggcccgagttccggcccgtgacggccatggtcatcgaggaggtgctccccgtggtgcggttcgacgagctggaggccgcggcgtgcgtcgacggggactgcgccgtgtgcctcagcggcatcggcggcggcgacgaggtgcggcggctcagcaactgccgccacgccttccaccgggggtgcctggaccgctggatggagcacgaccagcgcacctgcccgctctgccgcgccctgctcatccccgacgagatggccggcgctctctgggccaccgccgccggcgtgcccgacgcctccgacttcgacttcttctacctgggcgcctcggcgccagccaccccgacgctgctgcggccgcacgagctgctgctcaccggcctcggcggctaccagtgagcgaggccccccgatcggtcccaggcaagatggtccgccgccgtccagaatgcgcaatttacagggactgaat

SEQ ID NO: 62023 - DNA, 838 bp, Triticum aestivum
  unsure (1)..(838): unsure at all n locations
  Clone ID: PAT_TA_62023
aaataaagctccattcgtcttgcatcatctgaatctttcgcacttcctcttatctcttgtttttttccctccttcacgacaaacgtcttttcacgatactcaagatacccccaagaaccttccttcacaatgtctgacactgtctaccccgaagtcctctgggctcagagatcttccgaatctgatgtttccaagaacttcatctacctcaccatctccgtccctgatgtgtccaaggacaacattagcctcgaccttcagcctaccaagctcaacttcactggtacctcatccactctcaagaagaagtaccatgtcgagcttgagctctggggcgagatcgaccccgcagagagcaagatcaaccacacttccaagaacgttgaaataaagctacagaagaaggagctcaaggaagagtactggcccagactactcaaggactccaagcgcgtccacttcctcaagacagacttcgacaagtgggtcgatgaggatgagcagaacgaggcccctgaggacgacttctctcagttcggcggcatgggtggtggcatgcctgatatgngtggcatgggcggcggcatgggtggtatgggcggcatgggtggtgactttggcggcatcgacttctccaagctgngaggcggtgctggcttcccggcgctgagggtgagatggacgnagacgagggtgacgacgacatgcccgcgctcgagggcgacgacnagaaggacgccgcccccgctgctgccgctactgagaaagaagattaattcagcaaatctgggtgtttgacgttgccaaggcgagcatttctgaactacagcacaggatc

SEQ ID NO: 62024 - DNA, 835 bp, Triticum aestivum
  unsure (1)..(835): unsure at all n locations
  Clone ID: PAT_TA_62024
aactcgtcgcctcctccccttccagatcgccgccgccacctccttccccaccccctcctcgcactcgcagcggctcccaccctccccgcacccgcgcacggcgccgttggctcctccacctccaggcgacgccgagcccgcggtctccttccccaagatcgcgccggagcccgcggtcctcctccacctatagctcgtctcctctccggtcgcgccgccgacctgttcgtggccgagcttcggcgagctgagcagcagagctctgacggctcctcttctccccttgcagccgcctgccgcgccaacctccctccctccctcctcgccaatgaaaccctagccagcagccatggctagggtttgtgcagtttctccccatccgatctggtagaccgcgccggcaagcgaccaggacgacgcccgaagaggagagtagggccttctcctcaccgtgtagccaccgaccttgtcctgctcgaggaagaggagcaggaggggcgcacccagccaccacagtcgccgccgtcaagggcttcttccacctagacctgtaaatccacggcgccgtcgtccagccacccaaggcgctgccggattagaactatacggcttagcgggtggccctattttgccatcgggacaggagctctcatcactgacccctcttctccactacacgtgttcaacagaaattgttttagtttgtcatacataattgactatgcttatgttggntgttattgagtgtataattcattatattaantatttggtttgaagnataactgaaacttcatatatgtatttacattcatggaaagcatataatcaatat

SEQ ID NO: 62025 - DNA, 875 bp, Triticum aestivum
  unsure (1)..(875): unsure at all n locations
  Clone ID: PAT_TA_62025
gtctcacttcctcctccctctcgattccgatcggaatcgcaactagctccgccgcttgattagccggcagccccgtccccatggcgtccaagcggatcctcaaggagctcaaggacctgcagagggatccccccacctcctgcagcgccggccctgtggcggaagatatgttccactggcaagcgacgatcatgggtccatcggaaagcccatatgctggtggtgtatttttggttactattcacttccccccagactacccattcaagccacccaaggtatgcagtcgagtgtatgcaacgatctgaaattattcctaggatgatacaggagtgctgccttttcaactctctagctttttgaggtttcccaaagccctgttataagaaacttccttgccaacgtcttgcattaattctcatcaaatttttgattcaagcttaaatactactgccagcctatcagacaaaactgtaaagttgtctagcccagagtcaggggaatggttcatctattagcatatcccttctatgtttgtgtgtcgatcactggacctgtatatcaaacgctagtattatcacaactcctgtcctttgcgtgtacagtggatgattcttgcatgatgcatgctctagtaaagttgtgatgatcaaattgtgcttattgaaaaaatgctctagtatgataattgagatgcatgttacataacaatgattacttccatngtggtggaaaggttgactaggagagggtttcatggttatttttctggtccatgctagtacttgtangataaatatttgtgctatagcaatgatctaagtagttgcaactgctttgccaaatgtctttttacatttcagtaaatctgaaat

SEQ ID NO: 62026 - DNA, 608 bp, Triticum aestivum
  unsure (1)..(608): unsure at all n locations
  Clone ID: PAT_TA_62026
attatgacctactaaaccctcctagctcactctcgccagcactagctagctagcttagccggcagcaatggcgtccaggacctcggcggcgtgcctgctggcgctgctggtggccagcacgttcctggccggcgacgcgtgcaacagctgcaagcaccacacccctcccccggcgtccccgtccccgcccccgccagcgcctgctaccccgacgccatgcccgccaccgccgtcatcgggcggcacggggtactgccccacggacacactgaagctgggcgcctgcgccaacgtgctgggcctagtgagcgcgggcgtcggcaccgcccccagcgttgttggcgacaaccgctgcagcctcctcggcggnctggccgaccttgaggccgccgtgtgcctctgcaccgcgctcaaggccaacgtcctcggcatcgtcctcaacatccccatcaagctcagcctcctcctcaactactgcggcaagaccgcccccaagggcttccagtgcgcttaattcatcagcaaatcgtccatcactcaccgcatgcatgcatcgtcagggcatccgccattttacccgtctccttccacatttgatttcatcatgc

SEQ ID NO: 62027 - DNA, 784 bp, Triticum aestivum
  unsure (1)..(784): unsure at all n locations
  Clone ID: PAT_TA_62027
gtgatacccctccccattgattcttcttccgctcacagcaagaagaagaaagtcaagactcagacatctactatgtctgctgttaacaggaccctgcgaacggccaccaagcagctgcgcttccaatctccccggggtcttcgtgtcgctgcccctcttgtggcccgctcagctctagctgctcgctcttcgcttcccgcttcgcacggagctgccttttcaacatctgctaccaaattctctggagctcccgacatgtcttccgcacctcgtgaatacgatcctgagatcaaggacattgccgactatgtcgccaacaagaccattgactctgagcttgctttcgacactgctcgatggattcttctcgacactctcggctgcggcctcgagggattgaggttcaaggagtgctctaagctccttggacccatcgtcncccggcaccgttgtccccaacggtcccaaggtccctggtactcccttccagcttgaccccgtcaacgccgccttcaacattggtgccatgatccgatggctcgacttcaacgactgctggctcgctgctgagtggggtcacccctctgacaacctcggtgccatcctcgctgtcgccgactggatcaaccgtaccaacaaggccggcggcaacctcgctggcggcaaaacctttggtcgtcaaggatgttctcgaggncatgatcaaggcccacgagattcaaggctgcttggctcttctcactcctacnacaaggtcggtctttgaccacgttgtcctcgtcaa

SEQ ID NO: 62028 - DNA, 753 bp, Triticum aestivum
  unsure (1)..(753): unsure at all n locations
  Clone ID: PAT_TA_62028
nnggccgggaaaatacaaaaaaaaaaaaaaaaaaaaaacgcgtcgtcggcgcctctactccgcacgcagcccctccgcctctccctctcgcatcatcaccgcctttccatgttcccatacgccgtcgcctctccctcttcaagatttcatttttactccggcgactggatctgaagcgcagctgctccaccttcctcagggtagcggggatctccggctcgctgcgcaggggaagggcccgaccgtcggcggccgctgcgggcagaaggggaactgggacgacggcggcggcggcgtcccagggacagggcacggcggcacgcactgtgggcccacgcacaggcacactgtgcgccgccgtccgccagcgcgccgttgttcgacaggagcagccacagccacgcggccacgacgagcaggaccgccggtgacgggttcgtgcagtcccgtgaggaccgcgccgtgtgggatgccgagatgatgttgccggagaaggagtctccgactacctcacgctcgccgctggcctgcacatcaggatcaggtaacccgcccgccgctggcctgcacatcactgaataaacttctgtaaatttcagagatgatgcatgaagtttttgtactctgaaagcttaggactacactgggataagtttctgtaaatttgtgagtactactggcttgtagggggtgtactctgaaaagataggagtagatgatgcatgcatctgcttatngataatttcagtaacc

SEQ ID NO: 62029 - DNA, 645 bp, Triticum aestivum
  Clone ID: PAT_TA_62029
ccgtgcaccacacaccgcgcttccactccccgtcccccacgccgcccccgcactcaagcacgagcacccgccatggcgcgccccacccacgccgtcgtggctctcctggccgtcgtcctcgcgctggcgtccggcgcggcgtcgcaggcgccggcggcggggccggcggcgccggcgggggactgcggctccgcgctgacgggcctcaccggctgcctcccctacatctcgccaggggccgcgcagggcaagccgcccaaggagtgctgcgccggcgtcaaggccgcgctcgccagccccgccagcgtcgcctgcctctgcgacgccttcggctaggtctacggcatccccatgaacctcacccgcgccaagggcctccccgccgcatgcggcggcaacccggccgccctcagcaactgcaggctgaaactgcccggcggagcccctaacggcgcccctactgaagcacctacaccaacttccggatcaacaccggcaaccgtcagcccaagcccagagaaatcggcagcgaccaggtctcctgtcacggcggcaaccctcctcctagccgcggtgttggcgcctctgctttcttactactacctctaaagatccaccacatgattagctccatgaactactgcg

SEQ ID NO: 62030 - DNA, 862 bp, Triticum aestivum
  Clone ID: PAT_TA_62030
atcttcctcaacttcaccaaccaccgaaatcgactctcgtcgccctgcgcatcaaaaataattttgcccccagtactaccgctcttttcacatcacaatctgcaaccatggctgccatgtttagccaaaaccccttgatgaatgggcccaactactcattctccgaagctcccaagaccaaccatggagagtttcgtgagcatcgattcaacccatacaccgacaatggtggctcaactctggccatcgctggcgccgatttcaccatcatggccggtgacactcgccacaccagtggttacagcatcaactctcgcatgtcccccaaggtgttccgaattggcggcacgaccgcatcccaagaggacgccacactagtcctatcagttgttggctttgccgccgacggcgaagccctccgcgatcacctcgacaccatctgcaagatctaccgttatcgccacggcaagcccatgtctgtcaacgcttgcgcgaagcgtctctctacagttctttatggcaagcgattcttcccatactattcgcatgcgatgctcggcggtttggacgaggagggcaggggcgctgtatactcgtatgatcctgtaggaagttacgagagagagcaatgccgtgcaggcggcgctgcgggcagtttgatcatgcctttcctcgacaaccaggtcaacttcaagaaccagtacattcccggaagcggagagggtcacgagttgaaggagagagaacgacgtcctttgacacgaactgaggtcgagaccgtcgtcaaggacggcttttgatggtgcagtcgagcgacacatcgaagttggtgacaacctcaaatgctcattatcactgcgga

SEQ ID NO: 62031 - DNA, 572 bp, Triticum aestivum
  Clone ID: PAT_TA_62031
atttattgtgctcatctcatcctcgacacctaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcgt

SEQ ID NO: 62032 - DNA, 859 bp, Triticum aestivum
  unsure (1)..(859): unsure at all n locations
  Clone ID: PAT_TA_62032
ggttggcccctgtattttcttcgcttccactctccgtgttacattttcactttgcaactacaattaccacttcaaccacgactcggccgcagtctttatttgcatcgcatcccgtcgataatcggctgtgcttgcgtattaattagtcgactcgtccttatctgctccgattcgattcttggttatgctagaggcttgacgatagcatctattacgacatttcttgatctctccgatccacaaagctaacaattctatccccgcgaaatcgaaaaccggcgcatacctcaacaccaaacatgtcttcccgtccgcacaacgaggagcctctcccgctcctctccgctgaggagagagaccgcgatatgaagggcgagcttgatgtcgagggcgatgctggtcgcgctgagcctcccaagaacaacaacctcgagcacgagtactctatccccagtaccgtcaagttcgcatggcttggaacctacttcttcttctccctgctcttgactctctacaacaagctggtcctcggaatgttccacttcccatggctcctgactttcctccacgcctctttcgccagtatgggaacctatgccatgatgcagatgggctacttcaaactctctcgactgggacgtcgtgagaacctcgcgctcgtcgctttcagcgctctcttcactgccaacatcgctgtttccaacctgtctctggccatggtctccgttcccttctaccaaccatgcgcatgctgtgcccgatcttcaccattctcatctaccgtgtctactacggncgtacctacagctacatgacctacctttctctcctcccctcatcatcggtgctgccatgacta

SEQ ID NO: 62033 - DNA, 866 bp, Triticum aestivum
  unsure (1)..(866): unsure at all n locations
  Clone ID: PAT_TA_62033
tcggactactggactggcgccagtgtcatcatcatcattgtcaccatactcaccatggctcccgagaaacgatccgccgagttcgtctttacacactacgatgcctcggcaagtggctggcctgccggatggtcctttttcgtcggactactgcaaggtgcatatgttctcactggctacggcatggttgcttccatgtgtgaggaagtccagaaccccgaacgtgaagtccccaaggccatcgtcctctccgtcgctgctgccggtgttaccggaatcatttacctcatccccattctcttcgtccttcccgatgtcaagatgcttctctccgtcgccaactctcagcccattggtactctgttcaaggttgtcactggttccgctgccggtggctttggtctcctcttcctgatcctcggtatcctcatgtttgcaggcattggtgctctcaccgccgcgtcgcgctgcacctacgctttcgccagagatggagctatccctggatacaagctttggagcaaggtcaacacacgtttcgacatgcccgtcaatgctctcatcctctccaccattgtcgactgcattctcggctgcatctacttcggttccaccgccgcctttaactccttcactggtgtcgccaccatctgtctcgcctcctcctacggcgtccccgtcggcgtcaccttctccgaggtcgcaagattgtcaagcactctcccttcccctctgcaagttcggacctcttatncacgntatctgcgtcgtgtggatcatctttctcatcgtcattttctgcatgcccgtgtctctacctgtggatgcagtaaccatgaactacgcctctggtgtctttgctggat

SEQ ID NO: 62034 - DNA, 358 bp, Triticum aestivum
  Clone ID: PAT_TA_62034
cggccggccggtcgatccaggcggaagacattgtcaggtctaacaacccctcacccctcgtcgccgacccccccccccccccccgcgccggcaaatatgaattgctctgcggcccccccaagggggggcacgtttccgtggacgtggaggagaccgagggggccgctacggtggaggtggcgacctgagggagcgatagggtggagacagcttagcgttcagcaacgagggcccccccaacgaggaccacatcgccttcaagagccagaacgtgtgggagggggacgcggtaatcaaggtgctgcacgacaaagtgcatcacttgaaggggggtatatttctttttttaccccccccc

SEQ ID NO: 62035 - DNA, 285 bp, Triticum aestivum
  Clone ID: PAT_TA_62035
acgttcatcaccactctcccaccgccaccgccatcctcctcgccggcgacaatgtcggtgcacatcgcggccgtggcggttctcatcgcgctcctcgcccccgcccgagcctcggacgtctcctccttcccgctcacgcagacgcagtccccggccaacgcctccgcggcgccctcctccccgccctgccgcctcgacctctccgcggagctcttcggcggcgtggacgcggagtgacgagacgacaacaagccgcgccaccccctacgcggcatctagtgcccc

SEQ ID NO: 62036 - DNA, 669 bp, Triticum aestivum
  Clone ID: PAT_TA_62036
aagtctcttcttcttcatcccatcatacaagctgtatatttcacacgcactctcctctttcttcctgatatagtcctcctaccatacgcggatggcccccaatggggaggcatccgatatttcccacactctggtgactcctgtgcctctgcttacccggagtgaccgatgcaaggacaacaacttcttcacccaacaagctcatgagacgacctccctccagcaaaatgaccacctgactcaacgaaagtctccacggtcctccatgcctgattctcattggtgacaccacctgatgtctgcgatggcaaactggacacacctcttctgacccctgttgaatgatgacctctgtactctatcgccgccagcatagaatagtccaggcatggctgcatgatcattggacaatgtgacaccttcgacctcgatggtgatagctaacactcactcgtacactgactgccatatcacaccttactgaagcagattcaataggtgtccgcgatgtcgtatgccctgtggacgatgactgatctctggcgaggactccaccattacattgacatgtactaccgcaaattctactgacagcgatgcttgcccaatcatctggatccatacgtaaatgacctcttcaccgacccacgacgaactgatcatccgaac

SEQ ID NO: 62037 - DNA, 274 bp, Triticum aestivum
  Clone ID: PAT_TA_62037
cccccccgccccccaatctccccgcggaagccatggcagaacatgcaggaggctgtcgccgtgcggggtgcgatgcgcgaccacaaccacccgtcgactccgatcgccgtaccgaccgaccactcgccctacatcgagccagaatcccgcgaccacccgctgctggcctgggacatcaccaaccccgaacagccccgcagagacggtatcggcagtagaccctacgcctggcgccccgaccgacctacccgccacgcccactgcgtaccacaac

SEQ ID NO: 62038 - DNA, 673 bp, Triticum aestivum
  Clone ID: PAT_TA_62038
ggttgttggatgttcgtatgtgacacacgaacacgagcaccataccagcagcagacgcactcgagtaccttctaggctctccgttgccggttgcgtgacgtgccgtcgcccgcgcctcccaccgcagcacgccggtgagccccgcctcgtgctgcctctctttcggttgctctcctatctcatctctctctctgcctctccttgcaacaatggaggccgagcgcccatggcgtcacccgaggacaccttccacccgccattctccttcaaattcgtcgggatccggcctgatccggatggatccggatgccgacggcccattcccgacctccctgccttgcctggttcgtcggcctctccgatgtcgtcatcttcgtcacgggatccagcgctaccgatggctggcctcctcctcgcctggatgtgaccccccccacgtcggagcctccaacatgagcagcagcagcgaacgcctcgacaagggcgtcttcggtgttgtctttattttaattttattttaaagaagtttgccagatcagtggccagggaaaagccatggcgatgaagtctgattgatgtctcgcgagcgctcggtggcgcttgatgtggtggatgcagaatagtatagctcagagtagtaggccagatctgaaaaaaaattatctgtacttac

SEQ ID NO: 62039 - DNA, 769 bp, Triticum aestivum
  unsure (1)..(769): unsure at all n locations
  Clone ID: PAT_TA_62039
aactccggctgctgatcaggcacgggcgtgcacatcgtgaggtagtagaaggacctcccactgcctgcaggcaaggggagtcactggagcaccaccaacgctggaacctggccgatcgctgatgggctgagcgaggggtgggggttggaggagaggctagagctggtgagagagggaccagcggtggcaccccgccgccgctgtccgccgagattcggcctcctccaacggcggcggagagatttgctggctaggcttgctttgttgcgtggcggtggcggtgcctccagagtcctcgagcgacccgggaggcagttggcatgaggccgggagtagtaattagttctgagggctctatctgatgttggtttgaagataacctgcatcttgtttgtacccgttttgtgtcgcatgtgttgatattcctccttgggtgataacaccaaaagatattccatgcaacaggagcacaccaacctcaattgcattccctgatggagggggtctgcctgatcacccctgacgccccccccacccnacattcgcccccccttatcctcccccactcccaacctccttttcccttcccgccccctttcttcccccccccccctccttcccctgaccccccaccgatctaccttgtccccccctccccctccttcccccctccctcttttttcgccctctttcccccctgttcttccctccaccccctcccttctacaatttctctttagtccgcccttctcaccatcccccccccccc

SEQ ID NO: 62040 - DNA, 183 bp, Triticum aestivum
  Clone ID: PAT_TA_62040
gtctccttcatttggtggaactacgcggaacggcctctcgcccactccaccttcctcccgaggaactcccgaggtgtccggcgggcatggatccgccgtgaccatcaactccggtgaagacgggttcgtgatggccagatccgtcgaccctgacggcgtgctgtaacgcccccccccccccca

SEQ ID NO: 62041 - DNA, 523 bp, Triticum aestivum
  Clone ID: PAT_TA_62041
cttcacttcaagtcccagatgtttctcatgttcctcgccttaccatgaacttattttctgcaagtcagcttactgattctggttgtcgcgtcattcttgacgttgattcttgcactgtccaggatcgtcacaccaaggtcgtggttggggctagccctcgccgccttgactctcaggggctttgggagttagactggcttcatgttccttccgctgccaccacactagccagtacatctgccttcgccgcttcagctacccgctccttccagaagtggcatcatcgacttggtcacctttgtggctctcggctatcgtctttagttcgtcgtggtcttctggggcctgtctcaggagatgtctctttgtagtgtcagggttgtaggcttggtaaacaagttcagttaccttatcctactagtgagtcagtgtctcaacgcccttttgatttagttcattccgatgtgtggggaccggctcccttcgcttcaaaagggggccatcgatactatattatttttac

SEQ ID NO: 62042 - DNA, 525 bp, Triticum aestivum
  Clone ID: PAT_TA_62042
accttcaacaaatactctatccatcatccccttaatttgcagcaacaaacagctcgcgccgggacaaaccaaggcaagctatggcgtcgaaaactcagctcttactttgcctgcttcttgcattcttcttcttcttccttgtggcttctgaggttgatgctgctagaatattagctgataattactctggaggacttccagcttcctatggtggcataccgccaccagcatcaccttaggtaggccggagtttgcattgtacgatggagccatggaggggtttacaattatacaatatacatatgtgtcatcgtgtacgaccattacacataaataagaacttctactacaaataaatgacatgtaataggtaggtacgtcgacacacagcatgtactgtacctgctatctatctacatatattactggagtatatatgtacacttctccatgtgatcgagtacctgtcatattcatatactcaatataatagctgaacctcatgtatggccatgtatatttttc

SEQ ID NO: 62043 - DNA, 651 bp, Triticum aestivum
  Clone ID: PAT_TA_62043
atgcttctcaactcgtaatgattgaacttgccaacaatcagctccatggatcagtgccactcaacattggtagcttgagaaatcttgagacgtgtcggtgcagcaaccatgggcgtttgctcctctgacttatgcacagacgtgttgcagctccccccggcaagaatcgaacttcatacacaaccaaacaagagaagccgctcttcataagatcaacgagcgcattaagaagaccaaggcttgaaacaagctgcgagattcacaacagaagcaactaaccctggcaagaacgagccggcaagacaaggcccggcaagcccctcgagcacggacttcctgccaaaacaccagcgagacctctctggccagctgatcgttgatcagtgaggtttcgagcccgcaggtagttaggtggagacggctcgtacgtgtcagcttgctggaaagaaggattatctttattgacacccgtcgtcctactagcgtgtcaagctaataggaggtagttgggcaagcggtgcggcaaccttgtcggggctcctcctccacacgacaccttgcagtgcatttaatgcatttttgtcctaactagcagagttaggtatgatagttttgtatctatctaatcaccatgtaatgacctttttgccg

SEQ ID NO: 62044 - DNA, 547 bp, Triticum aestivum
  Clone ID: PAT_TA_62044
cccctcggttccatctcggtgctaactagctagtaggttttatcctctagcaaagggacggagctcaacccggtttagaaagaatgctactacatagagattgccatttgattcggttcatgctcatgctgttcttggtctgcttctgcctcctttccaggggtttcgcgcaccacgattatggcagcgccctcggccccaaccgtcctaccaagccgaaccagccccaaccccgacactgtccatactgttgcccacagtgcggataggaagggtattggttctagacaatggagggtgccaatatgtggatggcggctgttccgaggcatctgtacgctcgtttaatccaagacccattgcacctcaagtcatctacctaaataatggggcgttcatcattctgcaggagctatttacttacctcaagtttctgatgcagaggtcgggtgttatccttcttttaaaaaataataattttacttacctcaagtgtaatccgttcaatcgattgtaactcgcaatctaaaatgattagttttcgtgg

SEQ ID NO: 62045 - DNA, 689 bp, Triticum aestivum
  Clone ID: PAT_TA_62045
accctcaccacaacccgcggatatatgcgctcttattgacataccacatacagtcgatcgtctccggcgtgcgcgcggccatggaggagttcgacgaggccgacgtcctgtggccggaccaccaagaggacgaagaacctgtcaaagtacaagaccgccagcagcagcagcgtgtgtcaccggcgatcaagccgcacgacaagatcgaggcggcgcgtcgcccggcgggctcgtcgtcggcgccgatggtcatccccgtggcgccaaggcccccgatgatgatggattatggctcgtgggcgcggaggtaccacagcgacggcgtcgggggcgcgtcgttcgtggcgccgcacgtgatgacggcgaggcggcggtgcgcgtcttcggaggagaggtcggtgtgcgtggggcaggggcgcacgctcaagggccgcgacctcctctatgtccgcaccgccgtgctccgcctgaccggcttcctcgagacctgacggccgtcgatccatcgacatcgagtcaccaccgcgcttgatttcagcatcccgtagcgaaccaccccagcagttttttcgtgccacccgagtccgagtccattccatgcttaattatgatatatgagtgtcagtcaattcccgagaaacaaaatggagtcaagttttcaccgatgatgcaaaatatgcttaattatg

SEQ ID NO: 62046 - DNA, 833 bp, Triticum aestivum
  Clone ID: PAT_TA_62046
aagcacccttcatctagctgtctcagagccaaacaagacagagccaccacgcgcctccccttggcccccggcacgcaccaagcagagcagagcagccgccggcgaagaggagaggaaggcggcaatggggaacagcctgcggtgctgcctggcgtgcatgctcccctgcggcgcgctggacgtcgtccgcgtggtgcacctcagcggccacgtcgacgagttcacctgcccgctcatcgcctccgacgtgctggccgcgcaccccagccacgcgctgaccgccgcgggctccgccggcgccgccaggaggatcgtcatcgtgtcgcccgactccgagctcaagcgcggccgcatctacttcctcatccccacggcgtgctccgcgccggcggccgagctgaagcggcccaagcagcagcagcagcagcagggccacggcgcctgccagtccaagacgaagaggcgccacggccacggccaccgcaagggcggcacggcggtggccgccgcggcgagcacggcggagcaggacaactacctgcgggagctcctgtccgagaagcgggagtcgggccaccggcggcggcgcagcagcagcgcccgcgccagcgtgtggcggccgcggctcgagagcatagcggaagagccctccgactagcaagtagactgatttgccatttcttttgcctctcttctgctttcgttttcgatcttccgctgtgaatatgattgatcgattgctgaggagcgttttgtctctccgtcaagcttaatctccttaatcctgatgcaagtgtaaggatgctcattcatttaggctccgaagtcgactg

SEQ ID NO: 62047 - DNA, 746 bp, Triticum aestivum
  Clone ID: PAT_TA_62047
cattcagaggactaggaagcacaggcaggatcgaccaaagaaaaaaagcgtctagttcaccggttagttagcccgaccgatcgatcgatcatccggcgagaatggttgcgacaaagtcgggcgagctgagggcgctattcgcgtcgctggaccaggacagcgacggccgggtctccgcggcagagctgcgggggtgcatgcgggcaacgctgggcgaggacgtgccggcagaggaggccgaggcactggtggcgtcggcggacgcggacggcgacgggctgctgtgcgaggccgagttcctcgagctggcgcagcaggcggcctgggcgagcgccgaggacgaggacaacgagcagaggacccgggcgctgagggaggcgttcgggatgtacgagatggaggggcaggggtgcatcacgccggccagcctcgggcggatgctcggcaggctcggcaccgagcggggcgccggcgagtgccgcgccatgatctgccggttcgacctcgacggcgacggcgtgctcagcttcgacgagttcaagatcatgttgagctagctacctagctagcgcgtgggcccaagcatacagtaccagtttagtttcgtcttgcatatagcccctttgctcattcattcattcattcattcattcaattgttacgtggtagtagcagtagtccaaaatttgtactcttggagttgatgcacagtaattgatctatgtgaataccctttggtctcgatc

SEQ ID NO: 62048 - DNA, 680 bp, Triticum aestivum
  Clone ID: PAT_TA_62048
gacccgcaccagccgcagcccccgcttttcaatccctttcaaacaccaacccatcgccgcctcctccgcccccgtccacccatggccgccgcctcgcccgagttcttcaagccggcggacgccttctccccgcgcctgcacctcctcgccgccggcgccggcgcagaagcctccgacggcgacgacggctactaccgctgctgccggacgctcgcgggcgccgggaccggctgcctgggccaggcggccacctgcccgccggcgccgcggaagccgcgcgcgcagcccgacgccgcctgccggaagcgcctcttcggcgtggaggtcatcagcctccttttcgacgacctcgacgccatcttccgcccctcgccgccgccgccctgcgacgaccaccacaacaacaagcagcagcggcagcggagccgccgcgcgctcggcaggctcgccgccggccggagcagccgcgccggcttgaattaagcgcttctcattaacagtcagcaccagtagttgagctgagttgagacacctgtgcggatgcatgatagatgtatcacccatcttcaggtaaaaacagtagcggtagccacgaccgatacttatttttacgcacaaccatcctctgtaatcacccgtcataataagactattataggaaaaaaaaaaaaaaaaaaaga

SEQ ID NO: 62049 - DNA, 207 bp, Triticum aestivum
  Clone ID: PAT_TA_62049
tatcacgctgctcaaatggggattctaagacgtgaacaattacaccacaaccatgtggacatttcgttgtatcagaccagactatcgaacgctggattccttagcgggagtcgcgcaatgtcacctaaccccagagtcggtactgctgcggccacacaggctagactttagcgcaaatattgggagaatacatacagaatcacatat

SEQ ID NO: 62050 - DNA, 455 bp, Triticum aestivum
  Clone ID: PAT_TA_62050
cgggaaaaaaaaaaaaaaaaaaaggatgcctgctagcacatggcaaaatattgatgagtttacgaaggaggatctcgtcatgaagcgcctctgggagaaggccaacatggagaggcacatagcggaggcgagaagaggatcgaagcagcgtagaagataagcttttaggcagcccaattttgactgaaggttacgagatgaggctgtttaacagcatgtcatgtactccaggaggacaactacatacccgagtggaaagggaaggcatacatgagtcaggcctgggttcgtcgacccataaacatgggacattgatatactgaagaaacataagatacaggggattcttttaccataaggatcgtacaccgtggaggagttatgtggtgatgataacatttcttacgtctatttggattctatagatacatctacctggatgctatttacatgcc

SEQ ID NO: 62051 - DNA, 720 bp, Triticum aestivum
  unsure (1)..(720): unsure at all n locations
  Clone ID: PAT_TA_62051
aactatcaagacaactaccaagataatcatcgcatttcaatattctctcattcaactacgagccactctcaaatcattcacatcacatcttacacaatgggtaactcaggatctaaattcaacacctctcagctgtcagctgaagagcttcaagacatcccaaacgtcatccgcatggcctaccaaaattcatggaagaaatatgcctgcttcacaagcatgaatatcagtcttggcccacccgacgctgagcccatgtataccattagctttaccaaggggttatacggtgatatcgtccttcacaagggtcctacccccgagtcaccagccattgcaacgtcatcaagaatcaagcaataccacgatgactacctcatcacgttgcctacaggaaagggcatccacgaagaaaccctgcgccgacccaagggtctgaagggtcgcttctggttcgggtgccttgttggtaacggttcagagcagcgcgttgagcgcttcgaatggcgccgttcgcgtggtgccgaagtcaagagtgtcggacagtccaaatggggcggctacaagctcgtccgtctcggcagcaccaacactaaagaagaatactcgtccagcgaagaggatttccccgagggcagcagcgccagcggcgaaggttacaccagcgatggcaaggagattgtgngagtttggggaatgccaattgctggaagacatgtc

SEQ ID NO: 62052 - DNA, 878 bp, Triticum aestivum
  Clone ID: PAT_TA_62052
aactgccgcacacacccgcagcgcccgaacccgtcgctcgctagccctctccctcctctcgatctcatctccctcgttcccgcacagcgccgccactcaggagaggagctcctcgtcccgatcccctcgctgccggcagcagcagcagctgctgcaccctctcgccgacgccgcgcccgatccccatcttctcgagcgcctcctccatcccgcaaccatgccccgtcgcccctccggtcggcgagtccaggccgcgccgccctgcctgacttgcttcggccatggccatgtcgccccgcgcctccgtctctgcttttgcgccagtgcctcgtcgccgggagttcgtccccgagccctacgcgccgcgaccacgaccccatctcctgtgtgagacctgcatcgctgctcctctgctccacgcgcccgtgccaggacctcctcgcccacctcctcgtctacccagcgccatcgccttgtcagctccgtcgtcaggggaggagcccctcaatccgtccccttcggccccgactccggcgagcgccgccccgtctcctcgcgccggccccaccaccaagtcacaccgccagagatggccttcgtcctgactccagccagatccgccccgcgcgacccggatccgccgctgccgctcatccatggcgccatggcctctgcctcttttggccgacccgttgctgccatgcacaacctctgccgtgccctatgtgcgtgctctccgctgcctagcgctggtgacgtcaagaccgtggccgcaacaacatggatacaccaagaccgtcccggataacgtcaagtaccccgaccacgtgtgtacctctaccgacgaacccgaacatctacgggcgtgtaccactact

SEQ ID NO: 62053 - DNA, 697 bp, Triticum aestivum
  Clone ID: PAT_TA_62053
cggccgctcaggcggcgggcgggttccttccaagatttgagcttcatacaactagtatcccgtgagcgtctttcctcctcgtgtgtgtgtcttgccctgcactagtgtgtgtgttatactagtgagctgagtgcaagtattaccagtagatagtcactaccctctgatctcagtagttcgggctaacactgctgtcaccgcgccaaacccctccgttgcgcagccaagggcgcacgcgcaccaggcgctggacgggcgcgcggccatgcacctccaccgcgctgccaggaacgcaaattgcgcttatccgggcgcgtggaccccagatcccaagctccagcaagcccccgcggatctccatcgatgtgccgtgaagctgcctctctcgatgcaccgtagtggcaagaccgccgccttcctcggggccggcctggacttcgcccgttggcgtcctctggcggcggcgagacgggtggggatggtgtcgacgctagggtcggggctcctcatcattagttgtggagctgcttcttttcttttcctcccatcaaaggcttctagaagcacgttcaaacatgtgaaggtctacctgagtactttccgtatggacatctttcctttccagcgaatcctcatgatagcaatgaaccaaacacgcaatgcatctcgttgaactgtcaatgcgccgctttaacac

SEQ ID NO: 62054 - DNA, 296 bp, Triticum aestivum
  Clone ID: PAT_TA_62054
aaatactctcgatcctcgagctgggtcgctggtctgcagtgcacctgaccgatgcagtaacattgtggctaaaaacatcaccgtgggtgtgcctagcaagaagccgcctgtctacgactgttacaaccttgacgaaagtactttggacatcacttgccaggatcccactacggatcgggacatgaccaacggttaaccagatgactggattatttgttgtaatacagggtagctgatagggcatgtatcatacttgtaccctaaacttccgatacataattaaacaagtttgtcct

SEQ ID NO: 62055 - DNA, 778 bp, Triticum aestivum
  unsure (1)..(778): unsure at all n locations
  Clone ID: PAT_TA_62055
aacctctgttcattttgttgttcttgtgatctgctggagcgagaacaagtcgagggaaacaccattcatggcacgaggaaccatggtacccacccttctggtgctgcttctggctattttctgcgcgatcaccgtcgtccacagcaaggaatggaacgtcggtcgccaggacggatggttcttcagcatctccaattggggggacgacaagccaatcaaggtcggcgatgtgcttgtgtttaagtacaaggcaattgcgcacaacgtggtgcaggtctcagaagaagactacgacgcatgcacggtttctcgcccgtcgccgacctaccgctccggcaatgaccacattaaggtcaccagcagtggcagattcttcttcatatgttatgtgaaaactcctttacactgtgagagtggcatgaagatagccatcactgtccaatagatagacataatccctctcatgatacgtacatatgcatgtctttgtagcaagtctttaaggtgcaatctcatgacagaatgatggcagaagaaataaatcgatgcttggctcaagtctgattcaacatgtttctttcaagactgattcattatgtattcatgacaccttgctacagcaacatctattgtttagttttgaggngaccaatatctgttcggaagagccagtggaagcatatcactagtggaagtatacgactagttgggttcactttatgtgaaaacgtcgatgaatttaagtaatttcagtggacacggaagtatttaccttttc

SEQ ID NO: 62056 - DNA, 301 bp, Triticum aestivum
  Clone ID: PAT_TA_62056
atatacaacctaacaacacgtccgcttctgttgcgtgacttgagtcgatggcggctcgtgttttcatctcgtcgtccaggattgccggccagctcgcagccgcaaataagcgtggcgtccgttcgtacgctgcagcggcggcggccgtgacgcggcaggagccttcagcagccggggcggcgagcaggctggcggcggcggcagaggaggcggccccgaagagggagtcttctggatgagggacccaaagaacggggtgctgggatgccggaaaaaccacggccgacggccgtttgacccc

SEQ ID NO: 62057 - DNA, 443 bp, Triticum aestivum
  unsure (1)..(443): unsure at all n locations
  Clone ID: PAT_TA_62057
ccccgatgcctctgcttttccctcccccgacgccctcctccgcctcgacgtagacctcctccaccagcgagcatgacatccagtggtgccggcagtagcggcgaccctccgccgggcggcaggtggccgacgaacttgggcacgctggagacgcacgagctcatccgtctcgggctcatggtgtcgccgggctgtcggctgccgaaagccttcaagatcacggccgacgggtacccgatgagggggggcggcgcggcgccggaggagctccgccgccacagcggcggccgctggaaccctgtcggccggcatgccttctgggacggcaaggacttctggtccgtcgtcgccgagcgccggcgggcagcgaggcagtggggttcggcactgcacaccgaatgctcncccctcctcccccctcccnccnctccccctctccctcc

SEQ ID NO: 62058 - DNA, 741 bp, Triticum aestivum
  Clone ID: PAT_TA_62058
ggaagacaatcgtatcttgcatgtccaaaagattctcgcgtggttgttagaaccaaccacctcgcctcaccatcgccaggtttttcggctgccatggagcataaagccagcccgccataaacccctcgccgcccggtcaccaccacacagagtagcggcggcgagcgcttggtcgtgttgggtcgggggctgcgagaatggacgcgcaggccgccgtgacccgtgacgccgtcggcctcgacgacccgctcgtcgccctcaccctcgtatccatctacgccgccgccccgaccccgccgcccaagccgtggcgcccctctcctccgacccctccgccttcccagccggcgtccgccacccgccgccgcctcaacgactccgccaccggccagcgccgccgcgcgagcaacgagccgccatccgacgacgacgacgccgccgcggacgggctgccgccgccgttcccgtgggccacggagcggcccgcgcggcacgaccccctggacagcctgctgcgccggggcgtcacgtccgtcgagggcgagacccggtgcaggcgctgcaaccgcacgtcgaccgtggcgtacgagctggcgcccaagttccaggaggtgcgccagttcgtcgtcgccaaccggcactcgttcgacgaccgcgccccggacgcgtggatgaacccggtgctgctcgactgcgctgcgtgcggagagaagcgctgcgtgtggccggtgatcgccgccg

SEQ ID NO: 62059 - DNA, 829 bp, Triticum aestivum
  unsure (1)..(829): unsure at all n locations
  Clone ID: PAT_TA_62059
accatctacacatccatctcaaccgaatacctaattcctctaatcatcatgggtcgcgaactccaaaagaagaaggccagatcaggccgacagaccgctaggcatgctcaacagatccaagaatatccttaacccccgaggcaatgattgctattgcaaagagctggaacaagaaggagacactctctcacaactaccgccgtctcggtctcgtagatcgcctcaaggctcccgctggtggaacatagaagcatgtcggagcaaccacaaccagcggctacgccaacgatcccttcgccatcgccacgattgaaaacgccgtcgtctccgaagagagtgtctagcgcgacgctgacggcaagatcatccgcatcatcggctccgacaaggccaaccctctcaacgatcctctcaacgaccttgacgagggcagcgacgccgaggacaagcctgctgaagagaggggcggcatcgcagacaacgccgacgatgaggagacaacagacgttgtcgaggaggtcctcgagcaggccaagcacgctgatctgcccaagaagagacaccacagtgctcgcgagattgattgtgtgcacaagctggtcgccaagcacggtgatgatacgggcgccatgtccagtgatcgcaagttgaaccctatgcagcaaacatccgcgaacatcgccaagcgacttcgcaagatgcaagaggagagtcagtagtataggaagggaattacacactttttttgatagagaggggtgactttcgaagagagacttcgatgagagctcanaaggctgaatcgctatatcatcaagtacggagcatc

SEQ ID NO: 62060 - DNA, 667 bp, Triticum aestivum
  Clone ID: PAT_TA_62060
gttgtgtcctttcctggtcatgcaaatacagaaatttcttagtcttgtcatggcattctttcccttatctcctctgtttatttgactggcgcgcagattacacggcagcgcccgcggcatcctactcgccgcacggggcggcagccggcgacgaggagcttccttcgccgtcctccgccgagtctggtggctccgggggcacgccgaggaagcggtacaggggcgtgcggcagcggccgtgggggaagtgggcggcggagatccgtgacccgcacaaggcggcgcgtgtgtggctcgggaccttcgacgacgccgaggccgccgcgcgtgcctacgacgccgccgccctcggattctgcggcagccgcgccaagctcaacttccccgagtcggccaccatcccgccgccgcagcagcctcctcatgcaccggcattagcgatgccaccgccgcagcagcctcctcatgcaccggcattagcgatgccaccgccgcagcggcccgaggcgctgctggagtcgcaggctctgttgggagggcaggcttattcccactacgccaggttcctgcggccgagcaccggcggctcgacgtcgggggggccgagaacgccggcgcctcctctgatttacagcttccgaggcggagcgagctaccccttgcagcc

SEQ ID NO: 62061 - DNA, 709 bp, Triticum aestivum
  Clone ID: PAT_TA_62061
cccctcgctcatctgtctccctcgtgccgccgcctcgctagggttcggctccaccgtcgccgccgccgcgcaccgcgaccgcctgccgtcaccgcgcaccgcgaccgcctgccgccgagcgcctcgaccgcctgccgccgcgcacctcgaccgcctgccgccgctgccaccaccgccatcccggcgcttcccaccttcgtccttttccacgatgctccgtctccggccgtctgccctgactcccaggcagccatagtccgagctcatctaccctgattccctgacatcgacccccgagcttctttcccgtcaattcccgggcctaggccattctccgccttccacgatccatatcttcatcggcgccctttcactcttccgtcatggcaatgcaagaccatccttctccgtgtggtcgccacccccaaatcctgctggatagaaattgtttagtgggccagttggaaaattccactaccgcaaaaaccaagaatagcaaagggcatcacttggagctttcttttaaagcagatcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgactgtgccaccgacga

SEQ ID NO: 62062 - DNA, 835 bp, Triticum aestivum
  unsure (1)..(835): unsure at all n locations
  Clone ID: PAT_TA_62062
aagatttatcttctcacacctctttgctatctatcattgattctctttacatccctcaaatgacaacactgctagacgcccttcgtcagaccactcaggttgactgcgatacccttgacgccaatgtcgctcatcaattgggtccctttgtggactgtacttccaatcaggcgattgcattctctgagatctccaggccgcttgcaggggagcctcttctgcattacgacgctttggtcaaagatgctatcgaaaaagctcgaggggccttgaaagagtttcaaggatccgcgacgtttgaagagtttgttgttcaaatcttgatggtcaaattgcaactgttaatcgtcccaaatgtgacgggttacgtgcacattcagaccaacccaaagctgtcttactcaactgatggcacaatgagtgatgctcacagaatcgtcaacatcttcaaggcgctggcacccgaatttgacacaaagagggtgtgcattaaaattcctgccacttgggaaggccttcaagcgtgtcgtgcacttgaagttgaaggaatcgctacacttgctaccaccatgttttgcatggaacaagcgacattggctgcagatgcacagtgcacttacattgcaccctatgttaacgagctcaaggttcattttgaagcaggatacgttgatgagcatanagccttttgacttttgtcgtgaagcgcagacctactacatcaaccattcgtggcgcacgcaagtactagctgcgtncgcttcacgtcggtcgatgaaagtatgcagcttgcaggcatccaaacatattacatctccccaaatctgctcaacgg

SEQ ID NO: 62063 - DNA, 690 bp, Triticum aestivum
  Clone ID: PAT_TA_62063
aaattcttaactttctcataatcttaaacctggaaatagaactgccgaaatggtgctcagagagagtcaagtttatggacctataactgcatatggcaaagatgccactatgtgcatctttgtctttcacactacaattcctggataccccaatgcacgattcccatgcgtgagtctcttcatagagatataccaagccgccgggactgtgactcgctttgcaccgaagatctctagggcagggctatcttcgatgccgctccttcatcataccacgaactttacaggtcccgaggatctcaagtacgacgtcgacgacactgatggtgggatctaatacaatatcgaaaagacccgtctagtcttacgacgctgatatcaatgacactgtcgactatctcctctcacttgccacttgcacaagatgcatctggttccacaaggatgtgcctgggcggtcatcttgccgtccgtgctgctcttgatcctcatatttctgcttgtgtatgtgacttgggtactgatattcactctcacactctgggcctctactatgctctctacagttcctctaccgcctctgacaacagtaaccgcactctggaccttttccacaagttcaaaaggccatattgccatgatctttggagcgtaggacacccacgtccctgacgatggacgtgatctcat

SEQ ID NO: 62064 - DNA, 666 bp, Triticum aestivum
  Clone ID: PAT_TA_62064
ttcgatctgggacaggtgttcctccaccagctcgggaatccccttccactcgccaccgccaccgccgccgccggcgagccacggaccttctcctcgcccccatcccctcgccaacacaggaagattcgcgcccaggaggttctcctctgacagcggtcgccgccgccccctccaggtaatattctactgccctgagcacattgaaagatggttaatgcaatcaaggggctgttcatctcctgtgatataccgatggctcagttcattgttaatatgaatgcttcaatgcccgcatcggagaagttcatcgtgcacattcttgaccccacacacatgtttatccagcctaatatgggagattacatcaaaagcaagatggcggagttcagagaccagaacagctacgagaaaccaacatgaagggcccccatccattaccgcgcggttgtagcttcaaactccaaccagagatatctaagttgattatcgctatttagaatggctataggctgagattgaacattatctctttcttgtgatgttctggaatgacagttgtgtagtatcacagagtattgcatatatgcatcttcggagtaagcctttatctgataatatatttgcttaacacttatactgtgcgaataatacagtaccacttgttac

SEQ ID NO: 62065 - DNA, 843 bp, Triticum aestivum
  Clone ID: PAT_TA_62065
atctctaccaacaccaacaataacaccaagtcgcaccactccagcagcgtctcccctcgcagcggcagcggcggctccggctccggcggtgggggtgggggtgggggtggcacgaccaaccaggcctgcgcggcgtgcaagtaccagcggcgcaagtgcaaccccgactgccccctcgcgccctacttccccgccgaccagcagcgccggttcctcaacgcgcaccgcctcttcggcgtcagcaacatcctcaagacgctgcgccggctcaagccggagctgtgcgactcggccatgcagacgctcatctaccaggcggagatgcgcgccatggaccccgtcggcggctgctgccgcatgatcatcgacctcgagcacaccagcgagctcctctcggccgagctcgccgccctgcaacagcacctcgacatgtgccgccaggccgccgcgtccggcgtggccggcggggacgtcatggacggcccgtgcgctgacctggaggtcacctcctcgaaccaccagcaggagcagctgctcctccacgccgaccaagatcatcatcaggcgctctacatcggccaagaaggcgccgaccccgtgatacagaacggcgccgatcacgacgacagccggcaaccgcagtatcacggcggacagcagcaccagcaacagcagctgtacgactatttctactacgaggcaaccggtgccggcagcgatgaggccgggagaaagccagtggcagcggcgtcgacattaacgtcgacgtcatgcagcatttcgattacgactccagctgcgagggtgatgatcatcacaaggtgggatcactggagccgatga

SEQ ID NO: 62066 - DNA, 692 bp, Triticum aestivum
  unsure (1)..(692): unsure at all n locations
  Clone ID: PAT_TA_62066
aactgaaccgcagaagcaaaccaagaaacgagccaagatgcgtcgcgaggggaggcagcgagggtgggtgcgcgtgtacgaccgcgagctggtcgacccggagggcaagcgccgggcggcgcacgtcgtggacgccgacgggcaggccgtggtggtggccaacggcgggtacgtcagggcgtcgcggaggccgaccaaccactccaagccgggcggcagccgcgcgctcgacgcgctctgcaggaaggccctccgcgcgctcgacgaggaggaggaggcgcctccgccgcagccggccgcgcggtacgggtactcgccgggatggtggccgccgtcgttttcttcgtcccggtacggcgccgtcgcgcagaagcagcaagcgcaggttcagccggcgcgttcggggggaaaggcgtcgtccaaggcgggcccgggccgcaacttcaagcacggcaagatcagcaagacgtactacctcgacgaggacgagatcgactatctctacaactacgattcgtgagcggtcggaagcggngagctgcattgtggcttttttctatttctttttggcgaaattcagcgagaggagttgtatgctggattagactcaaattcttgttaagatcacgagtctctgactcttaagtgtgtttgttgatctcgaattgaagggatttatttcgagtagtgcc

SEQ ID NO: 62067 - DNA, 530 bp, Triticum aestivum
  Clone ID: PAT_TA_62067
acacctccatcacggatcacactcaacacctgcctgccactgcgagagcgagagcaagagtgagcgtacgtacgtacgacgacggccatggcgatgaggaaggaggtcctcctggcggccatgatgctggcgctgctggtggcggcgccgggcggggcgcttgcggcgtgcgaggtggggcagctgacggtgtgcatgccggcgatcaccaccggcgccaagccgagcggcgcatgctgcgccaacctgcgagcgcagcaggcgtgcttctgccagtacgccaaggacccctccctcggcgcctacatcaggagcccccacgcgcgcgacaccctcgtctcctgcagcctcgccgtcccccactgctaggccggcgccggcccctagccagcgagtatggctcagctataggtaggctacctccgtccatgagagatgatgagagacgagtatagcttagcctagctgagacctgagagagtgcatgcatgctgctgttcgattgatgatgctgcaataaaatgattgat

SEQ ID NO: 62068 - DNA, 523 bp, Triticum aestivum
  Clone ID: PAT_TA_62068
cgatccgaggtggcaggcgcgctgggaggagcaccgcacgttccgcacctcggacgcctccaggcccaagggctacatcctcggcatgttcccttacccaaggttcggttcaaataggtgcttgactgtgatttgtgaatgggggtgattggcgcacactagcgagtgagcgatcgatcttttggattagctgcttgcacagagcacggtcagcgtcagttggggtcgaaattgctgtcatggcaatagtttccggatagctcctcggctaggtgtatctattatataacaacatggcaatcagataatgtcattctatcagtccacactccacaggctgacatatatcacttccagtaatctgataattatactctggatgggataatgtgctatagtgctacagttaggcaatctgtgaattgatagggttgtgatgttggtgccacacaaaattagtggggcatgcacagtgtctaagttaatttttcagagggactatggaaccacacatctgaattat

SEQ ID NO: 62069 - DNA, 775 bp, Triticum aestivum
  unsure (1)..(775): unsure at all n locations
  Clone ID: PAT_TA_62069
caaacctctattctttcacggacctcgaaggaccagatttcgacattcttttttcttaccactctctttttcaatcactcactttcgcttcgagccttgacggccgtttatatttatttaccactctttatactacaacttctggtcctagagacactttcacgaaagacaactacttcagtacacttttatatctactaccgccaaaatgaagaacgccgccgctatcctcgctctcattcctctcgtcgccgcccacggcttcatcaagtctcccgccccccgcaggcccggcgtcgcctacaaggccgcctgcggtgaccagcccttctaccagcagtcctcagacatcaacggcaacgtccagggcatcaagcaggtcgttggccaggacttcaaggccgctgactgcaacctctggctgtgcaagggcttccagttcgacgacaacaaggacaatgtccagaagtacagcctcggcgagaagatcccctttgagatcaacattgctgctccccacactggttacgccaatgtttccgtcgtcaagacttcttctgataccatgatcggcgagcctttgatcgagtttgagaactatgctgccaacgctggtactgcttccaacaacactgctttcagtgttacccttcctactagcctgggtggtgactgcaccaaggctggcgagtgtgttctccagtgggtctgggacgctcccgatatncaccagacctacgagtcttgcgttgactttgtcgtcggcgctgggtcc

SEQ ID NO: 62070 - DNA, 707 bp, Triticum aestivum
  Clone ID: PAT_TA_62070
gcaagcatgcacctcaaaattttttttaagcagccgcccaagcaaaaacttgtcggtcagcttaacgagctgtttttaatctgcctctgtctgtctaatccatctcttggcccaacccaaccaaaagtttgaaaagaacaccctacccaaatgctttacacatctgaaaacaacacctgccacctgctcgaagacctggacgatgacactggcacataagttcgtcgagacacgcatgggacgatggtgtggtgtgcaattcgcgtggtgtgaagaggacatcatgctctatctagctttccatgacaaggccttctgcatgacctcctcctcctggcactctgaaagggatgagccaggacaggtcagcttcaggcgcactgcgtgtcacgtcctcgcccttctgcgcgctcgggctcacgtgtttgacctggtatctttagattcggcagggattagtggtagatgatagtatctccgttggatatagtttcaggaagcggaataaagagtgttatagcgaacgactccagaaaatcttcatggcaacggccttgcaagaagattcatgcaacggccttgcgcgaagagtgtttttgaagatctaaaatcgctcttcaattactcctcttgtgcgtaatctgaagggattcctcctgctgtacaaatctcatcctcttactaataaaattgccatcatcttattg

SEQ ID NO: 62071 - DNA, 722 bp, Triticum aestivum
  unsure (1)..(722): unsure at all n locations
  Clone ID: PAT_TA_62071
aaccgtacaggagcacagcactgcggcagccacctagctagcaaactcctcgtcgccagtccgacttcagtgcacggagctcgagctcgctagccagcaatggaggtgaaggtgctgagctccaggctcgtcaagccggcctacaaggccggcgctccggccacggagtacatccctctgtccgtcttcgacacggtcacgtaccagatccagatggccatcatctacgccttcgcgccgcccgcgccgtccaccgccgccatcgagaagggcctcgcggccgtgctctcccagtaccgcgcgttcgcgggcaaggtcggcgagtcccccgacggcgcgccggccgtggtcctgaacgaccgcggcgcgcngcctcgtggaggcgtccgtggacgccgacctcgtcgacatggccccggccaagcccacgccggcgctgctcaagctgcacccggacctggacgcggagcaccaggaggtggtgctgctgcagctcacgcggttccgctgcggctccctcgcggtcgggttcacgtccaagcacgtcgtcgccgacggccacgccaccagcaacttcctcgtcgcctggggccgcgccaccagggggctgcccatgggcctcccgcccgtgcaccaccagaaggacctctttcagccgcgctcctcgccggttcggccggagcacgaccaccgcagcagggagtaccaccgggcgtcgcccg

SEQ ID NO: 62072 - DNA, 763 bp, Triticum aestivum
  Clone ID: PAT_TA_62072
aatccgatccgatccatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtcactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactaaacattcagaaggagtcaacccttcacttggtgctc

SEQ ID NO: 62073 - DNA, 424 bp, Triticum aestivum
  Clone ID: PAT_TA_62073
gaatttctccgtacaccgcatctttcgccccccccaagtttaagccgcgaacctccgcgcgctaaaacttggatcccacgaactctagacgaggttcaaagctcccgaatcaaagctccaaagcactccgcccccgtctgatcccgcctctacttcgaacccgcccgaatcggaaaaatcgcagtggttcttaatcgcagcagtccgcgccggctgccgtggtggttgctgcggcggcggggagctcgcgcccgagggcccgatccgcgccatggaggagccgctcgatgagaaggatttggaaaggaagctgaagaaagaacagaaggcgaaaaaggaggaggagaagaagctcaaggcaaagcagaaagaggaggccagactacaggtccaatcagcatctgatggagctaacaagagtgtg

SEQ ID NO: 62074 - DNA, 731 bp, Triticum aestivum
  Clone ID: PAT_TA_62074
acaacccatccccaattacccaccggttctcctacctagcagcgaaaccccacctccccgcacctccgaccttcgtagcggcagcagaatccatggcgcccaagacggagaagaagccggcggcaaagaagcccgcggaggaggagcccgcggcggagaaggccccggcggcgaagaagcccaaggccgagaagcggctgccggcggggaagtccgccgctggcaaggacggcgacaagaagggcaagaagaaggcgaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggccgccaagctcgcccgctacaacaagaagcccaccatcacctcccgggagatccagacgtccgtccgcctcgtcctccctggcgagctcgccaagcacgccgtctccgagggcaccaaggccgtcaccaagttcacctcctcctaggctccggtcttcttctctgagagtttccctcttttctggttcctggcggtgtgtggtgaattgatgttaccctgtagttagattatgttccgactgtcatcctgtaagaaatcgtgcactgttaattggatctgaagtaaaactgttattccctcggaaatatctgaagaaatgctattgttcctgctc

SEQ ID NO: 62075 - DNA, 671 bp, Triticum aestivum
  Clone ID: PAT_TA_62075
accctccaccctcctcccccctcgtcttattttaccgagcgatccccccagcgagctaaaccctagatcctccgcccaaccgctaaaaccctagcaggccaagagctgctgcgtcggggacgataggatggccgagccctccagggtgatccacatccggaacgtcgggcatgagatctccgagactgacctgctccaggtggtgcagccgtttggcgcggtcgccaagctcgtcatgctgcgcaccaagaaccaggcccttgtccagatggaggacctgtctgcttcaatcagcgccatccaatactacactacaattcaacctagcgtgaggggaagaaacgtatacttgcagtactcatctcaccaggaactgactactgatcagagctctcatggacggaatcctgatcaggtacataattatccagctgcactttgggttctatactctattagcacgattgcttttctataggtaattagcagttttgtgcatttctgtaatctatgatctctgcatgtaaacatattggcctgttttcattccttctatttagagcgtgggttcttgcttcacggtatataccaacctaaatgaccaagagttcaaaaatgaacagctgccttttcaaaaatattatatgcacaatgtaatgaggtactgatgc

SEQ ID NO: 62076 - DNA, 865 bp, Triticum aestivum
  unsure (1)..(865): unsure at all n locations
  Clone ID: PAT_TA_62076
atatcctcaaatttcagtatttttctctgtctcataacatctcaaaatgacagacacattctcccgcgaagaggtccgctcccacacctcggacgaatccctctggtgcatcatcgacagcacagtctacgacctcacagacttcgtcgatgcccatcccggtggtgagactgtcctgcgtcaagtcgccggtcaagatgccacaaccgccttctacaaccttcaccgacacgaggtcctcacaaagtacaaggacctcgccgttggcaccatcgagggcgagaaggcccaagtcatcactccacagcccggtgacctcagccaggtcccctacgccgagcccctatggctcgctgagcctttccgctcgccctactacaaggacagccacagggagttgcggcgcaagctcagggagtttgtcgacagcgagctgtacgaggaggcgcaggaatgcgaggcgacaggtcgctacattagccagaagatgattgatcgcatgagcgagttgggtatcctgcacatgcgccttggacctggaaagcacctccacggagtcaacctcatgnggaggcgcggtcaagggcgaggagttcgactacttccacgacttgatcgtgtcgcaagagctcgcacgcgccatggcccgcggtttcgctgatggaaacatggccggtatgaccatcagcttaacagctgtcctcaacttcgcccgcgacgaggcctgggaagaataagattgccaacgaggtcttcagcggcaaagaagagatctgtctcgccattaccgangncttcgcctggtttcgatgtcgctggactgcgcacgactgccgagaagacccccgacgggcagcactacatc

SEQ ID NO: 62077 - DNA, 753 bp, Triticum aestivum
  unsure (1)..(753): unsure at all n locations
  Clone ID: PAT_TA_62077
aaaaaaaacgcctcaacatacagaccgctcgggaatggcgccggtgaaggtgttcgggtcggccgcgttcacgaacgtggcccgggtgctcgtgtgcctgtgcattcttgcagccatttggtgaaatcccagcttttcaagacggagacctcgtgctctttgagtcccgtgccatcgccaagtacgtgctccgcaaacacaggacggatgaggtcgacatgctgagggaaagcaacccggaggaagcggcgacggtggacgtctgggccgaggtcgaggcaccagtacagcaaagcagtcgcacctatcgtctacgagtgcatcgtgtaccccacggcctacggcataccgacgaaccagaaggtcgtggacgagagcgtggagaagctgaagaaggtgcttgaggtctacgaaggccgtctgtcgaagcaggagtacctggcgggaagcttcatcagcgtcgcggacctcaaccatttccccttcacgctccgcttcatggagactccgtatgcgtccgtgttcgactcattcccttccgtgaaagcgtggtgggaaaagctcatgcttaggccttccatgaagaaggtcagcgccgacatgcagagaaaggtctaatcgcatggggtgagggccgggccatgtttggcacgaccacatgacgagtatcccctgatttcctgttccaaacgttggtggatgatgaccaattgaccatgattgngtaataaaggttacgtaacagtaagagtg

SEQ ID NO: 62078 - DNA, 793 bp, Triticum aestivum
  unsure (1)..(793): unsure at all n locations
  Clone ID: PAT_TA_62078
atttcttactacaactctcgatcgcaacaccagtttttctccgcaaatactttatcaatatcataaatcatgtctgactttgatgaaggcgatgtggctggcgctggaggcgatgatgccatgtacgaggatgaggagatcaacgactactacgaccctgagcctgccgatgatggcgagaaccaacaagagaaccaggacgacaacattatcaactctggagacccttctgctatcgcgaacgcggtgaagggcggcgatagactcctgaaagacaagaagatacccgagagcgagcgaaccacaacaccctacatgaccaagtacgagagagcgcgtatcctcggcacacgcgctttgcagattagcatgaatgcgcctgtgcttgttgatctcgagggtgagacagatcccctgcagattgcgatcaaggagatgagggaaaagaaaattcccctgatcgtgcggcgctacatgcccgatggctactacgaggactggacctgcgaggaactactgcagtaagcgaaataaggacaagcacgaaacgaaacaaagcgattgcccgcggggcgcatatacccatgcgaccttgtttagaccacaatcgaactggaacgtcgtgcgctcccctctagcttggcatgtcgagtagtgtaccaggaggttaattaatgttgtataagcgcggcgtttgagattggtttacacaggaactagaaaaacaagaaggaatcacatgcttctatgttcgntgcacgagtgtgttgattgactctagcgaagccgttga

SEQ ID NO: 62079 - DNA, 835 bp, Triticum aestivum
  Clone ID: PAT_TA_62079
accccgtctcccgtccaccaacaacaccatgtctccaaccgtcgtcctcatccgccacgcccaagcattgcataacctccatcaggattacaccctgcctgacccctcactcacaaaggacggcgaggcacaatgcgccaagctgagggagaacctcatcgatacctttacaaggacgtgagtaaccccgatgatatcgctatcgtcgtaagtcccatgcgtcgtactctacagacagccatgctctccatggactggcttgtcgagcgcggcgtgaaaatcgaaggcaacgcagactggcaagaaaattcggataagccttgtgatacgggaagtctgataccatccgtatcaaaagactttcctcaagtcaacttctccaccgttgatcccgtttggcctgacaagaaatcatctgcgggccggcattacgcacataccaaacagtccatccttgctcgtggaaagcgtgctctagaggatcttcacaagaggcctgagaagctcatatttgtggtgtcacacgctggctttcttaggctaggtgtcgttggctattggttttataatagtgactaccgcgtcttcgattttgaaactgagaggaatgccgacggtgggctgagagttgtccagcagaagaggactctcactggtggtctgggtctatcgtgggaggatcctgttgcccttggcggtgatctcccagaggaggatcctgaaaccgatcccagtgctttttagctttcagacatgttcactttgctagtttcacatcaaacggtagaaagattgtatgacatataggaaccgatgtagtttcagtatattacga

SEQ ID NO: 62080 - DNA, 473 bp, Triticum aestivum
  Clone ID: PAT_TA_62080
aggctgctgcgtcgtcttgtaacgagcgacagcccttatgggtctggccattgtcgagctgatcaagttcgattattgttctcaccggaagaaactcgctattgctttgttcatcctctcctggttgctgtaggttgaagagaaaatcacccccagcaaccagaaagccttcaagtcgagatggtgagcagcgggacgttgcccgtgcactctttaatcaatttcttggtctattctttttgcaaccgctcagcagaagcgaaacatggttctgacgggcggagacggggttaatggagtttacattggcgtattattgtgtgcttgaatcatggttttgttatatttgatttatcaacttcttttcaatcggcatgttgccggcagcgtcctcaattaacgcatttctggcaatatagagcttattcctgtagcggtataaacagaatggatcacaattaatgattcttttc

SEQ ID NO: 62081 - DNA, 686 bp, Triticum aestivum
  Clone ID: PAT_TA_62081
agtttcagctagcaacacgtcacaaacacacaaactagctatagcaggttgtcactgatcatgacgatggccgcacgcctgatgctggtggcggcgctgctgtgcgcggcggccgcggccgccacggcgcagcaggcgaccaacgtgcgcgcgacgtaccactactaccggccggcccagaacaactgggacctgggcgcgccggcggtgagcgcctactgcgcgacctgggacgccagcaagccgctgtcgtggcggtccaagtacgggtggacggcgttctgcggccccgccggcgcccacgggcaggcggcgtgcggcaagtgcctccgggtgacgaacccggcgacgggggcgcaggtgacggcgaggatcgtggaccagtgcgccaacggcgggctggacctggactgggacaccgtcttcaccaagatcgacaccaacggggtcgggtaccagcagggccacctcaacgtcaactaccagttcgtcgactgccgcgactagatgaaatgaaagggtaagcaagctatgataagaataaaaggctagctagtagcgggctagctacgagtgagcactgagactgatccatgctgttgaataaaagctaccacgtgttgctgcattgtatacgtgtatacagtacgtacatggaaggaaataaagtggatcgttttcatgct

SEQ ID NO: 62082 - DNA, 636 bp, Triticum aestivum
  unsure (1)..(636): unsure at all n locations
  Clone ID: PAT_TA_62082
cgggaaaaaaanaannnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggtgccaatgccgtatttcaaaatgcagcccccaaaaccctagggccagggaatctgcctaaacttcaaaggtttaaatctgcccttgagggccccattgcaggcctggaaaaaaatccggaggatcaaaatatatatggggttctgttttcctttggaaaaaatcatgggagcttttcacccaatatacccaaacttttacccaaaaagtattgctgctgcactgattctttctgtttgcgcggttctttcaagttcggtatatactaaaaaggaggtaccttcccaagtccggaagctgctaagaaatttgtaacgatgaagcctacccacccccaactgtaaatttcttttttacccaagaaatacttttaaggaggggttgcatatttacagtttgatttaggacaactgaatctggaaggcaaagagcatatttaatttatatatatttttaaaagaccttattaatatactttatcctcggggaaaaaaaaaaaaaaaaaaggcccctaggg

SEQ ID NO: 62083 - DNA, 778 bp, Triticum aestivum
  unsure (1)..(778): unsure at all n locations
  Clone ID: PAT_TA_62083
attcgagcgcatcttcactcaccaagccacacggaattaatagaccagaccgcgcaactacatggtacaagacttcgagcagtctgccgccgctatggactcatcctcgggctgggcggtcgcgccggcggtctccacggccgcaccaaccatgccgatcggtggcatactcaccatgacaggcatctttctggtgttcctgacgttcgccctcgcgctcatcttcctccagtactacttcaacaccagcgtccggaccgcgccgagagggcgcccacgcggcgtgcgtggggtggccgcagggggcgtcgacccggagctgctgcggtcgctaccggtcacggtgtaccgcgcggggccgaagggctccacggacgacgtcggggtggagtgtgcggtgtgcctgaccgagctcgaggacggggaggaggccaggttcttgccccggtgcggccacggcttccacaccgagtgcgtcgacatgtggcttgcctcccacaccagctgcccgctctgcagggccaccgtcggcaagcccgacgcgtcgcaggcgcttacaccgacgagtctcccttccttgccaccggagccgatgaactacgccgggaacctgccggcgatgtaactggctcggggtttcagaccaggcccgncttcgcccgcggtgaccgtngacctctcacggagcctactccagcccctccgccttggccacgnnngnaaagggctgggtgatcgacattccgggactcaggacagtggcgaccccgcgcggcgc

SEQ ID NO: 62084 - DNA, 808 bp, Triticum aestivum
  unsure (1)..(808): unsure at all n locations
  Clone ID: PAT_TA_62084
atctccttcactcgaacagtgatcggcctctcgttgcgcaataggtctttcctttgttctcttgattgctttacggtccctaggggtcgctacaagttctttctacctggcagtctctttctgtaaaagcgccctacctgagcgcccctcattcccccgccatgaacgttttgaagcttcagaggaagtttcctcaattccaacaaaatgagatattcaccttgtctgataccttccacgacttgatgttgacgacaagggatatcttgacgaagctaccgctatcaaggccacgcaacagagcgagaaccagccctacgatgtcgtgcgccaagcgctgaaggaagtcgagcttgattcatcacgacgtgttgagctggaagactatgtcagcctcgttgccaagctccgcgattcctcaccggctcaaaagcgcatgtccacagggcctacttcgtctccaggaggcggaggaggcgtcgttgcacagcgaactggcggtcatgcctccaaaggcagcttaagcggcaaaattcaagtccaaggctccaatgccaacatcactcacaccatcaacgaggatgagcgcactgagttcacccgtcatatcaacgctgttctggctggtgattccgatatcgacagtcgtctaccctttcccacagatacattcgaaatgttcgacgaatgcaaggatggtctagtcctagccaagctcatcaacgacagcgttcccgacaccattngacgaacgtgttctcaacatacccggtagaaaatcagaaactccatgcgtttcacatgagcg

SEQ ID NO: 62085 - DNA, 490 bp, Triticum aestivum
  Clone ID: PAT_TA_62085
ccaccgcgggtctatacagccgacgtttgccgggtttgtcgacaccgacatttcgtccgggaagatctccttgagaagcttgatcgaccgttcggtggttgagagcttcggcgccggagggaggacctgcatcctatcgagagtgtacccatccatggcgatcgggaaagacgcgcatcttcacgtgttcaacaacggggtgaccgatatcaaggtgtccaaactaacggcatgggagatgaagaagccgatgatgaacggcgcctaagtgtatatgctttcttgggagttttggttttggcttagtgttgttttatgtcgacctacaccacgtaactgtttgttcgtctgaatgaagacctctttgagtatgtagaagtggctagagaaatttgttgtacgagcaaaaacatgatgattccacgctgttattaataaagataataaagaccttaatgattttctcccaaaaaagaaaaaaaaggcccct

SEQ ID NO: 62086 - DNA, 233 bp, Triticum aestivum
  Clone ID: PAT_TA_62086
tttcctctatatctgcccggatagtgctttgcctcttcagctatcacggttcctggaaatgaggaagattacccttgcacttcggaccgcccatcattcgcatttcagggttggtctgcggtgcaggcatggtgggatgtctatatggatggcttgtgtgactcccaattcactcaagtggttttttagctccctacatttctatatcatagcaataaaacattttatatccc

SEQ ID NO: 62087 - DNA, 882 bp, Triticum aestivum
  unsure (1)..(882): unsure at all n locations
  Clone ID: PAT_TA_62087
atccaaaggctcggagctcccgacggtctacatcctctgctcattgatcatccggaggagggaaaaccatggccgcccgcctgcaccatttcctcctcctcgccgcgctcctgctgctgatcggcggcgcctcctcagcaggcgacgtcgtcgcggcgggaaacgggaaggtgcgcatggagctctactacgagtctctgtgccccgactcatttgagttcatggtggacagcctcgccagagtcttcaaggacggactcctcgacgccgcggacctcaccctcgtgccctacggcaacgccaaggtcgacgcgcacggcgccatcacatgtcagcatggccccgatgaatgcctgctgaacaccgtggaggcttgcgcaatcgacgcctggccggatgtgaatgtacatttcggtttcatcaactgcatggaggagctggcgatggagtacaagcaccaggagtggcagtcatgcttccagaaacaagggcttcaccccaagcctgtcatggagtgctacaagagtgagcatggccacaagctttcgctcaggtacgggagacagacagatgcgctcctgcctcgccacacgtccgttccgtgggtggtggttgatggcaagccgctgtacgacaacttcggggacttcgtagcttacatctgcaaggcgtacaagggacgtcctccaaagatttgccaacacaaacagccgggccgtgaccatccagccgtacaacaggcggcggaggcagggcaccgtgtcggctacactccagcgatttcgtgctcaatgatgcgtcgacgacaggactaacatggcgcgngccgatgacattgatacctatgcttcctttcnggtccgatcatgtcatatacgtgac

SEQ ID NO: 62088 - DNA, 592 bp, Triticum aestivum
  Clone ID: PAT_TA_62088
aatatacagtctcatatgagttcgagcgaccaccacgatcgatctcgcattggcaagaagttgatgaacacacaaagtcgccctgagtccgcggcaaggtttccaacaagtacacccggcagaataatagcgagtcaatggcagggtccaaaacaagtccttattgcgatttcaaaccaggttgtgcccttgccattgacacagaagtaacaagttcttacaagacgagcctggcttggcgatatcggcgagtccaatacggcaagatcaatctgagaagcgacgaaagaccattaagttgttcggatagatgacgaccaaagtcagcaaacacaggcatgagcatgacactcatgctccacctgaatcgcccccgcagattgcatcagttattttttaatcaatgaatcaactttagacttgagttccatataaaaaaaagcgacgatgtcggaagaccattaagttattcagatagatcatgactaaatcagcaaacaaaagtgtgagcatgacactcatgctccacctgactctccaccgcagaatgcatcagttattttttttaatcaaacgaatgaactctagactg

SEQ ID NO: 62089 - DNA, 446 bp, Triticum aestivum
  Clone ID: PAT_TA_62089
gttcctcgccaccgctcccaggaacggaaccaacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaagggcaagatccaggacaaggagggcattcctccagaacagcaacggctcatcttccctgggaaacaactggaagatgggcggaacccccctgaataacacattcaaaaagaggccccccccccccctggcctggggctggggggggggatggaaaacttcctggaaaaccctccccgggaaaaacaatacccctggaggtggaaagtcctgccaccttccacaaggccagggccaaaatccaaaacaaggagggatttcccccg

SEQ ID NO: 62090 - DNA, 604 bp, Triticum aestivum
  Clone ID: PAT_TA_62090
ttttctgaactatagaatgccggccgggccgggccgctttttcctcctcctcttccaccccagagtccagagctatggcaaagctcgccaaggccaaggagatcgtcgcctccgcttccgtcgtcgtcttcagcaagtcttactgccctttctgtgttcaagtgaagaagttgctcacgcagcttggagcaagtttcaaggccgttgagatggacactgaaagcgatggaactgagattcagtcagctcttgctgaatggactgggcagaggactgttcccaatgtcttcatcaatggaaaacacatcggtggctgtgacgatactattgcactgaacaagggagggaagctggttgctctgctgacagaggctggagcgatctccggttcttcttcgaagaccaccgtcactgcttagctttgtttgcgagttgttgtgatcgacatgttagtgtgttacatgagttgcattgttcccgtgtcatgaaataacgaagttggatgtgtttggcaagttcagggcttgttgctgtctagcatgtccgcagcgactgttaaatctcagtgtaaaactcgttagaaataaagcaaattattttggtg

SEQ ID NO: 62091 - DNA, 514 bp, Triticum aestivum
  Clone ID: PAT_TA_62091
attctacacacagacatctcacacgatccaattatatcctgcttaaagaggaaggtagctagctaggctgcatctttcagctgcgcctggtcaaacatggcttccatggggtttagctatgcgcaggtacatgtgcggcaggagaaggtccggcagaggatcagccaacaaggagccgccaacaactcgaccgtgaagaacaagaacaagagtatcggtgaagaagacaagatcagcaagaaaaactgcgactcatgggccgccgccggcagggtgcatccgtgcgcatcttccacggcggcggcggcggctgggccggtgccggagaggtgaggctggctggcgatgagttttctcttcaggccacaagaggcttgattcgagagtttagtttgtgtttgtgactagtcttagcttctctcaatatttcctcaagggaataaagatgtatgctagtatgtttgcttgtctcaatagtgccaatatttcaacgaccaacaatcaaatatacttc

SEQ ID NO: 62092 - DNA, 787 bp, Triticum aestivum
  unsure (1)..(787): unsure at all n locations
  Clone ID: PAT_TA_62092
gcgtgcgtagaccgaccccccccccccccgcgctctcccttccacgccaccacttcgcgcgcccagcttctcccctctccttcctcttccctccctccgcactccacgcaaaccagagcccgcgcacgcaaccggccgacggcgccaaacaaaacggcacgcgacgctcagcgagggccgcgaggaagcaataacagagggaccggatggtgttcagcggcgcgtggctggcggcggcggcgcgggtgccggcggagctgtgccagggcccgccgcggccggggcagcggcggcggctgcgggccgacgaggtgctgcgcgcgctgctcacgccgcccgcgcgggagctggagcgcctggccgactgcctctacgtcttcttctgcctgccgctgccggagccggaccagtactacgtgccggcgtccgggcgcggcggctgggtggcgcgccggccgcccggcgccgtgctgtacagctaccggcggtccctctcgctctcctccgacggnggctcgtcgtcgtccacgtggatgggcggctccgacgaggaggggctgttgtattactcggacgactaggaaagcagccgtgatgtgcatgtgtactagcgatcgtcgtgtcgggcttgtgttagctaggcggtgctgcccgtttgtccgttccattctttgtagcaactgtataaacgctgtacatattggtttggttggtaagcttcagcgaaaatcaagacggtttttcgcatttggattctttgggttgatcgaacactgtataacagatg

SEQ ID NO: 62093 - DNA, 420 bp, Triticum aestivum
  Clone ID: PAT_TA_62093
tctttctctccaagcccagtccatgaagggctcgatcggctctcggagattacaccaggcatcggtctgcgtcgagttttgcagggccgatgaatccgccgtcccaaagatgggagcaggggccggtctcgagtatctacacccaaccaggaatgatccaaactccagcgcaagaaatggatgcaggttttcaagggccattggcatgcgaaaacaacaaaaagagagagaaaagaacagaaaaacgagaaactgctgctgatggatccagcgaaccgtgtgtggtacttgcaagtgtgtacatatggatgtggttcttgagctgccgtttcacccgggatatgtttgttttttggttgattgatgcgtctgtacaaatccgcagtgttctcttgcaagggaggtggcattattttattt

SEQ ID NO: 62094 - DNA, 675 bp, Triticum aestivum
  unsure (1)..(675): unsure at all n locations
  Clone ID: PAT_TA_62094
aaactccaagaagaacacaatacacatctcagacaatatggcaccattcggaactctttactcttttatgccaaatggcagagtcttcaagattcttgccgcagccaaactcaacaacctcaacattgaggtccctccctaccaacactttgtgactaacaagtccattgaatttctcacaaagttcccagctggcaaagtcccagcatttgagggcgctgacgggttctgtctcgctgagtcagacgcgatcgccagatatgtttcccaatccggaccttatgctggtcaactcctgggagaggacgccgtgacatcagccaagattcagcaatggatttccttctttgctgatgaggtctatccagctgtcttagatcttgtcatgtggagagttggaatgggacagtttgatcaatccactgagacaaaggcgctggctcagctcgaatacgcgcttactgtgttggagaagcacttgtcggcagccactcaacttgtcgggagccgattgacacttgctgacctgactggagcatcatccccttttgtggnggttcatgcatgttgntgatggacccatgaggaagcaantcccaaatgttttgacatggtatttgagcacgattgagaacgatgacgtanaggaggtatttggcgagcctaacttgattg

SEQ ID NO: 62095 - DNA, 423 bp, Triticum aestivum
  unsure (1)..(423): unsure at all n locations
  Clone ID: PAT_TA_62095
ngaatcacccaaaccccagcgcctcaaacaaagccccgctgcgcgtgccccgatcgccgcgaggaaccagcgagagaccccggagccagaggaggaggaggaggaggaggagatgagctactacaaccagcagccacccgtcggcgccccgccgccgcaagcctggccgccctttgctgctgctgtctcctggacgcctgcttctgaggagggagggagggaggaagacgacgatcaacttcgtgcaactgggactgagctatccttctctgacggagaaatgctgctagtagcttaattattatttctcgtcgggcattatcgcctcctttgtttgatccatgtttatgaacctctctgcattgcaactattcgcttggttgtcgactgatgattatgttatgcctggtgccttccgtgtgc

SEQ ID NO: 62096 - DNA, 620 bp, Triticum aestivum
  Clone ID: PAT_TA_62096
tcttccaccacaactctccaatgtctctcgctcctccatcgtactctcctcttcggagcgccctctcaggacaccatctgcctctttgatgtcgacggcaccctcacccccgcgcgtctggatgcttcccccgagattcttgccgtcctccagagacttcgctcaaagtgcgccgtcggtttcgtcggcggttccgacttcgccaagcaacaggagcagctgggcaagcccgctggccagcccgtcaccgctctcttcgacttttgcttctccgagaacggcctcactgccctcaagctcggcgagccgctcgactcaaacaccttcatcaagttcattggtgaggagcaatacaaggagctcgccaactttgtcctccactacatcgccgatctcgacattcctgtcaagcgtggaacctttatcgagttccgcaacggcatgatcaacatcagccccgtcggccgtaacgccagcacacaagaacgaaacgacttcgagaagtacgacaaggacgccaaggtccgcgagaagtttgtcgctgtccttaaggagcgattcggtcatctcggcctcactttctccattggtggacaaatttcctttgacgtcttccctac

SEQ ID NO: 62097 - DNA, 393 bp, Triticum aestivum
  Clone ID: PAT_TA_62097
gagtcaccacacacgtctgcaccgtgtgttcgcgtgctcttgctccgtgtgtccgctcgcgtctccatcttgctcgtgcgggctaccgctccgaatatcggcgtctcgcccgtgctactacgcggcagtggaactcacagcatcgcattgacttactgctgctcgtgatctccgtacgccaccagactcctatctgatatgatctcggatccactccacacaacactggacatcttgcgttgacgcagatgggcctattctggtctcgcgcgggctgctagataatatgggcttcctcttcttacaattgaaaatgttgtcctgacagataataaaaatcgcaatggactgttctgattcaaaaaaaaaaaataaaaaggctccataccggcg

SEQ ID NO: 62098 - DNA, 344 bp, Triticum aestivum
  Clone ID: PAT_TA_62098
cggccccgatctgataccactgaggctggccgtgttctgctgaattttgcatcgctactattactactactaccaagcaaatgagtgtttcgttttgaaggcagaggaaatgagagctctttagctgtataggatgttgcaattgttgctcgtttggtaactattccgtactgagaaataagcagtgtgcttgtcagttacgtatctaggatattgttgaaccaccatgtcgctctaagatgaacctatttggcgtacgccacgatgtcttcgttatcagaccaccattgatctacctcgctatgtacatatcccttatttgaaatattcttccttttccttgc

SEQ ID NO: 62099 - DNA, 627 bp, Triticum aestivum
  Clone ID: PAT_TA_62099
cgggccgctcgagggccggccggggccggggaaatgcaaaaaaaggaaaaaaaaaaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatggccccctcggcccccaaggggcgccccccggggaccccctccccgaaaaaatttttttggggcggggggcccaaaacccaaaaatggggccccaaaagggggccccccgttttaaagttggggggaaaagccgccgaaagggggaaaaaaggggggggaaaaaccccaagggccgggccctttgggggcgcaaaaggggggggtgcccgggggagcgaaaaccccaaaaggggggggaaaatgggcccaaaaggggcccctaaggggggatttttggggaaaagggggggggaaacccctattgggaatttttcaaaaaaccgcgaaaaagggtgtccccccttggaaaaaattcccgggaagtggtttcacaatttttggaaaactaaaaactgggtgtttacctttcccggggcccctgttttccttttttggagggttttgcccccc

SEQ ID NO: 62100 - DNA, 112 bp, Triticum aestivum
  Clone ID: PAT_TA_62100
atattgataccttttgcccctaatggtgtacgggttgagaattctctgctgtaacaacataacaattggctctcatgttagcaactcttcatcacgtactgagtttgatccc

SEQ ID NO: 62101 - DNA, 499 bp, Triticum aestivum
  Clone ID: PAT_TA_62101
accgaacatccagtccctcgcttgctcagtttaagcacttccagctccaaacaatttctggcattccatcttgatcgtttcacctgtgactgtgaaggtgagctccgactctccgaggatcgtccatcagaacttcagaaccatggctgatcacaatggcgtgaagaagagcatcctggagctcatctgcggctgcttctcctcatccggcaccaaagattaaatgacgccaactctggctgaagtgtttttctttcttttgagatagaattgaagtgtggttggtctgtctatgtaacaacggtatgtaatgtagttgatcatctggtatatagttcgtcagatgcttctgcgcttcagttatttgtagtctttaaggtgtactttgtttagggtgatctataaggtgtgtatcgttctaaatgtatcatcagttcagtcgggttttttgcaaaacatatcgatgtatttgagtgataaagcattagcgtttcatgtc

SEQ ID NO: 62102 - DNA, 551 bp, Triticum aestivum
  Clone ID: PAT_TA_62102
attctattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacc

SEQ ID NO: 62103 - DNA, 616 bp, Triticum aestivum
  Clone ID: PAT_TA_62103
tttatcctttctggctatggatctagataatactaaaaaaaaaaaaaaaaaaaaaaaaaaaaaaaaaaaaaaaaaaaaaaaaaaaaaaaaaaaaaaaaaaaaaaaaaaaaaaaaaaaacggaaacccttaacccccccctgacccccgatcagaagcaaaaaaaaccggagttttccctaagcttggagagcaggggaaagaaagaaaaaaagagggggacggggaatttttaggggggtaaaagcttagaaaagcatcaagggggttttgctgggggtgtccgaatgccaaggggccccccaaaaacaactcctgggtttcctcgccctcgccgcccgctaaagatcccagggagggcgccaaaaaaaagcaccctcaagccgtaaaaaaggaagggaaagagaaaaaaaggagcacccttgaccgggccgccagggggtcgccccgcctccccttcctttctcgacccggcctaaggaaaaaaagttggcaaattttcaaaacaatagggcttacaacatacaaccctgaaggttctcttattaccttacccccgggtttgcctcggtggtcccgctgaaaattccattggaacggggcccacgggaacggttt

SEQ ID NO: 62104 - DNA, 672 bp, Triticum aestivum
  Clone ID: PAT_TA_62104
atctgccatcccgcactactacccaacctcgtgcagacctctcacaagcaaagcgatttggaatgagtttgaccacccgtgagcagctgcctccatgttcctcttccttgccgcgatcactgccataacgatggcattgatcccctacgtcaataatgactgtgcctacgcggcgggggcgctcgccacccctatcaacaacgctggcatcctctgcaccgaggagaagtgcaccctcgacgcccccgcgaacaagcgctccgacactctgtggaagccgtgcgggctgcaacttcatgggtaactccgcaagctggcatactgcggactggcgcctgacaatgtcctgcacattgtccggatagacgacgatgaccctgagactgagttgaccatcaggaacaggcagtaattttacaatatctctggcatcgaaggattcattctgacgctgacattctcctgtagcaacgcttccaaactgaacgtgaccatattgtacatagtgacccgacgcctatctctttccgtatgcgatgacgccaaaaaccgctactgtagacgggactgtatgagctaccacgctacctactgcacatgaggaataaggtatcatcgcacactatttgacgggcgtgtaccaccacctttgtcatacgcgtacatacaatg

SEQ ID NO: 62105 - DNA, 787 bp, Triticum aestivum
  unsure (1)..(787): unsure at all n locations
  Clone ID: PAT_TA_62105
atccccatttgtccgtcgccagtagccacagaatccatcgacagagcccagagagagagacagagtactgcacagcacacgccggccgttccatttcgctccgccctcccgccttgccccgttgctgagttcccgccggctcgcccgtaggagcagttcgccgccgttgaagcaccctccccggtcgctcgccgccatgaagaaggttgtgctcaagctggacgtgcacgacgacaggcacaaggccaaggcgctcaaggccgtctccggtctccatggcatcgaccagctgggcgtggacatgaaggaccagaagatgaccatcgtgggcaccgtcgaccccgtcgccgtcgtcggcaagctgcgcaagctcttccccggcgtgcagatcgtctccgtcggcccggccaaggaggagaagaaggacgacaagaaggacgccggcggggacaagaagcccgccggagacaagaaagagggcgacaagaaggacggcgacaagaaagacggagacaagaaggacggcggcgacaagaagcagcaggaggcgaagccgcccatgtccgtgtacccgcactacgcctacgcgcactacgcctacccgccgccgccgccgccgcgctacgtcgtccacagcgccgaggaggaccccaactcgtgcgtcatctgctgatcgacgccggcgcccaccccccttgtacatttcgtcgncgtcctgcctgtcttcctctgctgccggtggttggtggtggctgcaatcatcagcctacccgctgcagcgatcgac

SEQ ID NO: 62106 - DNA, 265 bp, Triticum aestivum
  Clone ID: PAT_TA_62106
acattatcttagatggtctgagttggttaccgtttttatcatctttctccctacgacaggtctcctgtcaggaggtgccaccaacagttgattttatcctctgcctctctactccgcagactgatgatgatgacaaggcctcggctcaaataggaccgacctgtggactgattagaaatcctacctgacctgccatgttgaactgagacagtgttgattttacatcagaagtgttcgttgaaactcacaagaaacgaaagtaaat

SEQ ID NO: 62107 - DNA, 382 bp, Triticum aestivum
  Clone ID: PAT_TA_62107
tatctacgccggtcctgcttaccaggtagaccttgccaaacaggtcaagaaggccgtgggagatagcgttcttgtttcagctgttggcggaatcaagactggacatctcgctgaggaggttttgcagtctggtattgatgttgtgagggctggacgttggttccaacagaaccctggcctggttcgagcttttgctaatgagcttggcgttgaggtcaagatggcaaaccaaatcaattggagcttcaagggacgtgggaagaatggacacaagaagtcgccgtagaccatagatagatgattgttcatcaagactagtctggcccaagccatcttcggggcactagataaaagaactgataaaagtttaaaagacgagact

SEQ ID NO: 62108 - DNA, 545 bp, Triticum aestivum
  unsure (1)..(545): unsure at all n locations
  Clone ID: PAT_TA_62108
cggccgctcaagccggcgggcgggacatatgttcgcgcagctgggacaccgctcgaggacgccgccgacgcaggaatccgtccgccacagaagctgcaaaaacggggtcaccagccaccgtcacggcctccctccccgccattctcacgcgcaccttcatcgcgtcgctgtcgaggccggatctgatgttgccccctctacgtcatcagaatcctgccaaggctttctctcagctttgttctcagcagtgggctctgctgatggttttgtccaaaataaggcatttcaacggaaatcatatggcatgcgtggattaaatcttgaactttgctactaaatatttgtactaaacatggtgtaactcgcttctcagttttgcctcataatcctagctctcattggttgattttcatgatgttgcgtatattttactgaggttatcctctaaaaaacgatttttatatctgtgggctttttagtaatgggcactataacttntctnnnanaaaaaacaaatcaaaacaaactcnaaaccctctttttct

SEQ ID NO: 62109 - DNA, 905 bp, Triticum aestivum
  unsure (1)..(905): unsure at all n locations
  Clone ID: PAT_TA_62109
ggccgctcgaggcncggcccgggcccgggaattcaaaaaaaaaaaaaaaaaaacaaaccttcaacagcctcaggctgtcgcaagcgtttatctgacacgatcaacctcccaagcacaggcaatctgctcgacagtacatatatccggagccatgtccgccagttattggcagtcaacgcaatgtcgcttctggaccttcaccaaggaacagctggcgacaatgcgacagaagcttgaggaagacaatgcagagctcgtgcgcatgttcccgctcccgcagcaacgccatttaaacatatactttaaccagcagttgataaggttggcgaaacgactgacgattcgacaacaatccatggccacggcgcaggtctacatgaaacgattctactcaaaagttgagatccgccgaacgaatccgtatctcgtaatagcgacagcaatatacctcgcgtgcaagatagaagagtcgccccagcacatccgacttatcgttacagaggcgcgacagatgtggggagaccttgtcgccatcgacacctctaaactgggagagtgcgagttcttcatgataagcgaaatgcggtcacaacttatcgtataccagccataccgaacggtcgtagccctgcgaagcgaacttggattgcaagaggacgaggtgcagcttgctcggtcggtgattaacgatcacttcatgacagatctcccgctgctatacccccctcacgttatcgcaatggtagccatgctttctggctttggttctcagacctaataattctggaccaggccagaacccctcaggagcagcggcggcagcaggactggcagcagctcaaaggcgctgatgcgtgcgcagggccagcagactttcagggggagagctacagatgctgcaactg

SEQ ID NO: 62110 - DNA, 627 bp, Triticum aestivum
  Clone ID: PAT_TA_62110
aatataacaatttttcaacgactgactcaatattgatcagatcaagacaaaatccttcacggcaacatgacaacttcgcgagttgaccccgcagacgcactgcagcttgcggccatcacgtttgactggggagatagtctggatacaaaggattgggctcgtttggaagccatacttgccccggagctcgttgttgactacgccgaagtgacaggccaaagctgggacgcaatgccagccaaagacttcatcgccatggtctcagccccaacctttgtcggagatcctctcgtggactcgcagcacttcatcgggggctccaagtacgaagtcgtctcgactgatcgtgttgtcggtaaacaccaactacgagctgcacaccagcgctatactggagctgataaaacaactgtcgaagccaagggtcattgtcatgctttgatgcagcatacctatgtcaaaatcgacggggagtggaagttggcgggattgaagccaaaggtttattggaccgagtttgactttgataagatctttaagagtagttcttgaagatgtttgttattatctcattaagagaataatatagacttttgcttactgcttaatgcagttacagtttccttc

SEQ ID NO: 62111 - DNA, 297 bp, Triticum aestivum
  Clone ID: PAT_TA_62111
cggccgctcgagccgccggcgcgggaattcgtgctcactcccatcccatttccccattcccctccccgctagggttttccaccatggtagtacgtcttacgcgtagtctcctcctctccaggggctctgccctccacgtacgacgctatcgcttcctccgcccggacgcggacggggggagccgcctcccgccgtgcgctggcctcgtcccccgcagcgccgccctgggggtgggcgaggaggttcgcgacgcagaccgcgaactcgtcgctgcgggactcggccccgagctggagc

SEQ ID NO: 62112 - DNA, 763 bp, Triticum aestivum
  unsure (1)..(763): unsure at all n locations
  Clone ID: PAT_TA_62112
ggtgcagaaaacctagcactatctccttcttcgctctctctcctgtggcggccgccggcgagctgacggcggcgtcggccgcctctgcgccacgcagcatctgttcgccccatccacgagcccaacgccaccggagctccctcatccttcatcatcttccccgcgttcgtgcggcgtcgtttcggccaatctacttgtctggtgggcactaggtaccatggcagccgcacatctcttactcatccatacgaacgacgagctccgagctctggccaacatcttcggtacgagtatggtcgagcttaagacactggatgctctgcgtacagctcctgagatgtaccaaacacttcacaccttagtgcgaggacgaaattgggcatgtgatgaactgcccatactgcaaggattcagcgagctcgctcgtaatgttgaaaacctccgtctcctttttcaatctatgctgcccaacgtgatgccatatccagttttagaaggcaatggaagtattctacacacaattgctcacatcaggcttcaaggggctgagattcagcgcgcgaagaaaacgtttaaatttggngggtggagggctccaacggcaagctcacaagcttggcagattattatataatgagttacagagggttctagatggcagcatgcccttgaatgagttccagacccgtattccaacgtatatcactgacattgaccgtttgcttggctcgcggatgatntctgatannagtgtaattaattg

SEQ ID NO: 62113 - DNA, 646 bp, Triticum aestivum
  Clone ID: PAT_TA_62113
aaatgcatctggccacttgcattgtctacaaaattacaaggttaattacagccaccgaaagtagaagcctaacaccgacataattgacaagaagattatggagcgctcctgttcttcttcgaccgcggcaactgtggcaatcttggctctgatgttcatatattgctccttgccatgctcggtggccgtgcaaggtaagcattagatatttcacttgacaatagatcttccagaaggagatcgtccaggagtgggtccaccggcgccgatccctgggtcagggcgccacaggtgccccggctgcgaccgccccaccactccgccgccaccgccgcaccggaagaccctgctggttggtacagcaaacaccccgtaaaattaccaatggtcaagtacgcatgccgttgaagctgtgggcaggagcggtcaataaaccatgtcctgagtttgggcatgcaagctgatcaaagtgagatcattggaggcctttcattttgaaaatcactgagcggtcgatgctatagcctagccagcttctgcctcctgtcttgtcgtatgatggatgactgtgctatatatgtactattatgtgtaattattatttgttccacggcaccttaaaaggaataaaaaatagtttctgatg

SEQ ID NO: 62114 - DNA, 699 bp, Triticum aestivum
  unsure (1)..(699): unsure at all n locations
  Clone ID: PAT_TA_62114
atatgagacctggtctctataatttttttcctatgcatcctgaggatggaacgctgccttttatttgacccagcttcaatctaatcttttattctctatagttgaaaatctgtatgcagtttttgcacctcttgatttttgctgatgattagttgcagagtcatttagccttgcattgtttgacaaatattttgtgataataattgcaacatctgagagttttcagtacgatagttcttccgtttgtgtttattctttttagctaaacatggtgttatttgctttttttattagctaaacatggtgtccttggctgcctagtgccttcctatgatgagttgcaaactttattgcctacattgttcgatcaatcttatgagaagcttctgcaaggactgaggatgaaaaaatgcacgaaaaatccaatattttttctatatatttttattatttacattcagttacttggcttgtggcttttctatctatgatgagctgcacacgttgaaaaaatgcaatttaggattttcttgtaccccacatgttttaaccatacgctaaccgattgattgatttaccttgatcagtgtggttcgtcaaggtcagttgctcctatcaaggctggattcgtggcgcaagttgngcgtcggaaggctggaacttaaaagtgggtagtgcgcggatgctctatcaacgtaa

SEQ ID NO: 62115 - DNA, 518 bp, Triticum aestivum
  Clone ID: PAT_TA_62115
atctcccactttcccggcctgttccgtgaagaagtagatatactacatcacatggggagctgcgcgtccaaggacgacatggcggcgaggccgaggagcgcggcggtgcacccgtgcccgtggattacgccgacggcgctgccggcgcccggccagcaggtcgccgtgcggatgcgcgccagcgagttgcgcgctctgcatgaggccgctggtggggataccagaggcggggacgccgacgccggcatcggccgtgccatcctggacggctgcgtcgccggtcggtggacgtggtcaccagcgtccgcgtcctacttggcaggctagccacccatgctgtgcacgcagtcatgcacatactagacgacttgtgtacataatacagtacatatgaattcgtctctgtacacatagcttcacaaaccacctgatccattcgtctctgtacgtacgtactcggttgtaattaaggaaagacgagttgggtttgtggaacagattacacattcggttggatc

SEQ ID NO: 62116 - DNA, 274 bp, Triticum aestivum
  Clone ID: PAT_TA_62116
gcaatatcgatactcttcctaggcaaaataccacccaccaaaacatctcatcgttaaagctcttaaatcataaaatctcaatggattaccatattgacgggttgttgataaaagaaatccatatatgctctccgatctattactatttgcactgaccatgtttagatgaatgatctccaagagagatgtgtgtatgttagttgggttaccttgacagtaatctatcccagtgacagaaagaaagaaatctattatgttattttcactaaggatg

SEQ ID NO: 62117 - DNA, 665 bp, Triticum aestivum
  unsure (1)..(665): unsure at all n locations
  Clone ID: PAT_TA_62117
accttcccctaccattcggccagcctctcgctctcctctgcccttgctctctccaccgtcctgcgctccgatactcccatatggcaccgttcacgcgcccagccccacgagccaccgactcccctagagttacaccgggacgctacgtcccccagaggggcctggtgctgaagcgggtgctcaaaagcctcctctcgtggctgctgcgccgccgccgccgccgtgccggccgcccctgtcccggcaggggcgccgccgcgccgccgggccgtcgtggcacgtagtactaaccatcaaccaccacctctcctcaactggagtgtatccgtcaattattctgcaggtcaggtcaagtcgtacacgtccggtccgggccggcgtcacaagcggtgacccagctggccgagacgtagacgggtcaacgagtcaagctatcggggttgctcaggatggtggcagaaaaccaagtgttgcatccggcctccggtcgtcagtcaacttaatactattgtttaaaatactggatacatatagatggaccacacgcttactgacggcatctcttgctgttcgcgtggggcgtgcatgtgtctccacgctgtgatagggcatggtattttttcgnntttttcttttatataacacatatacctgttttttcgttc

SEQ ID NO: 62118 - DNA, 464 bp, Triticum aestivum
  unsure (1)..(464): unsure at all n locations
  Clone ID: PAT_TA_62118
tgtcccacctgtccagtgtaacatatattcccaatggttatcaagtttgaaggaatcactttttattcaaagtgctagggaacttgatgagttgataaatgatgtattctcttggatggaattcctagcgggggtgaaatttatcatgtgcatgtaatctttgtgacccaaattgggcgctgccataactctagccatatggtgatgcatagaacaccagctcaatagttatgttatcaagcatcacgggttttgctattgcgacaataaaggatgcatacatctatgataatttggtctctattggggaagcatcaaggactctgggaagcaggggaaagtccagctgccttgtttgatattttgagtggattcattttggtaaacctggaatgcagtatgtttctgactagtgtggcaccaaaaaagacttctnattaatgtgnngcatattgtncgtggcc

SEQ ID NO: 62119 - DNA, 539 bp, Triticum aestivum
  Clone ID: PAT_TA_62119
aaagtaggatcccaccttggttatctctttcacattctccttcacacataatgattttcaggagcctgttatatgattgtggttatttcttttttcgactttattcttttcacatcctttttctttaccgtcacggcgttgatgattacctttctggattatttccagcgagtcccttggcaaactaaactggtggatacgtttcaatctggctgtggccctagatgggcagccaacaggatcgaccgcttgagcggtgcgagacctatacgtttattctcagcgcgatcgaaagtgcttcatcgcgtgactacgatatatactgggccgggtcggtatctggaaggattttcccaggagaggaaaaagaggagtcggttgcatttttatttttatacatccggtacatgacatgaggatgaagggagttcgatgttgacatctgagcatggcgtttttttttgtttctggggtgcccgctcggacgggtcagcgttgaacctccagatcaagaagcgctgtcatcatccatgctttat

SEQ ID NO: 62120 - DNA, 336 bp, Triticum aestivum
  Clone ID: PAT_TA_62120
ttctattcgcctttccgcaccctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagatgcctttccagcgcctggtccgcgagattgcgcaggacttccagaaggacctccgc

SEQ ID NO: 62121 - DNA, 447 bp, Triticum aestivum
  unsure (1)..(447): unsure at all n locations
  Clone ID: PAT_TA_62121
atctcttctcttctcccggtcatctcttgttcaattaagctagtagtattaccggtgtgattaacaaaggagccggagcgtggccatggcgaagatcgacgaggacgggccgtgcgagtttagtctcgccggcgacggcgtggcgtttgccaggagccggagctgcgccgtctccgccggccgggccagtgggcagagggggagggccgcccatgtgcctgtgtcttgatcgattgttgcactgggaagcttgcctcgcgtccagccttcctctgtttttccccttcgacttcgagtgtgcagaaatctgcaatcgtgctgtaaatctagttaagaaagctttgtagagtatgccttgtgctctgttaatccttctcgcaccattctgttctgtctggaaattattctggcgcattcgcttgtagtaatatcttccgcgccannaaa

SEQ ID NO: 62122 - DNA, 520 bp, Triticum aestivum
  Clone ID: PAT_TA_62122
agacctcttccattccactccattcaacttcaatacaaggcaatcagcctccagtactccgctccggtgcttgtgtgtgtgcgttatagactgcactagctgtagtgctttggtctatcttccgtatagatcagtacaccactagtagttcagtacaccactagtagttagggccaacaccaactccctcttcccatggcgcccgcatctgccgcgccgtcggaccttgccggctgaaaccccctgccactccttgcacgcgcctcgtgcgtcgcgacgtgagctgcacatctcatggctgcaaccactatggtcggccgctggttaaatcctgagtgttttttttcgtcgcctccacctcccgaggtaacggcctcgtcgccggctgctcacgtctgccactcctttcacgagctccccgggccttgctcctcctctgttggtcgacttccgcacaccctttgacctcgtgaccggctcccctgatgcgctgctgcaaaatctgcctcccctccggcca

SEQ ID NO: 62123 - DNA, 845 bp, Triticum aestivum
  unsure (1)..(845): unsure at all n locations
  Clone ID: PAT_TA_62123
agacctacttactcatccaccatcatcagttcatcacagcacgaacgacatggctgctgctccggtggttgtgccgcgcatgaagctgggctcgcaggggctggaggtctcggcgcagggcctcggctgcatgggcatgtccgcggcctacggcgagcgcaagcccgaccaggacatgatcgcgctcctccgccacgccgtcgccgccggcgtcaccttcctcgacacctccgacatctacggcccccacaccaacgagctcttactcggcaaggtaggctacctccttactacagccacccgacgtgttccttggctcctcgctagttgccattcgcacgcggatgtctgaccggccagagttctccgtgcaataaagcaggcgctgcagggaggggtgagggagcaggtccaattggccacgaaatttggcatcacggccacctgggaggtccacggcgacccggcctacgtgcgggcggcgtgcgagggcagcctcgcccggctcggcgtcgactgcatcgacctctactaccagcaccgcatcgacaagaatgtccccgtggagatcacgatgggtgagatcaagaagttagtccaagaaggaaaagtgaaatacgtcgggttgtcggaggcctcggcgtcgacaataagaagggcacacgcagttcatcccatcaccgccgttcagctggagtggtctttgtggtcaagagatgtcgaagaagatataatcccaacttgcagangacttggcattggaattgtagcttacagtcacctaggcagaagttntctatccagtggacctanactagtggacacattaccagaagacgatttcc

SEQ ID NO: 62124 - DNA, 652 bp, Triticum aestivum
  unsure (1)..(652): unsure at all n locations
  Clone ID: PAT_TA_62124
cggctgcttccctatcaactgcgtgcatctcagatcctgaaggtgatccacaggaagatttccctcgtcgtttgtccttttttttgcatcgaaccaaggattatactatctctttacaagggctctagccgacgttgacgtgttagggtccatgtccgatttgccacaagctccaggtcaggttggatgttacgttgctggcaaggggatgacgggcgaaccaagaacagtctgtgcaaggccggggccctactacttcgagcgagccattggtttcaattaggtcctttacgctgtttttcttctaatcttgttgagctggcgggcttggtatctggcatggtagacaagtcgacattcggttatgatcgggcatctctagcttgatgactcgactcatgcacacatatcgtggcttctcatgagcagatttcatgtatcatgacaactcaaaaaagttttttttgcgattgaagtttagttgaatcgtgtttgggcaaacaatgctaggatcgcaaaaagcaaatctcatatcctagctcagaacgaaccgaggctcccctggacaattcgcccgaacagtttagggctcgcgcatctcatgacaacggttgatcgactagnnanaaaatcagaaaaaaanntaataaaa

SEQ ID NO: 62125 - DNA, 354 bp, Triticum aestivum
  Clone ID: PAT_TA_62125
aatatctaagatgatatgatgaggtgagagcaacatctgcaccgatgaagcaacaccattcgacaccccagttctttacacttgcagtctggtctgggcaatgtcaattttcccaggtcagaggcttaacgccaccaacatactagaatcgatgacttggtattttgagggggacgatgctcccaacagctcagcctaactacctaggtatctcctcagtgtaactgcctttaggatgtaaggtcgaatcaattccgtattggcagatctatctaggctggatctcgacctatactgtactagcggagtcgctgcaggcactctacctagagtgcctaatctatctatccatgc

SEQ ID NO: 62126 - DNA, 888 bp, Triticum aestivum
  unsure (1)..(888): unsure at all n locations
  Clone ID: PAT_TA_62126
cttgtaccccagaactcaccgagacaatcggtgttgtgaaggcttacacgacccgagttggccagggagctttcaagacggaggacactggtgagatcggaactaagctccaggagattggacgagaatggggaacatcgaccggccgccgacgtaggtgcggatggctcgatcttgtcgttgtcaagtacagtgcatccatcaactactattctgctttgaacctcacaaagctcgatgttctggatacttttgagacaatcaagattgccattgcctacaaggttgacggagaggaactcgaccactaccccgctgatctcgacctcctggagcgcgccgaggtggtgtatcacgagatgcctggctggcagaagccaacaactggtgcaaagacgttctacgaccttcctaagcaagccagagagtacatcgagtacattgagaagtttattggggttaaggtcaagtggattggtaccggtcctgaccgcgaggccatgatcgcgcgcgcttaagcgatcgcaattgtaaatggtgttgattgcacgcacgcatggcgtcttttcaaccatagagcctcccagacaggctacgatagctcatttagttgaagttatggatttgggaacagtttcagttcgttttctgagctaacaaaatagacttgcggatttcttgcggattcgggtgtcgcgaacgatgatccgcagtaaactggataatatcagtcgaaaacttacacaacagtcgatgacaatcggncgtctcttgaactttcagattacccatatacatacngnncgaaagagtcgtaatcgagctggtgntgngatgaactgaccttacatagcataacacaagtctngaaanaattgctataccaat

SEQ ID NO: 62127 - DNA, 154 bp, Triticum aestivum
  Clone ID: PAT_TA_62127
tccctctggaacctattttgttttctctttgtcattattgtgtgtgggagagagagggacctaggatgatggttcatattaattgtttttggtatacagaagtggtgtatgcaaatgaatttcaacattaagctacaattttttctcagttaac

SEQ ID NO: 62128 - DNA, 844 bp, Triticum aestivum
  unsure (1)..(844): unsure at all n locations
  Clone ID: PAT_TA_62128
gcttcactccgatacttacgcaacccgaaactccgttgatctcagctaataatttattcgtttgttttaaaagtatacaagtggcaactctgccctccagatttcttccccatattccccatatttgatacttcaactctactcatcatgtctaaacccgttgtcctggaagacgttaccggcggtagtgtaaatgcaacgcatctctgtgtattagttcacgggctttggggaaacccatctcatttgcgcaacgttgcgaaatcccttcgcgataattactctgaagacgaattatatatccttctcgcgaaacagaacagcggcaaccacacttatgatggcatcgagactggtggcgagcgcgtttgcgcagagattcagcaagagttgaaagacattgaaaagaagggtggaaagatcacaaagttgagtatcgcaggatactcacttggaggtctggtatcccgatacgcagttggtttgctttatgcganaggagttctcgatgatcttgaatgcatgaactttactacatttgcaaccccccatctcggtgtaagaacaccactaaaggggtggctcagcaatatctacaacgtcctcggcgccagaacactatccatgtccggtcgacaacttttcaccatcgatagctttcgcaacaccaaccgacctcttctcgcagttctcgccgaccccaattccatatttatgtccggcctgaagaaaattcagcgcccgactctgtatgcgaatattgtcaatgacccgagtgttgtgcattacacatctggcatcaataagacgacccatacacagatctcgancacgtcaagctcat

SEQ ID NO: 62129 - DNA, 228 bp, Triticum aestivum
  Clone ID: PAT_TA_62129
gtcttcccagatccgaaagatcgaggccagtcgtgagattgccgccactctctcatcaaaccccaacgttgcctacctacctggtggaagcggaaagcagggtggccagtacctgctgtcagtgggcagggcttaaagtaatggaatgtatgatgtaaagggtgttgaggaaatgaaagggaactccccgcttatcgttggtaatgaaagtatttgttcatgagcgct

SEQ ID NO: 62130 - DNA, 720 bp, Triticum aestivum
  unsure (1)..(720): unsure at all n locations
  Clone ID: PAT_TA_62130
attcctgcggtttcttccttgcccatcgccggttccctgagctcccgcccgccaacgttcgtcagtcggtcagtgccggccgggttggagttggatccatggcggagaagaaggttgtggtgaagctggacgtgcacgacgacaggcagaagcagaaggcgatgcaggtcgtctccaccctccacggtatcgaccatatcgccgtggacatgaaggaccagaagatgacggtcatcggcaccgtcgaccccgtcgtcctcgtcgaaaggctgcgcagcaagttccccacggcgcagatgctcaccgtcggcccggccaaggaggagaagaaggacgccgccaagaaggaaggcgagaagaaggagggcgacaagaaggagggcgagaagagcaagccggtggtgtacccgcctccgtactggtacccgccgccgccgtaccaccacgcctgcagcggcgaggaggaccccaactcgtgcatcatctcctaatcggcgggcaccgccgattgcctcctctgtacatttttgtacctggccgtgtgctgcttgcctggcgatcgatcctgcgtgccacggtgatcgacgagggcatgcgctatacataaggccgtgtaaggatttgcgncggtaatctagtgagtttataaattgcagatattaaatgggatcacagtgtggaggaaaattaaatagaactgcccacttgggattttcagtg

SEQ ID NO: 62131 - DNA, 470 bp, Triticum aestivum
  Clone ID: PAT_TA_62131
gactcccgcgctcgttcaagcttacgttccttactcaaaccgccaaaatgacccgcgcccagcagaccatctctctcgccctcctcgtctcctccctctaccttgctctcttcctggagctcatccctcttcctcccctgatccaggagcagatcgtccctgtgctccccttctgggcactcgtgtcctttggcgcatacctcctcttccgactcggcttcggcatcctcaccttcaacgacgttcccaacgcgcacaaggagctcacggcggagattgagcaggccaaggtcgagctacgaaagctcggcgtcaccgtcgactaattgcctaccgaatgaactacgatgatctagatggggcaaaaagggggttggatgcattttggctcttggggcctaatcaactttaatctacaataatctggtatcttgctggtgtggcccgcgcgaaaagatttcctttacacc

SEQ ID NO: 62132 - DNA, 541 bp, Triticum aestivum
  Clone ID: PAT_TA_62132
atcttccgatctcactctactctctcttctatcttatctctaaccgtcaaaatgggtcaagtactcgatgcccaccctacaaaggccttaggatgacgtggactactacctaaatacacccatgccatcgctgccgcatccaagtggggaactttagggtctcaagagctacaagatccgtgaaatgtccgaaccatggtgtctcgctcatcagagttgccaggcacactactcccaggtcgggagagggactcagaggctctcttgactcagacgtgccaggaagaccaggcgtgctcgagagagatctgttgtgatatatctgagacactttaaacaacgccataaccccatgatctctcaacaggcccgtgcctgagtagctcacacaaagcagcttcaaccttgcctaccgatatgatactaccgtatcgcggcgccatcaataccacatagtctgacctgcgtagactcacccacaagtttcagaattgcctgcagactttcgctatctgcatgaatgcccggtctatctctgctg

SEQ ID NO: 62133 - DNA, 879 bp, Triticum aestivum
  Clone ID: PAT_TA_62133
aagctctcgcgcctcgggacagacaacatcatctctaaagcttctctctctccgccttgtgacacgttctcacctcccaaaccagcctgctctcgtcaccaatcgcatcgcaatcatgaagattctcacaaaggaagaggaggaggcgcattactcggccgtccttaagggtggcttcattggaggcagtcttggtctcacagtcggtcttggaggtgttttccttgcctcaaggcgataccctgctttccgcggcctcactcttcccttcaggaccttcctcgtcacatctgccggtactttcggcgccatcatcaacgccgatcgctggtccatggatttccagaagaagcagaaccccatgaacttctatgaggaccagacccagcgcgcgcagcaaattgttcgcgagaaccagaccgcaatggagcggttcatggagtacggaaaggagaaccgctactcaatcgtcttcgtctcatggctggcttccatgggtgttgcctttgccatggtcagccgctcgcccatgaacacagccaacaaggttgtccaggctcgtgtgtacgcacagggtcttactcttgcggttctcatcatctctgcaatctttgaggtgaatgacgccaagaagggtgagggtcgctggcagaccgtcatggtcgtcgaccccaacgatcccgaacacaagcgtcttatcgagaagaagatcacaaggaggagtatgagggccagggcctctggaaggatatggttgctgctgaagagcgacgattgggcgaaaagagcaagcccagggagtaagggctaatgagcctctgcctctggagcgataacctacctattcaaatcattcgcatcacacataatccctgagcg

SEQ ID NO: 62134 - DNA, 586 bp, Triticum aestivum
  unsure (1)..(586): unsure at all n locations
  Clone ID: PAT_TA_62134
acactgccttctggaccggacagcaccgccgctgctgcggctgaactggaggggtggctccccatgctacgcgacgcacgacccgacccggcccactccctgcctccgctcctccagtccggtttgccttgagcgtgttccaccattgcgcagcacccaccctcctctccccccattaaaaccccgccccgtccggcaggccaaggcacgcatacacacacgcgcctgcctgcgatctgacgccaccacaccggccaaggaagcaaggaacctgctccatccatggcgtcccacgcgggccgcctcctcctgctcctcgcgctggacgccgcgctcgtctgtcgctccgcaaaaggggcgtggtgcgtgtgccgcacggacctgccggacgcgacgctgcagaggacgctggactacgcgtgcggcagcgccgccgactgcaagnccatccagcccaacgccgcctgcttcgccccggacaccgtcaaggagcactgctcctacgccgtcaacagctactaccagcgcagcggccagaaatcgctcggctgcgtcttctccgggaccgccgtggtctcctccgtcg

SEQ ID NO: 62135 - DNA, 572 bp, Triticum aestivum
  Clone ID: PAT_TA_62135
aaaatgattctcactgacacacagacaataccctatacaacccatcgccatcatgcttgctacaccgaccctgtccaacttcgacaaaccctctcttccatcctcggagggaggtgatcccgcccttgcagctcgcttgcaaccactgtattcgaggtttctcacggatcttgatctacagccggaatatagacgtcacgaaagcgagaagcttatggaggaggtgctcaaatttgcgaagagtactggtgtacctcatgatctcaactcccattcctatcaaagtctcatggttggatacacatacgccgataactgcctcccatatcatgacattgaagtcaagggttatgtagccatctacacatggctggcaactatttgcgatgacgccgaggcactaggcatcattgatgatgttcaattgttcgaacaacgctttattctcggagaggaacagactacggtcctcctcaggggttttgtcgaccaactcaaactcacctataagctgtaccacccccctgttgcgaaactgattctttgctcctctctgaatctgctcacttcta

SEQ ID NO: 62136 - DNA, 517 bp, Triticum aestivum
  Clone ID: PAT_TA_62136
cttcttactgttcaagaatgatgcttcatgatgtaaagatgttcactttaagtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaacaaaagaacaaaaaaaggcccccccgcccccccgcgggcgccctccgggaaccttccccccaaccaatttttttgggggggaggggggggccccaattaacccgctccccaccggggggcccccccctttttttttgtggggggaaaaaggcggaagggccgggaaagaaggggaggttatttttttggaggggccgctcgggcggtctctagggaaggggcactcctggcgggattaacccccccccccgggcttatttatccggtccttggcgggccagggggcacttccctcccaaggggggggggaccccccccgtgtttgttttttttccaaactccaataaag

SEQ ID NO: 62137 - DNA, 522 bp, Triticum aestivum
  Clone ID: PAT_TA_62137
atctcagcatctgcagcccgccacacatcccacccaaacttaacctccccacacgctcgaaccagcggcacccatggcacccaaggcggcggagaagaagccggtggcggcggcggagaagaccccggccgggaagaagcccaaggcggagaagcgggcgccggcgtccaaggaggccggcggcgaggggaagacgaggggcaggaagaagggcagcaagggccagaagggcgtggagacgtacaagatctacatcttccaggtggtccaggaggtggacccccacattgggatttcctcccagggcatggtcattatggacttcttccttcacgacatttttcaaaaacttccccgggagttccgccaggttcgccccttccacaaaaaagccccccttcccttcccggagattcaaaacttccttcggcttcttcttccccgggaggttcgccaagaaggccttttctaagggaaccaaggccgcacccaagtcacccccttcctaggttcctccgccgt

SEQ ID NO: 62138 - DNA, 409 bp, Triticum aestivum
  Clone ID: PAT_TA_62138
cgccttcaaggccgatgagaggatcagcttcaatggatgcaggagcttcatgctctggcagaagaccgtcgccgacaacaatgggtctgagccggtggtggctacgacggttaattcttccccaggcagaaaggggatcagcggctggaaatttggcctaaacaagatccttctcaacttcagcttcaaggtgtgagccatcgatgagttcaaatacaataagtgcgcttgattcagcgaatcattgctgtaatcggctgtcaattttactgcattgggaagtctgttgcttcgttttttttttggttcagttgctgtttcatcgtcctccacatgtaatgagattatagttcgaatcatacattcagaattgtccaatgtgaaacttatatgcattgaagttacattc

SEQ ID NO: 62139 - DNA, 404 bp, Triticum aestivum
  Clone ID: PAT_TA_62139
atccttacgtcaaaatccattcacaatgtctcacgtcgagatcgcttcgctctacacggacctgatcctcgccgactacggcattgagatgaccgccgacaagttccagaccctcatctaggtcgccaacgtcaaggaggttgaggccatctggacctccatcttcaccaaggttcttgagggcaaggatgtcaaggaccttctcgtgaacgtcggttctgatgtgcggtgatgcccctgccactcggtggtgccgccgctgctggtgatgccgaggaagctgctcctgaggacgtcaaggatgaagaaaacgaggagtctgacgaggatatgggcttcagtatcttcgactaagcggttacgtcgtcacgactgattccttgctctttgtacttcgactgcat

SEQ ID NO: 62140 - DNA, 623 bp, Triticum aestivum
  Clone ID: PAT_TA_62140
cactatcccatccagccccctcacatctcgccggaaaatctcctccgacagatcgaagcgaaggccatctcgtcctcctcctcaagatgcagatctttgtgaagaccctcactggcaagaccatcacccttgaggttgagtcctcggacactatcgacaacgtcaaggctaagatccaggacaaggagggcatccctccagaccagcagcgtctcatcttcgctggcaagcagctcgaggatggccgcaccctggctgactacaacattcagaaggagtccaccctccaccttgtgctaaggcttcggggtggcatgcaaatcttcgtgaagaccctcaccggcaagaccatcacccttgaggtcgagtcatctgacaccattgacaacgtcaaggcgaagattcaggacaaggagggcatccccccggaccagcagcgcctcatcttcgctggcaagcagcttgaggatggccgcacgctcgccgactacaacatccagaaggagtccaccctccacctggtgcttaagctccgtggtggcatgcaaatcttcgtcaagaccctcactggcgagaccatcacactggaggttgagtcgtctgacaccattgacaatgtcaag

SEQ ID NO: 62141 - DNA, 316 bp, Triticum aestivum
  Clone ID: PAT_TA_62141
tcattcgctaaactgaagaaatggtagagaagagtcaagggcagactgccagattaagtgtacgagactccgcaatgaacccctgtaatcatactccctccgtccgaaaatacttgtccaagaaatgaacgaatctagatgtattttagttttgtatacatccatttgtatccatttcttcgataaatattttcagacggagggagtatttcttagccagaaaataacatgtaacaaatctcgtactctactatccaatccggtgagtgttttttccttttggcgcataaaggaatgaaagtcctcaggtttgtac

SEQ ID NO: 62142 - DNA, 644 bp, Triticum aestivum
  Clone ID: PAT_TA_62142
atctcaccacaacaacgcagagatttctaccaccggaccgcatgagagaagagagagatttgcacgaaaacttcatcagaaaccatgaagagtcccaagctcgtgatgatctctgatcctaccagggcggcctggacatgggagtcctctcacacatgaacgccgattttttccccaagtgctgcaacaactgtaagttcttctcggaggcttacgtctgtgaccagattgaccacatgagctctcgagccctgctgcgcgaggcgcggggaggcgagtgaccccgaaaagagtggctgctccatcatcaaatgccaccaacccccttgccgcttccgcctgcagcatcagggagtgactacgccatcgacgtcatgacgaaacgtcgtgccacgaatccgactccgtcaagaacgaccagaaggagattgctgtctgtgtcaaggagggcgaggatgactgctgataccacgatgaggtcaactgggcctaggagaaggtttaaatatgacaatgatacgacaccctaagcgacggaatgcaaaagaacatagaagagtaatgacttcatctgtgtgggcatatctgaatcaagacaaaatcttcccgaacctaagaaaaaaaaaggcccgtaggacctcaag

SEQ ID NO: 62143 - DNA, 792 bp, Triticum aestivum
  Clone ID: PAT_TA_62143
attcagaatgcggccgggccgggacgcaggtatcggccgtttccgcgagcctgcacccgcgcgtgcaaactctcgagcaggtctctcctccctcggtctggcggctcgcatttcccctgctctcccgacgctctttcctctgtgcgacgctggtggatctcgccgtccctgatgcatctttgccgccgcatctcgtcaccggtgccaaggaagctctcctctcttcctcctccccaccgtcccaagctccggtcctccctcccatcccccagcctggatctcgccgtgcctgcttgtcttcgcccgatctggccgtcacagcaaacacgagattccggcgacacgtacacagcgcgccctcgctcgcggacgcccgccggatctggctgtgagagctgccgcccgcccgatccaattgtgaccttgctgctcgatctcctgcttggtacggccgctggccttgtaacgacagaactgcttcgctccttgattcgactgacaaagaatgagacagcatctacttagagaaagaagaacaagagataaacatctgaatctacaacccgacgggcgactacctgagccagagcccatactaggatatgaatgcattcgtgcatgtacgcatcagagcggatatttgcataaagaataaagccgaaatcacactcgtgataagatgtgaaactttagcaggagaaattcaagaatggggaattacccttcagcaaagttgactatcattgtagggccctgctatgcggggcttatgaatggaaataaagctttaat

SEQ ID NO: 62144 - DNA, 528 bp, Triticum aestivum
  Clone ID: PAT_TA_62144
aactacacttcaagctcgtcatttcatccatcactccatccgacgtacgtagatttcggcccgtctgaaacactcgctcaaccaatccgtccaaccgtacgtactcggagactcggaagatttgcatggcgtcgtcggcgacgatggcgaggacggtggtggtggccttgctgctgacgcaattctgcgacgtggttctggcggcgaggctgctggaggggggcggcgcctggctgcagggcggcgttggcgccgctggggcgcttatcatgcacatcctgcccggcggctctccgggagcgggagcacccaacggctgcaccaacaacggctaagttagccgccggccggcagagctccattagtcaattaggatctagtaccttctgcacatgtgtacatagagttcgtgttcagtgattcatccattcttttttggaaatccattgattctttctttctttaattgtaattagagagcttccgaaatggagccctggagcagttcaattttcagttatcttttgc

SEQ ID NO: 62145 - DNA, 621 bp, Triticum aestivum
  Clone ID: PAT_TA_62145
caattcaacctccccaattccatccccattccccaaaattttccccaccggcgacgacgccctccccaaatccgatccgccgccgccgccgttgacgccagccatggccgccgccgcccgccgcgccctgctgctcctcctcgccgccgccgcggtggtcctcctcgcggcgcccccggcgtccgccgcccgcccctgcggccgcgcgcagacgctgctcatctccttctcctccttctcccgccccaacccggacccggatgacccctcgccgctcaccaccaccgacaacaccgtcctccgcgtccgcaacctcgacccgcaccgctttttttttttcaaccagaaccacctccagaacaacagccccgacaagtctcaacccgccgatgctaccccagaaaccgatctccgagacatcaagcaccgtataaaaaagagcaaagatgataataaggccaataacgcagaggtgaccaagtcccagaactcacaggcgggaaaggacgccgtgcaaaaggcctccaaggacccaaagattgacggagacggcggcaacccttgaaatttgattaccccatacacacagagctgtgctgcctaacctgggttcctatccta

SEQ ID NO: 62146 - DNA, 590 bp, Triticum aestivum
  unsure (1)..(590): unsure at all n locations
  Clone ID: PAT_TA_62146
aaaccaccacaacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccnnnnna

SEQ ID NO: 62147 - DNA, 850 bp, Triticum aestivum
  unsure (1)..(850): unsure at all n locations
  Clone ID: PAT_TA_62147
aacgttactgtacctcaattctntgggcctcattcaacagaccacaccactcctccaccccaataccgcagccatggatattcgactcctcacaaacgcagacttgcccctcattcagcatgcaaacctcgagaaccttcccgagaactacttcctcaagtactacctctaccatgccctctcgtggccccagctgagctacgtcgccgtcgatgtctcaaggcccaagaaggacccatacgagtaccccaagattgtcggatatgtccttgctaagatggaggaggagccgtcagacggcattccccacggccacatcaccagtctgagcgtcatgcgcacacaccgaagactcggtattgctgagaagctgatgcgccagagtcaactcgccatggtcgagacattccaggccaaatacgtctccctgcacgtccgtgtctccaacgcagcagcccgccatctttacgagaacacactgggtttcactaacgagaagaccgagtccaaatactacgccgacggcgaagatgccttttgcatgcgtctagacctcggtgacatcaagaagcaagtcgacgaaaccctcgccgcagaggaagcggacgccgcggatgagggtgacgccgtgggcgaggttggccgtgatcccgaagctggcaaggacaaggaggacggcgaaggacgaaagatgaaggtcgccgtggggagaggattgngagtcggatcattggtagaaaagatgagtcnaagaactaaacaagtaaaaaggggaaaaatgaaaagtcacgggacaatttgttcgaatagacggatagataaaaggggtctaagtccggatgaacacatt

SEQ ID NO: 62148 - DNA, 435 bp, Triticum aestivum
  Clone ID: PAT_TA_62148
gatcatgcatctcgtctatcctccatctcatttcttgcttgcgagacggatcagaaaaggttgaaggagagctagagctcgcgagcgggagcaaggaggaaggcagtcgtcggtcgggggaggttttctgatggggaacgtgcggcgtcgcggcacgccggggagtcgtgggccgacgacggcgagtgggaggaggcgtcgtccacgtcggatgacgaccaccaccgccgccaccaccatcacgacgggtcggaggagcacctgtcggaggtgacgatcaggatcaccaagaggcagctgcacgagctgatggagaggaagacgcccggtggtctgtgtagcagcacccggcagctgctggccaacatcatggactccggggaggtgctccaccatgacgtgcaccaagaatagcactgtaggtccgctctgcgg

SEQ ID NO: 62149 - DNA, 723 bp, Triticum aestivum
  Clone ID: PAT_TA_62149
cggccgctcgaggcggcgggcgtgattcattcttcccgtaccaaaactcagcctcgtcttcaatcgtccgcggattgcatttgcagccacatttgttgcgcaaaacttaatcttttacagataaaaacaagctcgactctcacaatgctcacttctgtggggagggccgccgctcgtcgcgtccagacatcccgcatttctgctcccacttccgtttccgcccaattgatcggccgccagaacgctgttgccgccgcgcttcctattcgaagcttcacagcctcaacatggtcgtcctctcctaccgcgagtgataagaaacccgccaagaagaccactaccaccaccactaagaaggctgctggcacgaccactaccaccaagtccaaggccaaggccactgagaccaagtcgaaggataaggctactaaggctaaggctaaggctaagcccaagtccaaggctgttgaggaaaagcccaagaagctcaagaaggaggtcgaccctgagaagctcaagaagcttgagatcaaggaagtcaagaagtggaccctcaaagacaagcttcctaccctgccggcttcttcatggatcctcttcatctccgagaacagaggaagcagcacgggcgctggcggaatcacccagcagaccgctgcaattgcagagaagttccgtcaactgagccagtctgagctcgaagacttaacgccagagcctctg

SEQ ID NO: 62150 - DNA, 839 bp, Triticum aestivum
  Clone ID: PAT_TA_62150
aatttctgttcatcccctgaaatagcttagattgtcctgattcggcatctatctagcttcttggctcccttccttctaaactttattatctccgaaattaccgactccctggatcgcatcccactttacccctctcatcccgccatcctcgacggcagttgacagatacaccaaatcgccagtctgccaagatctctcatcaaactctatctcacaagccatggctcccctgtacaaaaagaccctcgtgctcggtgcctcgtcaggcataggggaggcccttgccgccaagctcatcgccacaggcaccaaagtcatcgtcgtaggacgtcggcgtgacaatttggaatcttttgttagcaagcatggtcacgaaaacgccagggctgtcgtgtttgacgtcaccaatctgtctgccattaacgagttcgccgaacgtatcatcaaatctgacccagatcttgattccgtcgttcttaactcgggcatccagagaggctttgacttttgcaaccctgaatctatggatctcagtgttcttggcgatgagcttacgaccaattatacatctgccgtttatctcaccgcagcgtttattcctcatctgaagaagcaggccagcggacatcttatctacgtcagcgcaactctcggtctgattccctccatggtgcgcacgcctaactacaatgcttctaaatctgcgctgcatacgtttattcttaacgtgcgtcagcagcttgttgatggcggagcagggcatgtacgcatggtagaggtgtttcaccggctgtgcagaccgagttgcacgatgagaagcaccagcctgatcttgtcac

SEQ ID NO: 62151 - DNA, 251 bp, Triticum aestivum
  Clone ID: PAT_TA_62151
cggccgctcgaggcggccggccggggttactcggctcggcctagcgcgcgaaccctaccatgtgcccttgtcccgtctgagcgggaatcgttgtcgcaagctcacgggcgcccgcaccaccacaccgcagcacagcgcaggcggctttcagattcagttggcgctcggagctctgaagagcgcaggggagaagaagaagtgtgtagattcctctaggaattgtcctggagttttggcatcggagagagagg

SEQ ID NO: 62152 - DNA, 863 bp, Triticum aestivum
  unsure (1)..(863): unsure at all n locations
  Clone ID: PAT_TA_62152
ggatctcccatccattttgcacttgctcacagagtcatacggagtcaccgcacacgtaccataccagcacgtcgtcacaagggaagaaatgggctcgtgcgcctcgcgctcgccggcgtcggtagtggcggcggggtccgggcgggcagtggccaccaagacggcgaaggtgattggcctggacggttccatggcgcagtacgtggcgctggtcacggcgcgccaggcactggttgacgccgcccgcgcgtggagcttcctgtgcagctccgacgagctccgcctcgatgcgcccgcccgcgcgctggccgaggacgaggcgctccagcccggatgtttctacttcgtgctgccagtgtctatgctccgtcggccgctctcggggcaggagatgaccgccctcgccgtcagggccagctcggcgctggccgtggcgagcggcatctcgtcccccacgcgcggcaagaacggagccgcgctggctggcgccaacggcaagcgacgcaaggtggcggctcgagtggcacctctcgctcacgatgacgatgtcgcggagcgggacggtggatgggaccaacaccttgcgtacggcaaatacggtggcgtgcccaagagggtgctggccgccggcgatgtggcggctgggaaggcgaggagaggagatggttacggtggaaggcgcagcagccgccatcgtcgtcgtcgtgcaggcgcgcaaaggttgagcgcgattttggaggccgatgacctctgagttcacaattctcgggagtggttaatttaattccgtattagttagttggttctgtccgtcgatcgacccgatcggcccatgtatataccggaaacanccaattttttga

SEQ ID NO: 62153 - DNA, 862 bp, Triticum aestivum
  unsure (1)..(862): unsure at all n locations
  Clone ID: PAT_TA_62153
aactctcctcaattcgaaccagcaatgaagtcatgcgaccttctcacgcaaacattggcttctggctgatatggttcatcgctctgctatggagctaccgaaacggctacgatgacccctcatccttcttctacaagagccgcatcgccttcaaccgtcgcttctccgctacccgcgaagctcaggtcgacgagtacctcgaacgagaaatctaccccgtcaagcataaacagcgcaccgaagtccaggtcgagaatgagttcctctgcattggaatcccgagcatcaatcgcacctcgtccgcctttctcgcgcacacggtcggtagcctggtcgacaccctgaccccgaatgagcgcaatcaggtacacattgtggtactactcgccgacaaagatcccacgaagcactttgcctaaggaaaggattggctatttgggcttgcggacgatgtactcgtttactccaacgacagctccgcagcgaaagccggaccagacctcgactacacagtcctccagcacgacatccgcggaatggggcgtagcgacgaccgagtcgagaatatccgtctagaccactccgttcttttcgaagcctgccgagaccgagacccgacgtactttgccctcatcgaggacgacataatagccgcgccagactggttcaggcgcttcaaaaagggcgtgatggaagttgagcaacacgcgacggatgcgcatcacgattggatgtacctccgcttgttctactcggagatcttgatgggctggaacaacgaggaggtcgtcgactacctanagttgtagtcctaggctacacaggtcttatcggatgtctcctcctcgctctgcgctgtcgt

SEQ ID NO: 62154 - DNA, 455 bp, Triticum aestivum
  Clone ID: PAT_TA_62154
ccttgcaagtgttcagctggttgatccggagctcggctacgacaccgaccccgaaacaaagaggacgatcgattgcgtcgccgaggtggccttccaatgcctacagatggatagggatctgaggccgtcgatcaaggaggtggtggagatcctgacttgcgtcagaaacagagactgtcacgttaagagcatgaagaagcaggcgtctcagaaagaggatgcggactttctcacggatggcctgcagttttcgtctgatacggtcatccatagattccatagccagtcaactaaccactccggggcgtcaaatgctagcggattatctaacatgaaatgctgaaaacaatgccggcgaggcccgttttggcactctttgacaatgacaaaacaaaattttgctttggtacaccccctaaattcttatatagattttgatgcaaattaatggttgg

SEQ ID NO: 62155 - DNA, 279 bp, Triticum aestivum
  Clone ID: PAT_TA_62155
atttcaaaaaaattcggtctgtgtcaagcctgtcggccgtggtcgctcggtgcgtgtgagatttgttcatacgacgtacgtactgcagctgctagtcgccgcggagaacgaaatggtttgcggccggcgacgggggccctgtgatgtgccttcctcctgcatgcatgcatgcacgcactgccaggtgccagccatgtctctgcctgcttgtttctttgtttgttgttgctacttgtacaaaatgactcctttttgttggaatcgcatttcagcgttctg

SEQ ID NO: 62156 - DNA, 704 bp, Triticum aestivum
  Clone ID: PAT_TA_62156
ttatgcgacctatagaaggccggccgggcaggggtcctttttaaatcgatccaaccatttctacaagcaatctgcttctctcttcgtcttcaccagcaccagcctcgagatctagagagggagggagcatggaggtggagaggcccgtgtccatgatgccaggcctggccgacgggttcttcacggaggccgacctggcggcggcggaccagctggtgcagctcagcgtgagcgggggagcggaggcgacatccccgacgtcgtccacgcggtcggtgcagtcggtgaacaacaccgaggcggcggggaggaagggcggctgcgatgacggcgcgccgtggctggacaggagggccaggaagcggtaccggcgggtggcggagctctaccacgccacgcggccgcttaagcgcacggacgccggcggcaagcggaggagggaggagatcacggggaatcggtaggagtgatcaggtcgatcggcccactgggctaactgcgcatttgtgtaaatacgtcgttttgtaaggtgtttactacctttactcctctatttacctttttcccctgtgcgagtggccatggtccaggaaagcagcaaagctagctttgtacagagttttgagtagttttgaatttggtgatgtagcagctcgatcggagaacgcctcgcaacttgcaagttgtttgttctttgtgtttac

SEQ ID NO: 62157 - DNA, 170 bp, Triticum aestivum
  Clone ID: PAT_TA_62157
tcttcttcttcttctttccagccttcccatccccgcctgatcggagtctcagccgcggcagccatggcgaatacctaccccgtcgtcagcgccgagtaccaggaggacgtcgagaaggccaggcagaagctccgcgccctcatcacccacaagaatagcaccccgctcat

SEQ ID NO: 62158 - DNA, 544 bp, Triticum aestivum
  Clone ID: PAT_TA_62158
cctctggatcagccaaagagcttaatagtactactaccaattctcctcgtgtgtgtgtgtgtggtgtgtatatgctacaccagtgagtgtatgtttcactagtgtgtttgagaacaacaagcaaagaaagtgagaaagagagagtagcagttagtagttgcgggttcacatcgggcggcatcggacgcggcgaacgctgccatccccgtcgcggccccagttgtgcgtcggacgcggccatcctcgtcatcgagcaacccctgcccctggcatcgagggccaccatccttgccggtgacgtccagacccgcctccctggtcggcaacttcccgatccacctccttggtcggcgacttccagatccgcgtccatgccctctttctcctcttccctgcccaatctagttgttgtgtcgaataattaccatgtgttgcagagttacaaataaatttatttccttcttagttctgaatttatgactttatgcatcttaaagtccatgcaaagaattctatatgtcgaagaaattgctatttaaggttg

SEQ ID NO: 62159 - DNA, 495 bp, Triticum aestivum
  Clone ID: PAT_TA_62159
aatttaatcttacttactacacacaagaactagacaaggtagaagagatctaaatctagccggagagaggagaggagcccagccggccggcggcaagatgtacaacaaccctccgccaccgcagggcatgtcctactacgagcacacgcagaagcgccaccaggagaagggatgcctctacgcgtgcgtgttcacggcgctgtgttgtttctgctgctatgagacctgcgagtgctgcctcgactgcctctgctgctgctgcaactaaaccaggccgccatggacggaggccgcaaggcgcagcggaggtcgaccggcctccgccgccgcctttcataataagcatatgtgtctagtgtcttagctccatgagaagtgtatcagaagttgctataatactatctgtccatgtggtcatccatcatggtttgtattgttgctgctgctactgctctaccattttaatttgattagcatcagattatggttctcacc

SEQ ID NO: 62160 - DNA, 573 bp, Triticum aestivum
  Clone ID: PAT_TA_62160
aattcccgacgaggggacggcaaatgtatcgacatcagcctggaatcatacctgcgcgcgctcggggcgttcgtaagctggcctgaggcaacaagatctgaatcggcttgatgttcaccatcttaagctagctccccggaatgatcaacaccgctcgcctcatcaccgatcatgactggaggaggggatccttacctctgactctaggggatacatgaagaactcgaactgcgctagccacaagcgggttggcggacacgtcatccacaacgcatggaggtgactgcctacatgcgcgaggacatgctgttgaacatctgtgatgatgaccatgattgatgactaggctgctctcctgccacacttcccttctccaggtgtgatagttatccatcgagccacttgtgttgttcctccgctccattgtcggtgccgcatggatctgggacatgagaaaaatgataaatcccgctcttaaccgaagagcgcgtggatggggcccctatggtctctagacgcgcgaatactagaaccatcgctcgaatcaacattacttgtagcgatgtgatcatg

SEQ ID NO: 62161 - DNA, 453 bp, Triticum aestivum
  Clone ID: PAT_TA_62161
atttcctcgcatcccacctcggcgcccccatattactcactcccctcctcccccatcctcccatcgactcgcaagccctcaagctacagcgcaaggtcgtgatggctccacgcgtcggcgtgctgctcctggccgtggccgtcttcttcgcctctgcgtcggcgcaggacttcatggcgccttcctcagcccccgctccggcgcctgacgccggcgcggccgccagcgtctccgcgctggccttggtgtcctcggcactggtgtcccttctcgcggcggcgatgatgcagtagatggatggctggagcagagagtttttcctttgagaggccggcggtggtttgatgagtgttgctggctcttgcctctttagtttgttcgacattctttttcatgatgtatgtaccttgtctatataatgttatgaatgaataaagcttgttgggttctgct

SEQ ID NO: 62162 - DNA, 283 bp, Triticum aestivum
  Clone ID: PAT_TA_62162
ctttgctcggaatgagaaaacagattcgagaccgaaatgtccacgcctatatccctatgtgagtggccattaaaccctgttccccttgttggagaatcgatttgctgaatgatcaccattagttatgtcgtatatggcaaaaagccagaaacagacaccccttcgaaggcctgatatattttaccaagtctgtactttcatcatcatggggattagggaggtatttcacggtcacagacttctttctatacagtacattccaattattgcatcggtattcatt

SEQ ID NO: 62163 - DNA, 768 bp, Triticum aestivum
  unsure (1)..(768): unsure at all n locations
  Clone ID: PAT_TA_62163
cggccgctcgagccggcgggngggagtgcaaaaagcgactaccgatctctaccgtaccaagaggcacgccgtggagctcgcccgtccctcgatggcaaccgccgcttcgtcgagcagggtggccgcggtggcggagcaggaggacaagaacgagccggcgaggcccctggccatccctcacccgcacgcccacccggccgccagcgacgccgacgaggcggcgcagacggcgacggggtggcgctccacgcagtacctccggaggaagcgccggtgcctgctctgctgcggcggctgctgcgtggccaccgcggtcatcgtcggcatcctcatcctcgcgctctcgctcaccgtgggctggnctaggacccgcgcctcaccatgaacggcgtctccttcgccgccctcagggccggccccggcacggggctcgccgaccccgtcgccgccaacgccacgctcaccgccgacgtctcgatcgagaaccccaacatcgcgtcgttccggttctcgtcgagcgccacggaggtgtacctcggcgggcggacggtcagcgtggcgtacgtgccaggcggccgcgtcggcgcccacgggagcgtgcgcatgaacgtgacggtagacatcctcggcgaccggctgtcgggggcggtcaacgccaccggcctgctgctcggccaggcgtacgacctgacgacgtacacggagatgggcggcacggtgaaggtgctgcggatctacaagaaggatctcgagatcaggatgaactgc

SEQ ID NO: 62164 - DNA, 578 bp, Triticum aestivum
  Clone ID: PAT_TA_62164
cagctaccacttcaagctagtcattcatccaccagacgtacgcagagctcggcctgtctctgtctgtctgcaacattcgctcaccaccaatccctccatccgctctactaagaagacgtatatggcgtcctcggcgacgatggcgagggcggtggtgatggccgtgctgctgatgcagtgctgcaacgtggtcctcgcggcgaggctgctcgagggagacggcggttggctgcgcggcggcgttggcgccgctggggcgcttatcatgcaggtcctgcccaggggcggcggctctgcgggagcacccaacggctgcaccaacaaccccaaacacccacccggtgggaaatgccacggctagcaagcagcaggcaaagctcgactagtcaattagcatggaggaatacatgtacatggtgcacatgcgtagatagagtcattgattcattatttctttaataatggtagttacagggcttctgtgcatactttggagccctcgagttgttcagattttagttacctcatgcagccaagttgtatataaagattttgatatattctactcatcagttggg

SEQ ID NO: 62165 - DNA, 566 bp, Triticum aestivum
  Clone ID: PAT_TA_62165
atttccatcacgaactcaacaaggaatccatataccatgcgtcgctaggcacggcagcgagagtggatgcgtgcgaacaaacaggccgagatagagccgaaaacatagagacgaacctggaactgctggtaaagaccggtgaggatacaactcgggtttcataccggcgtcgagaagatggacaaatcaaaggaaaagctgataattctcacaaattactggacacccatgaggaaaagacaaatagacgactatcctttggtcactgaaataacggtgttctgttcactagtacacaatgacgagcttggaacagcctgcgtcaaggactacccgttttgatgcatgaacaacctcgtccctgccgactaagagctaattactagcacgacgacgacagagtgaagatatgagaagagatctctccagctattttattcacaagatgaagcacagcgatattgagatgtcgaaaccgcacttggtatatgacgtctatggacctctctactatcttgatgagtatgagtcatgaatacaacacttgatatgcatagttcagctgg

SEQ ID NO: 62166 - DNA, 167 bp, Triticum aestivum
  unsure (1)..(167): unsure at all n locations
  Clone ID: PAT_TA_62166
gccgctcgaggcggncggggcggncattcgaacttctgnngtttctcattgngtttttattaggagagagagcttgattcttagtttttttttctcttgatttcttgagtgatatatacatgtatactcctacaagttaaaagaggttatatactggttggtaccac

SEQ ID NO: 62167 - DNA, 716 bp, Triticum aestivum
  unsure (1)..(716): unsure at all n locations
  Clone ID: PAT_TA_62167
acctcaccaccagcacaacccggcgagaggagaacgatcgagagccatcgagcgtacggcaagatgcagatcttcgtgaagacgctgaccgggaagaccatcacgctggaggtggagtcctcggacaccatcgacaacgtcaaggccaagatccaggacaaggaaggtatcccgccggaccagcagcgcctcatcttcgccgggaagcagctcgaggatggccgcactttggccgattacaacatccaaaaggagtcgacgcttcacctcgtgctgcgcctccgtggcggcagccgaggtcaataccccaagaacctcgagcccaacctccgcatccttgctcaaaagtacaatgagaacaaactagtctgccgcaggtgctatgcacgcctacccctcagggccaccaactgccgcaagaagaagtgtggacataacaatcagataagggaaaagaagaggtttatgtccaagtttgggagcgattcttgaacattgggagtgatgctgaagcaaccatctaccgtcatatatagtggagtttaagttctgtcctagttttaagtcatgttagattttgctaaatcgtctagcgccatagatattggagtcagttttgtccagtccggagtttgaacctatgtatatatgctttagaacatatatctatcaaatatccatattatacagagttgtttatattgagagcttttntc

SEQ ID NO: 62168 - DNA, 413 bp, Triticum aestivum
  Clone ID: PAT_TA_62168
gttccctttctgtgataggtttgcgggactgccgcgcacgggaagatgctgccacccaactgtcgccgcctccttgctcggcttcttgccatcctcatgttactgctgttaatcgtcggtggccatgcaggtcgtggtggaaggtttggtccacctgcacactgcgatactcgtcagaacccaggcggctgccctcgtttgccgcctccgaactgtgcaggctgtggatagcagcgggtctcattcccgaagcatatgtcctcgacgacggtcttttagcatgtcttgtactccctcacttgccaaatatttgtctttctacacattttaaatggactacaacatacagatgtttgtagtcatattttaaagtatagattcattcattttgcttcgtatgtaatcatttgttg

SEQ ID NO: 62169 - DNA, 697 bp, Triticum aestivum
  Clone ID: PAT_TA_62169
aatacacatactatcagtggcatctttcacgttgtctcattattcatccgttcaacagcttcataaaaaatgaattcattgttttgtatttttagatcacatcgaccataaattcaaacataattacaggctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaaaaaaagggccccaagggccccaaggggccgcaaaacgaaaaccatcccccaaaaaaatttttttggggccaaggggccaaaaaaaaaaaaaccgaaacccaaaagggaccccccaattaaaaatttaacggaaaaacccgcaaaacggggcaaaaaagaaaggaaaaaaagcaaaagggggggccccaagggccttgaaaaagaaaagggaaaccttgcgcaaaaacaccaaacccccccccttaaaagcccccaaaaagggcccgcaagggggaatttttcggaaaaaggggcgggaaaccccaatttgttaatttttaaaaaaaaatcaaaaaaagaacccccccaaaaaaaaaaaacccgaaaaaaggctcaaaaaaaattgaaaaagaaaaaatatgggttttcaacttttccgggcccccctaatcccctttt

SEQ ID NO: 62170 - DNA, 499 bp, Triticum aestivum
  Clone ID: PAT_TA_62170
atttccagagctgcctgggaagtggtggctgtacctgcacagtaccagtctcctgttcagttctgctcgccgagaagccaagccatggctgtggtggagctgaaggtcgggatgcactgcgacaggtgcatcaagtcgatcaagaaggcgatcaagacgatcgatgacatggagagctaccagctcgagaaggagacgaacaaggtgaccgtgacggggaacatcaccgcggaggaagtggtgaaggctctgcagaagatcgggaagacggtaacttactggggtgagtgaagaacagagcccagaggaaggcgagccacacggtaacagattattgttactgggagtgcggactacagagcccacgtagttagctagctagttagtattagcttatgtgcttaccatgggatatcaggagctacttgtactgcagattgggtaattttggggagtttctttgaactggttgatgctggctcttccctcgcttcatccg

SEQ ID NO: 62171 - DNA, 714 bp, Triticum aestivum
  Clone ID: PAT_TA_62171
aggaattacgcctcctcattaacaacctcagcacgcatcatcacgacaagctgtgactgcaaatatgaatggcttattcgcccctcgtcgccttgccttttctatcaatagaagtgctcgtgtactgcatctgggccagcggtatgggtgtttcaatcagcattggcagtcacgattccaaccaaaacagcaaaacatgaacctgaccagatcttacggcactcttccggatgcctcaaagataaataaagttattgatgctgagctcgcgcgtcgaggtgacttccgccgcgccgatgagatctctgatccggagttcaacgagttatatctccaaaagttttcacatttcgagacagcacgtccgacaaaggcaaaagcaaaggcaaaggcaaaaacaaaagcaaaagcaaaggcaaaggcaaaagcaaaagcaaaggaaacaaagggagcccccattccggcagaaccagagaaggagagcagttggacacgtttctttatacagtacgcatcgagactgttgcgttgaaagaagcccaggacactacaggaagattaggccgttttggaatagggctgaagactaaatctgggtcggataatgttggagtcagcgatcactttgggatcactgtaggcatcaaggtcatcgaacagattcactcctgacgtctcagttcaatcgaatatgatctatatgcttcttgtccc

SEQ ID NO: 62172 - DNA, 791 bp, Triticum aestivum
  unsure (1)..(791): unsure at all n locations
  Clone ID: PAT_TA_62172
ccttctccacgagaccaattccgagctcttccgactgactgaatccatctcccatctcctccatcgttccgcggatcgcacagacacaccagctctcgtcgagcagcccataccggactagctagctgcctggctagccccgtgccgatggtttcctcgatgaagcactgcagagatcaggcccaggaggagcccttgtccctctcgctctccctcggcgccatggccgaccgcaccaagaagcagcgccgcggcgtcgctgccggcgagttcgtgtgcaagacgtgcagccgcgccttcccgtcgttccaggcgctgggcggccaccggaccagccacctgcgcggccacaacgggctcgcgcttggcctcgctgccgggtctgatcagccggggaccaagaagaccacggaccagaagcaggcgcaccagtgccacgtctgcgggctggagttcgagatgggccaggcgctcggcggccacatgcgccggcaccgcgagcaggaggccgccaccacggcgcaggcgccgcccgttctgctccagctcttcgtctagcactgcatcaccgatttctctcaagttcaatagcgaggcatatctagttcaagtccagatttacaggatcacctatgtgcacgatttggtttgtacatttgctgcacaatagctggtctgctcgctcatgttattacgtatatatgtgtacatattttaggactcattcattcgttcattactggttactggnnatatctatancttatttgatcatacatttattttggtcc

SEQ ID NO: 62173 - DNA, 316 bp, Triticum aestivum
  Clone ID: PAT_TA_62173
aatccactcccgccttctcaatcccccatcgcgccaaatctctccgcacctcaaaccaacccctgcctcgagccgcaatggacgcctccgccgccggcgccgtcgccaaggcgaagaagtacgtggtggcgcgcaagctcggcggcggccccaggaacaaggcggtggcgcggtccgtcaaggccgggctgcagttccccgccggccgcatcggtcgcttcctccagaagggatgatacccgcaacgcctcatcatgggcctccccttctacctcgccttcgtcctcgagtacctcgacgtcgagcttctcgagct

SEQ ID NO: 62174 - DNA, 825 bp, Triticum aestivum
  unsure (1)..(825): unsure at all n locations
  Clone ID: PAT_TA_62174
aaatacgtcccccaagcttcttctacttccaacctgatccagacacccgaagaaagccatggacgccgccagcgagagcgccgtgacgtgcgtcgacttctgggccaacgggttcggcatgcgggcgcggatcgcgctgcgcgagctaggcgcggcgttcgagtacgtcgaggaggacctggtgcggcgcatgaaccccatccaccgctcggtgcccatcctcatccaccgcggccgtccggtctgcggctcccctcaacatccttgagcacatccagtcgcaaaaaaaaaaaaaaacatccttgagtacatcgacgaggttttgggccgacttcgttgaccacaaggtgttccctactcaaacaaggttcctgaagagcaaggagaaagacgcggccaaggaagagctggttgagcaactcaaacgcctagaggaggtgctcagcgacaagggatatttttctggtgacgaattcgggttcttggacatcgtcctcatcccattttcaagcatgtttcgtgggtacgagcagcatggagggtttgacctcgaggttgagtgccccaacctcatgcgatgggtgaagaggtgcaaggagagggagagtgtaagagaggttcttccggatgaggcaaagatgtacgatttacacaaggagtggtacggcattgagtaaagaagccagcttcagtagctgcggctgaattaatctagtcctctatgtatgagcagttaaaatttgcctcccaaataaatattgtcgttagatacatggngaattttgtattgtgtatttgntaggcatagtatgtcgatgttttttc

SEQ ID NO: 62175 - DNA, 564 bp, Triticum aestivum
  Clone ID: PAT_TA_62175
attctagctctctcgctccttcgtcctcgcaagcatcacaccaggtccaccgtaggagcaaggaagggagatccacctaacccaccaatggcggccgctgcttcctccagcgcgtggaaggcgaggtggctccgccccgaggcgtaccctatctttgcggcgacgggcgtggccgtggggatctgcgtcatgcagctggtgcgcaacatcaccaccaaccccgaggtccgggtgaccaaggagaacagggcggccggggtgctggacaaccacgacgagggccgccgctacgcgcgccaccccttccggaggttcatcgacggcaagtccgccgagatcatgcccggcatcaacagcttcttcaccgccccaccaaagaactagacgtcgttgtcgtcgccgtcggagagctctttcttcaacttgaagggtggaatcaatcccttcgcgagaattacattcttttttccgcatgaattcaagtattattcgccatgattgattgtcaggcgctgtactatattgatttttgtgatcatatataagtataaaacttgatctgaa

SEQ ID NO: 62176 - DNA, 737 bp, Triticum aestivum
  Clone ID: PAT_TA_62176
actccaaccctcgcccggctcaggcagggccagccctttaagtacctgtcgctctctgcagcctcgcccacactacaggcattacggcaaacactcgccatctcgccacgtgagaggagaagcacacagcgctggtgcttgagcggatctggaaaggatggccggcggcgcggacgcggacggggagcgcaggatcggggtggccatggactactcggcgagcagcaagcgggcgctggagtgggccgtccggaacctgctccgccggggcgacaccgtcgtcgtcctccacgtccagcgccacggcggggaggaggccaagcacgccgtttgggccaagtccggatccccactcatccctctgtccgagtaccgggagccggaggtgatgaagaactacggcgtgacctgcgacgccgaggtgctcgacatgctcgacaccgccgcgcgccagctcgagctgaaggtggtggcgaaggtgtactggggcgacgccagggagaagctctgcgacgcggtggaggagcagaagatcgacaccatcgtcatgggcagccgcggcctcggtaccatccagaggattcttctgggaagtgtgaccaactacgtgttgtcgaacgcgtcgtgccctgtgacagtcgtcaagggagaccgttaggtccgccatcgatgtgcatcaggatgcgcttcatcgttctctgctccgttgctgcgcttgaaaaagaatgcagcctatt

SEQ ID NO: 62177 - DNA, 387 bp, Triticum aestivum
  unsure (1)..(387): unsure at all n locations
  Clone ID: PAT_TA_62177
actacgccttcattagtctattggctagcgatctaagctttanaaaaaaaaaaaaaaaaaaaaaaaaaaaaaaaaaaaaaaaaaagcaggggacctcatcaagaagaccacgagcagtatcatggattaagtgcatggacctactgttcaagaagctaaacaaattcctatatttagggtacaattattattttacatttcttgttcttttattctcctttgattatgattattattattgttatttatttagacatggggttcttattccttttttgatctatatataccgaccgagggtctatatatatagcaggccggtaccaaagaaattggttgtacactgtaaaagggcttatacttaatatacatgatatgatttttttc

SEQ ID NO: 62178 - DNA, 273 bp, Triticum aestivum
  unsure (1)..(273): unsure at all n locations
  Clone ID: PAT_TA_62178
cactcaagttagcaccaaagcaatccaagagtagtagtactacaaccagcctcactacgtgggcatcttcacaacgagtgtgtgcgtgcttcacttgtgtcctgctagcttcagttagctgcaatatagatcgtctgtgcctctgatcctcggcagttctgccagtagatagtttgggccaacagtgaagaggcaggctgtggtagaggaggccgacgcggcgccgctgctggtgaagaggcaggccatagtcgaggaggncgccgcgccgcc

SEQ ID NO: 62179 - DNA, 562 bp, Triticum aestivum
  Clone ID: PAT_TA_62179
cctctcgccgtcgccgtccttttatttatctatccctcggctcgattccatctccactagccgctcctcgtcgccgcccgccgcccgccgcggcctcgctcccaccatccctcccggactccccgtctccgcgcgcgccgatcccgcgatcgggcgaggcggctcacgccagtccaggcgcccaggttcaacttggacacaacggtgctgtattgtgacaggcggtgcccttgcttggcgacgtttgtgttttgttgatcgtcaaaaggctttccatacaacttagccctctgtttttgctagctgtctatatctgtttggagagggcaatctagcaacaatgtcatctcttcagttattgcaacttacggagcatggacggaaccttttttcttcgagaaggaggacgcttgcagttgtttctggcgcactacttgctggtggtactttagcatatgcgcagtcaggtcgacggcggaaacatcgggaagaaaatcattctaatgatggaaatgtacatagcaggagtaaagagaacattagtcaaaatggtgttgacggt

SEQ ID NO: 62180 - DNA, 640 bp, Triticum aestivum
  Clone ID: PAT_TA_62180
acaagtcctcaaagcaatttggaagcagcaagcagcagcagcagcgcaagaagaatttgttagagaaactgatatggcgtccatgatgggaggggacttcgtggaggcctacgtgctcaagaacgcctacaaggagaagctgaggcgcatggaccaagcggaagccgccgcggcgctccacggcgcgaagagcagcaaggacaaggaggacgccggtgccactggagagaagaaggctgctggtggtggtggtgcgagcagcaggggaggattctttggcctcatgaagaagaaggtgcaccccaaacccaaagcatcggcggcgacttcctcttgattatattactgtagtacttgccatgccacgaaattgtaagccgcagctttcttctacgtaactagtaacgtgcgccgcgcgtgcgagtaactttgttccttcgctcaaataatctccccgggcatggtgagcctcgacacgtccctctccgccgcggctctgtgcgcgatccaggcgtccacctcgatccggctcgacttggcggccaactccttcccgccctcccccggcctgttcacgcatgcctacatgacgcacctggcccgtctcctgcctaccacccgccgcccgctgctgcccaac

SEQ ID NO: 62181 - DNA, 814 bp, Triticum aestivum
  Clone ID: PAT_TA_62181
aactcgaagccccaaaccgtctcaaatctccattagcgcgaaggtcaaccgcgcgcaggatggacagccccctcccgcagccgcgcaggcgcaggcccgtcgtcctgatcgcctcctgcgcgctgatcctcctcgccaccgccctcctcctcccgcgcgctcccgccgtcccgccgctgaccccggccgtccgcctcgacccgcgggtcgcgcgcaggagcggcaacgaggtgctgtggcagctgccgccgggcccgccgcgcgccgccgtgttcgtcgcccccgggtgcaccatccgcgccaccgacttcttcgacgcctcccccggctgcccgcgctgcgcggggctccccgaggagcgccggttcacgcgcgaggcgctccgccgaggctacgccgtcctcgccgtgtccagccgcgccgagtgctggtccctcgacgccgcctccgcctctggcgacggcagcgagctcgccgccgtcggttccgtcatcgaatggtgggtcaaggagcagcaccccgagctcggcggcctcccgctcgtcggcatcggcgcgtcgtcgggcgggtacttcctctccgcgctggcggcgagggtcaggttcagcagcgtcgccatcgtgattgccgagggcgtgtttgccgccatggaggaaatcccgcccggctacccgccggcgctgttcgtgcacatgcccagggacgccgacagggcgcagatggtggcggcaagcatagacaagctcaagtcaaagcacgttgatgtgcgggagatccagtgcgacgcctttgccgtgagtgccgagttcttggc

SEQ ID NO: 62182 - DNA, 568 bp, Triticum aestivum
  Clone ID: PAT_TA_62182
accaaccccagcaagaaaaacccaagcaaagccaccaattgattgaagcaaagtcacagagcctgcgtgcaagaaagcgtcggccacctgagctgctgccggaatcatccccgtctcctatcgagtatggacaaggtgctggccttctccatcctgagtgcatcgccggccgacatcgccctcggcaccggcgccaacggcagctgggctcggctgtcctggcggggaaggaagctgcaggtggacgaccgggctggagcagagcaccaagggaagcagggcggtctgccgcgggaggcagagcagcggcacgacaaagggaaatcgcagtcgccgtcgacgttgccgccacggtttgcgcccgagtttgatgggatcgactgctttgagaccatcgtgtgccattgatcggtgatgaatcgcgatctgctcctgttcccgccgcgcgtgtgactactaattctttcttcttcatactatcggcatgttcattcgttgttaagttgtgcttctaactgaagccggatgttgtacagaatacagagctgcctataaaccaagttctttc

SEQ ID NO: 62183 - DNA, 398 bp, Triticum aestivum
  Clone ID: PAT_TA_62183
agcgcactatggcgagcgatatattaggatggctagtctgttcctgatgaggagaacactacgcggcggcgcggccggactagccggcggagctcttccgcttcgtcgcgtcgaggaaggtgcgctacgacctcgcgtgtgacgtcggcgcccgccgcggccaggtggcagtctcgctggcgaaggtgtacaagagcgtggagggcagggacccatagcgttcagtgtctgggctactcgcgagaactccccgacgtgcgctatgtttattctcacttgacctgctgctcgacggactaaagcgcggccgtgacgccgacgtgctgcgtataagtgacaacggtggccctgggtttggcacagggtcaacttgccgagattctccgcctaagatgggt

SEQ ID NO: 62184 - DNA, 563 bp, Triticum aestivum
  Clone ID: PAT_TA_62184
aaaaagttcctacccttccagatttcctcgtgcccccaagcaaggagccacagagcaatgtcgcacactcgtatgctctacttccaagcccaccatccccatgcccactttcaggacaaccatgccagtgttatgaagaacgaagcagcagtaggggcgaaccatgtccaagcgcccaaaaaacaagtcaggtttcaggacaaccatgccaatcctatcaagaaagatgatgtgaatacagatgtggattcggtggcttcggacttcatcaagcgtaagcacatgtcttgggcactccagaagagcacgaccatgtatccatcctcttaagagaaccagagttccttagtcgtggtattatctgctcatgctttctccagtatgaaagttcaaataagaggtgctgcttggaagtgccctggatatcccgaggttgtgttactatggtgtattggtgttcttatttgtagcatgaataagagtgatgtgaatagatgtattgttattcaccgctgtgtgatattcttatatatgaaagtgtggttattacagtgattctgtcc

SEQ ID NO: 62185 - DNA, 432 bp, Triticum aestivum
  Clone ID: PAT_TA_62185
aatctgaagcaaaagatggtgatcagggtgcacatgacgtgcgacaaatgccgatccaaggcaatggggctggttgcctcggtatacggagtggagcgtgtggagatacaaggcgatgacagggaccagctggcggtggtcggcgacggggtggacgccgccaacctcacggcctgcctgcggaaggtggggaacgcggacctcctcacggtggaggcggtcgtccccgaggcgaagccggcaccggcatcggagaccaccgaggctccatggtatcccagctattattcctggccggcaggggcatactcccactgctacccgtacagcatgtagtaatctcttgtatatctgcggaattatcaaactgatccagtgatccatccatgtaatgattcccagaaaaaaaatccgagtgtttttgataggttc

SEQ ID NO: 62186 - DNA, 482 bp, Triticum aestivum
  unsure (1)..(482): unsure at all n locations
  Clone ID: PAT_TA_62186
atttaggtncactatagaagtccggccgggccggggcgcgagtacggcttcaggcaccagggcgccatcgccatcccctgccgggtcgaccgcttcgtccacgtcgagcgcctcatcgaccgcgacctcggcgcgcacggccaccagctcgtcgacctcgactgcggcgccgccaccgcccacggccacggccacatacatctgccgcgcttcgtcggctgcttccgcgcctgacgatgatggcgacgcgtcgtcgaccggcggatctcttgctgtttctttgttagggttggttgagtagttctctcccgtatgctgctggctagtttgtttcgccctccggtcgcgatgggtttgttatgcatggttgttctccattggtttggtttgtgctgggagaatcgatcggaggacgaattcgatgttgatgacgacgaaaaattatgatccaagtgtaaagagataatattattgttagtagc

SEQ ID NO: 62187 - DNA, 279 bp, Triticum aestivum
  Clone ID: PAT_TA_62187
gccgctcgagccggtcgggacggaatttcccaacagcctcctactcctcaagtatcctctcagtccttagcttccttccctcgccaccacccacagccaaggaggatgtcttgaatgcggcggaaactgcgggtgcggagccggttgcaagtgcggaaacggctgcggcggatgtaagatgttccccgacgtggacgccaccgccggtccggccgccaacggcaatacccaccgcctcccaccacgcccccctcgccccaaatctccaccccccccccc

SEQ ID NO: 62188 - DNA, 732 bp, Triticum aestivum
  Clone ID: PAT_TA_62188
atctccccatttttgctaggtttccctctccgccgccacagcagcttctccccatctccctcctcgccgccgccctccgctcgccgctcgccgccatgggacgcatgcacagcaacgggaagggcatgtcgtcctcggtgatcccctacaagcgggaggccccgacctgggtcaagacgtccgcgccggacgtggaggagatcatcgtccgcgccgccaagaagggccagctgccgtcgcagatcggcgccctgctccgcgacggctacggcatcccgctgtccaaggccgtcaccggcgccaagatcgtgcgcctgctcaaggcgcgcgggctggcgccggagatgcccgaggacctctacttcctcatcaagaaggccgttgcgatccggaagcacctggagaggaacaggtcggacgtggacgccaagttccgcctcatcctcgtcgagagcagggtccaccgcctcacccgctactaccgcctcaccaagaagatgcccgccgcctggaagtacgagtccaccaccgcgagcactctcgtcgcctgattcggttaagcttcggttctttgacgtaattctctgcagcttggacttcggttttttgttaagtactccagtaagcaatgctttttgggatgtaagctgttaaacctatcagctaccgctcgtgtgcctgcacagaagtatttcagagtttagtgggactggatcaggttttgatccttgg

SEQ ID NO: 62189 - DNA, 556 bp, Triticum aestivum
  Clone ID: PAT_TA_62189
atatattgatcaagaggggaggctctcgatcgagcagcagcagcagcagcaaagatggtcagggcgatgggtattgccgcggcaaaaggcttcatcgccggttccatgcactacacgcccagcggcgtcgtgtgtctagctttcgccttcgtggccgcggttgccatcgtggccgtcgccgtgtttggttgcgccggccacaagagctccggcgggaagaagcctcgacgtggtcacggcggctcctactgggcagctggagcgggcgcaggcgcaggcgtctatgttggagacagcggtgttagcacaggcggtggtggctgtggcggcggagggggaggaggtggtggctgtggaggcggaggaggtggtggaggttgctgagaaaagacatcacacagtggattattactgcaagaccatgatataatttggttggataaatttcactttatttgaatatttgtaaataatactttcattttcggagatgttgtaaatgcacgctcacttgtttacatatttatacattcattcatatatgatctataatttc

SEQ ID NO: 62190 - DNA, 437 bp, Triticum aestivum
  Clone ID: PAT_TA_62190
ggccgggccgggttctgcacctgtatggctcaccgacgaggagaagatgatcgacggatctagacgagctaacgctgatggaaatgtgtgagatggcctacgtgccatacgctgcagctcgggctccaccatataggttcgtgatgtacgagaaggtggaggtaggaacttcatcagagagaatgatgtcatcctcctctatggctacctgctccctaaaggccccatcctcatccagaacgaggggcccgatctaccagagcgccgacgcttggctgattcgaacagacttcccggagacggtcctcgccgtcgtcaccgataacttctaggtgggcgatgactttgaaatgatcacattcaacctagaccaacgcctcttgcccaagatggcgatcgcaaacaagctgatgaccctgatacttggcactcgagct

SEQ ID NO: 62191 - DNA, 449 bp, Triticum aestivum
  Clone ID: PAT_TA_62191
aagtattcccagcaagaaccaccagtcttttcttcactctgtgtccaactagctagcatctgcagcagcatccgagagagaaataatggtgtacgaggcagtggaggccattgctctgaggagccaggtgcagagaagaaacaccagtgcgaagagccatgagcatcaggtgaaggccagagagaatgagctcatatggggcattattctctggatcatcagcaaggtttggccggccttctagaacatgccacatacggaagatcagagtgatagttaaaggtgccatcgagcagagatttttgcataacgactgcgtgtttgtatgtatttatgtattgtttagccaacataggtaaagtgtgtagcatcacttgtggttagtaggcacagctcatcaaggtcgtgtaattaaaatgagtcttcaagaactccggtctgaaggaatg

SEQ ID NO: 62192 - DNA, 124 bp, Triticum aestivum
  Clone ID: PAT_TA_62192
actatgtgcttcagagcctctgatggtcgaatttcttggcaaggcatcataatgcatggttttgataggctgctgatgtatctactatctactaccactataaaagaaagagaggggcagatcc

SEQ ID NO: 62193 - DNA, 511 bp, Triticum aestivum
  Clone ID: PAT_TA_62193
acaacatctcataaccaccaaacaataccatcaacatggtcggaccccaagattcaggagcttcttgccaagccgcgatccgacctcaccgagtacgagatcgctcagctcgaagagtacgagttttccgccggccctctctccattctccagactgccgtgcgatcacacgtccaagtcctcatctccatccgcaacaaccgcaaactccttgcgcgcgtcaaggcattcgacagacattgcaacatggttctcgagaacgtcaaggaaatgtggacagagactccccgattagctggcggaaagaagggcagaccagtcaacaaggatcggttcatcagcaagatgtttttgcgaggcgatagcgttattctggttctcctaagctaattttcctttaccacatgatcttggagggtgagaacttgatttagagaatgggatgttttgtatgtcttacgggcaaggctcacagggactccataggcgttgaaaacatgatgatttgcgc

SEQ ID NO: 62194 - DNA, 488 bp, Triticum aestivum
  Clone ID: PAT_TA_62194
attacgcgcgacgcgtacccggcgccggcgcagcacccgctgctccgcctcaacccgcacgactgcgtcccgttcctggacgagatcttcgcggacgggcaggaggccaagctggagaggctcccgtcgccgcgcctcatgaacacgcacatgccacacaccctgctccccgagtcggtcatcgccgggtgcaaggtggcgtacgtctgcagggaccccaaggacatggtggtgtcgctgtggcacttcctccggcgccggcagccggagctcccgttcgcggagctgttcgagcacgtgtgcgacggcgccgtggccgtcggcccgatctgggaccacgtgctcagctactggcgcgcgagcctcgcgcggtccgacagggtgctcttcctcaggtacgaggacctgctgctggacacggggaagcacgtcaggcggctggcggagttcatggggcggccgttctcgccccccgacgaaggcgccgt

SEQ ID NO: 62195 - DNA, 523 bp, Triticum aestivum
  Clone ID: PAT_TA_62195
atcccaccacacacagaaacaaatgaccgacgaaaccccttctcagacagcaaagtccgctgaggaccgaaaagctgcttcggcccttgagaacctcgacgctgccgactccccttcgacaccacaaaacgtcgacgccgacgcggctaacaaagccatcaagagcctcggctccagcaaggcctcagcctctgctgcttcccacaagaacgtcaaggtcgatgctgctgacgttgctcttctcgttgaggagctcgaattgcctaagccaaaggctaccgagctgctcaagggcaacgagggtgatgctgtcaaggctatgagggcgtttatcaaggcttaaggacgatgccacgacgaggcgtcacaatttcgtctttctccgccaagggctggtgggaaggggtgcgacaattagaataaaaggcattcatggcactggcgtttagcgagcatgccgcaaagagattaccaacaatatgagacacgaccaacattcaaatctaacagtctcgagccttct

SEQ ID NO: 62196 - DNA, 501 bp, Triticum aestivum
  Clone ID: PAT_TA_62196
ttcaccagcaagaagcacacagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaact

SEQ ID NO: 62197 - DNA, 750 bp, Triticum aestivum
  Clone ID: PAT_TA_62197
gttacctcggccgtgcgttgagaaagaggcgaggtcagaggctcggaaggtggtcagccagccatgagcagcgcggaggcgtcggtggcgaggggcggcgaggaggagcggtgccggtacaagggcgtgcggcggcggcggtgggggaagtgggtgtcggagatccgggtgcccggcacgcgggagcgcctgtggctgggctcctacgccacgcccgaggccgccgccgtcgcgcacgacacggccgtctacttcctccgcggcggctccctctccggcaacggcgccgctgggctcaacttcccggagcgtgcggccgccgcgtacggtgttttttccgtggcgcccctctcgccgcggtccgtgcagagcgtggcgtccgacgcgggcatggccgccgacgcgcagctcgtggcggcgcgggacggcgtgcccaggcagcactacgcggaggcgcgcgccggcgctggcaccgcgcagggcggcgcgaacgcggagctccagcacgacggcgcgtatgcgtacacgtatacgggggacggcggggacaccactggcggtggcggtggtaccagtagggagcagcttgtctccggggagctcagcgtcgacgacatggagatattgatgtaaaattgagcatacacgaacaccggtagtactacgtagaattagctgatgcaataaagatcgaacacaggtcgcagttggcaaggttgaaccgttttgaattcggaaacagttccgcac

SEQ ID NO: 62198 - DNA, 651 bp, Triticum aestivum
  Clone ID: PAT_TA_62198
atctcatctcatcgcccaccaccaaaacaatccaatccaatcccaccgtagagaggggagaagcgcggaggatgtcgggccgcggcaagggaggcaaggggctgggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaggggcgcaccctctacggcttcggagggtaaggcgaggggtcatcgatccagctcgcgacgccgccggccgaacgagaggaataatggtatctatctaagtgctggctaagggtcgggggtctcccgggaagaacaaggggaaccccctggtggttgctccccgcctgggaactgaaggtgctggtggaaaaaaggactggaagaaatttggaatggtaaaaaaaaaaaaaaaaaaaggccctaagggctccaaggggcggactaactggaacctcaacccaatccaggtttttggggg

SEQ ID NO: 62199 - DNA, 840 bp, Triticum aestivum
  unsure (1)..(840): unsure at all n locations
  Clone ID: PAT_TA_62199
attttgtcttctctcctccgacacctatcctctcctctcatctgcacgccatagtgatgggtaagtcccgcagttggttttggcaccgcccgggtggatccggggggagctccgtatcatggcgccgccgccgacagcctccgggcccgtcgacatccaccgctcccgcgggcaaagaggttgctctccgatgaggaaaaggaggagcagtagcagctaccactcctcactgaggccgcatgcacatacgacgagttcgccacgcacatcaaggtgctgctcgagccattgctccacgaccgtggtcggcatcctaccaaatccaacacagtgtcaaggaggagccgccctcaccacatgcaattgcatcgtccaatgccacggcggcggcggttcctcctgcctcgtcagaccaaaggtggagccgggccttggccccatgaagcgcgagcacaacgacgaggccgccttcgacgacgaggccgccatgaagtgggcgtgggaggattgggcgtggacgaagatggagcgccagcaccgcgccctggaggagatcgccgctcgacgtcgtggttgcgacgagggaggcggcgttgttcccgatgacagtgacgacgaggtgtcgtcgccggccaaaccaatccaccagggggaccccgggcaggggtcgaccagagacggttgcgtgaagggnnnaaanaaaagggcaggtgacggcgtcgaactttggcgtgttcagcgagttcttcagcctgtaggcgcggncatttttcttcttctttttagtagactattattatgtttctatatggaaacaaactgtgaaccgnctaaatatcg

SEQ ID NO: 62200 - DNA, 850 bp, Triticum aestivum
  Clone ID: PAT_TA_62200
ggccgggccggggcatcgcgctcgccttcgccgccttcgtgctcgccacgcctatgtacaagcgccgcatgcccgccggcaccccgctcaagagcctctgccaggtcgtcgctgccgcgtgcaagaagatcagcgtcaacgtgcccgccgaagccggacacctctacgaggtcagcgataagatcgactcgccccagcccaagatcgcgcacacaagcgacttcaagttcctcgacaaggcggccatcgtcacggagtcggacatggaggagaggccggaggcggcgacctcgtggaagctctgcacggtgactcaggtggaggagctcaagatcctgctccgcctgcttcccgtatggatcaccagcgtcgtcgtgtcatcggcattctcgcagatgaacaccacgttcgtgcagcagggcagtgccatggaaatgaccatcctgtcggtgccggtgcccgcggcgtcgctggcctccttcgaggtgatctgcgtcatgacatgggtgctcctctacaccaaggtgatcgtgccggcgttgaggagcttctcctcgagcggtgacggcgagccgtcgcagctgcagcggatgggtgccgggcggctcctcatggcgctcaccatggcggtggcagcgctcgtggaaatgaagcggctcgacagcacttcttccttgccggcggggaggtgttctgctacatcgcgcagctggagttcttcttcggcgaggcgccggacaccatgaacagcatgtgcacgtcgctcgctctgctcgccatcgcgctggggagctacaggagctccttcatctacgccatcgtggaggccttcacggcgacgggagacagc

SEQ ID NO: 62201 - DNA, 828 bp, Triticum aestivum
  unsure (1)..(828): unsure at all n locations
  Clone ID: PAT_TA_62201
aatacaaaaaaaaagttgagtcggttgcagaggaaaggagaggcaaacttctggagctgggaatgggggtgctcacgcacaggaggtctcggcggcgaggacggcgggctcctcgtacccttgggcgcgctgctcacgcttccgtggcgacggcgacgacgagaacgcgcagcccatctgtggatccttcctacgccggccggccggcgccgcggggggctctgcgcgcttctctgcaggcagggcaggcgttgaccttcaaccgaaagcccagcaagaaggaaggggagcaccatcgaccaaaccgaaacacacaatctgacccgagaggctgagaccacctcgccggcggggccttccgcggctccgcacagctggctctgctccggtgacgctcggcacgggcggagaaatctccggccggggcctcgaggacggacggacggacgcggctgtctcctctttccgctgccgggtctgcgtcagtccggtctgtcccctcgctggactcctcctcctcctcgggctcgggggcgggcgtgatttaacgaggcggggcgggaggtcaaacggtggcactatttcccgctgccgcgcgacagcgactgcgaggccgcgaggccgagcgcgtggaccgccgggtgggggcttcgtacgccgtcgctgtccccccagatttcgccgccagtcacgccctatcctctctccggcgaagattcggccgccgtcactggggcaaccagttccgggcgntgaattctgcgtcctctgccataaactaccgagtactgagcagccgcccaaattgcatcaccgncgtcagctcgc

SEQ ID NO: 62202 - DNA, 706 bp, Triticum aestivum
  Clone ID: PAT_TA_62202
agtactctctaccactacaccagcaccgtgacatctttgctgccaactacgtcacccgctgatggggatctgttctcttgcccaagaagataagagatgcaccgatggaccatggcagtccttcggcctatatgcgtagcaatgcacacgcgcagcactgcgtatcgaaagccagaagagcaacgcgccccaactgcctctgatgtatgaagagtctctgttctgagtctcccgctccgactactgcagccacaattggcaaatgcaatgcacatcggctgaaggaacccgcaccggtgacctaataccctacacagcaccgccagggggcctccagtatctcagcacgcatctccttccatcgaagatgactggagtacacagcttcgatcgcggccagtcagaccaaggagccccacaactacggagcctataccacagtcattaaatccaacacagcctacattaacaacatacgatgccaactactcgaattgctaggggtccgaatgtctcactctacacctacccacgagactctcggttatcgtgcttcagtgaccgactaaccctactcgtggtgctactgtttcaatcatgaatctgaaagctactgccactagtgcacacaaaaatcacagtggccatgtgcgcctttgaacaactatttccattgactttacatgcacatatcacatgaatacga

SEQ ID NO: 62203 - DNA, 503 bp, Triticum aestivum
  Clone ID: PAT_TA_62203
gtctaacgtgcataaacgtgagaatagaaaggggcggaggtaagcgataagatttacacatctccgggacaggtcgcgttaggtttggatattggacgcgaatcggagctgacggggacgagcatcggaggtttatgccgcaggatatcctctcccagtccgagtcccaggcgactggaggcatgcagggcgcgcgaagcttctcccgctgacgccggctttccttgcagttttctagatggcagcagaatggacggccgagggtaccggacgcgcccatcggtggttttgagtgcaagatatgtcattcgtacgtaaacccggagcaaagtggtactttcacgaaggcgctttataccattacccttttcaagtgagggcaataccgaatcaacttgtagttggttggttacgaggacagttgtatccctgattatcggtggataaatcctaaatttgacatcggtgctcgcatttttctgatttatttcagtttttttggc

SEQ ID NO: 62204 - DNA, 343 bp, Triticum aestivum
  Clone ID: PAT_TA_62204
acaactaccagttacaaagtattgcatagtgctttatattgctctttgtgaacttaggcgatggcaaataatagcatccttcaggtcttcgttgtttttctcatcgcgcaaggatcgacgccatgcttcaccagaccggagggtgctttcctcgcccttagaaggagcttgcttgcagcctggctgttctatgtcgtatgctacctttagaactagagtaaaatgtaagaagtgaaagaacttgtgaggctatggttctgtgccataacctgagggggtctggaggtgaaagaacatcggagtactgttgatgtcgtgactgaagtatcatccattgcctaat

SEQ ID NO: 62205 - DNA, 488 bp, Triticum aestivum
  Clone ID: PAT_TA_62205
ccttagcagcgaacaagcaggaatggactttcatgagctgatcgagatcccgcagggcgaccgccggcggtaccacgacgacgtgtcggtcatcgtcatctccctggagggcaggatctggagatcttgcgtgtaaatacacaataataaacatactagtagtaggctagagagaggaaacgtatatacagagagagagagagagagaggtgtttttgcgttgcattgcaggccctgagcagttcgttcgtgtcgtgtcgtgcgcgcggctactcccagtcccaactccatccagtcgtctttcttccccagctgcgactgtacaatatcaatcaaacgctgggtcggatcaggttctggtcatctggtgggtgcttggcacgttgcgtccagctagctgagtcacggacgatgagtcggccatgtaaaagaggatttgttcatcaattattaataaccgaatatatgagaccaattggtcgcgtttc

SEQ ID NO: 62206 - DNA, 466 bp, Triticum aestivum
  Clone ID: PAT_TA_62206
ctatgttgtcaccgtggacatggacacggggaaggtggttgctagtgtaattgtctcggcggagcatcagcttgatctaatcatgaccgatggtttctttcgggcttttgtgctctcgccgtggcttggatcaaacaggattcctcgtgcaggcaagctgggcaatgccaggaacaagactctggcagacgttctgttcgctcaaactgatactagagcagatgaagcatgcaagcaacggcgcgcgttttggagttagatgcaacaggaggcgttcaagatcctcttcggcgggattcaacctatcatcatcaggggggccagtggagtttggggagttcttagcttcgatcaagactcttgcctttccaaattttattttgctttgtatggctatcttgtaaacagggccaaacctgaaacctgacaacttttgaatggaagctgcgcgataaaccttttctcc

SEQ ID NO: 62207 - DNA, 569 bp, Triticum aestivum
  Clone ID: PAT_TA_62207
atctgcgagactttacacttcacagcctcatgactactagcgagaacagtttgcatgactgcctcatcgatctaaactcctcggatgcatgagatgtgatgacgagcagactcaatcatagccctatacctcatgaatgcgacgacgcggagctctctcctcgcgtgcatctccccgggtatataacgtcaacgtcctatggggctgatggcaccacgaccgcgccggaggcggagcacccgctgatgttcgaggcggccttgagtacactcgccgatgatgtcctgaaactggacgcaaacgccggcagctgctcatgagaagacctgccatgcgctgccgccacacatacggatccgcgcgctaaatgaacaagaaaatgacttctcgtgcgatcccgctattatggtcatggttcttgtgaggcgaacaaagaacctgcttctttttaccaaaatagacacttccttctgagggggcaacacatacgtctactgacgactgatgtactatactgtacctcgactgctgaggcgggatactagagtacatttgcatcacaaagatca

SEQ ID NO: 62208 - DNA, 450 bp, Triticum aestivum
  Clone ID: PAT_TA_62208
gttccaacagtctcttctctcccatctcctcttcaactccccagctcctcacagctcgaccaagaaaccaaccaatctgcatcgccaagatcgttgtcagctcttcgattcttgcattgcgcggtccatcttcgatcgccgcggagcaggtatcggatcaccgatgacttcagcgcagccgtggaggtctatgttctgctgcgtccgaggcgcggcggaggtggtgggcaccgacgacgaacggccctcgccgccttccacgccccggcgcaggagaggggagtcgtatgaccctgccgacgcccttccccgcgccgaaggcgtcccggctctttctgtccaccccggggtctaccttcacgcctgaccccggaggaccccccggtgaagctctccggctccaacctgcaagacctcacccactccgaccccatgttggtcaccgccccc

SEQ ID NO: 62209 - DNA, 504 bp, Triticum aestivum
  Clone ID: PAT_TA_62209
atctgccaccgcagctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatcctcg

SEQ ID NO: 62210 - DNA, 716 bp, Triticum aestivum
  unsure (1)..(716): unsure at all n locations
  Clone ID: PAT_TA_62210
atctcagatcgccgccgcacccgatctccaagaacacaccaccaccagagccgccgacccccaatccccgatggcccgcacgaagcagacggcccgcaagtccaccggcggcaaggcgcccaggaagcagctcgccaccaaggctgctcgcaagtcggcgccggcgaccggcggcgtgaagaagccccaccgcttcaggccgggaaccgtcgccctccgtgagatccgcaagtaccagaagagcacggagctgctcatccgcaagctccccttccagcgtctggtgcgggagatcgcgcaggacttcaagaacgacctccgcttccaggcctccgccggctctgcgctgcaagaaggcgccgaggcgtacctggtggggctggtccaggacaccaacctgggggccatccacggcaagggcggcaccatcatggcccagggaattcaggttggccggcggattcggggggagcgcggctaaggtcctcctgggcgcccggaatggttggtaactggtcctggcctggggacccggtggggggctggtggttccggttggccgnggccataagaaggggcctccgggcccaaggatggtggagggccaaaggaaatggcatggaaaggtccacccaaaaaaaaaaaaaaaaaaggccctaagggcttcaacgggcggactaactggaacattaccctaatccaggtttttgggggcc

SEQ ID NO: 62211 - DNA, 725 bp, Triticum aestivum
  Clone ID: PAT_TA_62211
acctcgtatagcatacaagttgcctgcacacattgccaaacccagcgtccaagtcgtacacacttgttgcaaagagagaagagacacaagaggaggagggttgcaagaaagctaaggttgacgacatggccgccgtgaggaggatgaggcccgctctgctggtgatcgtggcagcgctcatgctgctggcggtgctcggcgaggcgcggccgctgggtggcgccgactgggcggccgccggagggaccccgctgccggccgcgggcggcgcgtcgaccgtggtccaggcgctccggcggctgtacatgcagcagctgggcagcgggccgggcccctcgtgcggcaccaacagcccaaacgtccactgcccgtagatggccgaggtcgagcgccgcagctcggccggcgtacgtcctctcgggttcgaagttccaacgcgtgttttttggcgaccccaagaggtagactctggtgatcgactctaggattggatttgttgcttggtttgttggtgatttttgcccacgcgtacgtgtacgctggttggcactttgtacatacatacagaagaaaagatacacatatagtacgcaggattttgtttcaatagaacgtaggtaagctgaacaagcatcagcaatacatttgtatttgtgttaaaaaaatacatttgtatttacattacatatgtaaacctttgtttatgaattgaattgatatactct

SEQ ID NO: 62212 - DNA, 834 bp, Triticum aestivum
  unsure (1)..(834): unsure at all n locations
  Clone ID: PAT_TA_62212
aattcaccatctgtctcaaacaacaccattctttccaacaaacaaacacataattaccctttgataccccaaccttgttcttttctttcttcacacacatacacaacacacacacaatgtctgctcctcgtggtcgtctcgctggcaaaaacgccgtcatcaccggcgctggtggtggcattggtcttgagacctccatcctcttcgcaaaggagggcgcctcaatcctcatgtccgacatctcccagcctgctctcgaaaaggccgccgcaaaggtcaagcagctcgtccccgatgcaccccgcgttgagatcctgaaagtcgacgtctccaaggaatcagaggtccaggccatgatcgagtcactcgactcttggggcggcatcgacgtcctattcaacaacgccggtatcatgcacgcccaggatgacgacgccgtcaacacccccgagaacatctgggatcttacccaaaacatcaacgtcaagggtgtgtggttcggctgcaagcacgccgttctttctctgcgccgcaacaaaaagtcaaaggcttccatcatcaacaccgcttccgtcgtcgctcttgtcggagctgccacaccccagcttgcctacactgcctccaagggtgctgtcctcgctctcacccgtgagctcgccatggttcacgccagagagggcttccgcttcaacaacctctgccctgcgccgctcaacacacctcttctgcaggactggcttggtgatgaccaggctaagcgacaccgacgtgaggtccacttccccatgggacgattcggcgaggctattgagcnagctcacgccgttgtcttcc

SEQ ID NO: 62213 - DNA, 791 bp, Triticum aestivum
  Clone ID: PAT_TA_62213
cggccgctcaggcggcgggcgggtcacccaaggtaaccctcgttgacatttttttatggaagaaactccgcgagcaccgcgtgttcgagccgggactcgaactcaggtgggctggcagtaacctcaactgcccagccaacgagtcgactccccgtcctccccacttctatcatcaataaagactaatggatcatctttcattcaactctctcgttctttactttttacttcaaacagttcgttcgtctgcacacaagcatgtaggtagagatactactagcaccccacatgcatggccggctgggcactgcacatggccggccagcagcagcgggttgtgatagccaacgtggacagtgccagttttgaggctagctagaaacgtacgtgatatcatcatccagctgaatgacccatcatctactgtacgtaatttcacaaagcaagcaccactgcacattcggtttaagatagactcggctggagccgcaacatgatcacaaatctcgtacgagacaataggaaccgcaggtaaacagctcactagtacgccactcaatggatatcagaaagggggcattggcagatggcaactactcctagtagtttgattttcacgggatggtgaatttcaaccaattagttcagtcgatggaaacacaaagcttttctgtcctcacgacaagctagccatgatggtctacactctacaggcccctgtggattcagttgcttgcttgccatgcttgcccggtagatcgatatggacgagatagacagttgctgctact

SEQ ID NO: 62214 - DNA, 493 bp, Triticum aestivum
  Clone ID: PAT_TA_62214
ttaccttgggccaacattggggagtccaagggagctttcttcgcatcctatgaaagagcaggaatgcgacgctagcattgccgagctcttggcagcgtctttaattctttgattagctgagtagcagatgcgccttttgcaaacagctgtcgggctgtgctacaagctaagcagttgcgataccttaaatcatgtctatgacgatatcaatatacccgatcggcgtgcggggagtggggatccggccgaaggagctcagaactgacggcctaggccgaattgactctacctccagcctatcgcgaattccggatattgctggcaatgaaggaagctatcgttttgtgtaggttgtccgttacgcggtcgttgcgcctccatgcgaccagcgtcttgagaccggtggacaaacaggcttttcatcaggtcgatacgagcagggttagttacaaacttacaataacaatattggaatctcgcaattacccaatcg

SEQ ID NO: 62215 - DNA, 420 bp, Triticum aestivum
  unsure (1)..(420): unsure at all n locations
  Clone ID: PAT_TA_62215
attcccaaacctcaccctagaaaggtcgttcccatttccgatatccacgtcatccctcctactctcatacaaaatgcgctgctattatctaggctgctaacgccaagaaccgcaccaacccggtatctgactacatttgctacgacccactttctggggtcctcgtctccaactttccccatccctactggactgccatcatgccacacacactaatagccactgagttgcatctcgggaccgatgaccggcngctctcatcatctatgccggtacttctatgcgatactccctcggtgacacccccaaaaactaccttatctttcactgacaattcgtctacggtggcgctcccctcaccccaggataccgaaatctgaactaccactactgtcgcgcgaagccgatcatgtcctcaga

SEQ ID NO: 62216 - DNA, 781 bp, Triticum aestivum
  unsure (1)..(781): unsure at all n locations
  Clone ID: PAT_TA_62216
cggccgctcgaggcggcgggcgggattactattccccctctcgatccagatcatatagaggaagccaagctcttgatcgaccaactcccttcccatggccaaagagaaagatagtggtgtcctaaacagcatggagctggtgcgaaaagtgtcaccggcccggccgacgacgctgcacgacatccccgacaagctcctcaagatcatcctcctgtacctcctcgcctcgccccactggcttgttcgcgcggcggccacctgtaagcgatggcgccgcatcgtcgttgaaagacacttcttcatgtgtgacattcccgccaccaatccctcatctcttgttgcaggccattaccataaccacacatcccctgtcaatggccgccgcctcatcttcgttccttcctcgtcagcgcttgctgtcaatagccgccacttctccctggacttcctccctggaggtgacagcgggtcatgggagatcgtagatagccaccacaccctcctcctccttgtcaagaagaagactgggtggagacgctgcttccctgacctcctagtctgcgagccgatcacacggcgttgccaactaatcccacgcgtggagaaaatgaaataccacccatgtattggtgtattccttgatatgcatggtcgcagaggagctatcacgtggaatggacacgccaccgatacaatgtcacgtttcagagtgatttgcgtgctctaccatgaattcaaaggngtatctggtaacattgggacagccaagggcttcgtgttc

SEQ ID NO: 62217 - DNA, 552 bp, Triticum aestivum
  unsure (1)..(552): unsure at all n locations
  Clone ID: PAT_TA_62217
gactggcggcggccattggcttcttttcgcagtggcgggattcgaaggagaggcgtttgcgggtcagctcggtcgcccatggattacgagccggcccaatcgggagcaacccatggattacgagccggccaagatctgcagcttgtgcgggaggaaggcggcaaggtggatctcatggagtccagcaaacctggacgcacgtactattcgtgcgtgtttaaccagcacggattcatcgaggctgctgttgttgggtgatcttcgggacaaagtgtagatgcttgaggctgctgttgctagtcagtccagtgagagagaagttgatgcgttgagagaggaattggagaagaagactgaagttatttctgaaattagtgctagctgtgacaggaaagatgtgattcagatgtataaatttgcagtttatggtttgataatctttgtagctggtttagtcgcagggttcatgctatcttagttcctggagatgtataatgtgatgctatcttaattgcaatgtattgtatctgaatcatatnttgaatggatttg

SEQ ID NO: 62218 - DNA, 640 bp, Triticum aestivum
  unsure (1)..(640): unsure at all n locations
  Clone ID: PAT_TA_62218
aattcaacaataccaccacaaccactcccaaagcttcttaccatggcgactcctctctcgccaaccatcatagtgatgacactattgttggccccgctggctatgctctcctcggcgcacgaggaccaccaccacacaccgactcaagcaccgagccctgctcaccatcttggccatttttccccagcgccgagccctcatcaccatcacggtccggcgttggcgcctgctcccgcccacgggcggcaccgtcatcatcaccatgctccggccccatcaccgatccaccaccatcatcacaaagctccgacaccatcgccgatccatcaccatcatcaccacgctccagcgccgtcacagatccaccaccatcatcaccatgctccggcgccgacgccgatccatcgccatcaccatgctccagcgccattaccgatccatcaccatcaccacgccccggcaccatcaccgatccaccaccatcgtcaccacgctccagcaccgtccctggtgcacctcgatgccgacaaggtggacacttagagtgatatcgtctcctatgtatatcttcatcttatttttcccagngaagtgtttaaataaaggatcatttgatggtatatcanatctcacatttccc

SEQ ID NO: 62219 - DNA, 769 bp, Triticum aestivum
  Clone ID: PAT_TA_62219
aaacatcggcacgccacgcaagaaatctctctctccctctctctgtcacacacgcgagtcgccaagaagaaagtcccaaactttttcctctcgatcgatccgtcctcctcctcgtcgccacaggagtttctccccggattcgccgccctctccttctctccagcgagcgagcgatcggatcccgccggccggaggcccaagccccgcccgatctacccgatggcagccaacgccggcgccggcgccggcgggagcaagatccgcaacgccaagctggttcttctaggcgacgtcggcaccggcaagtccagcctggtgctccgcttcgtcaagggccaattcgtcgagttccaggaatcgaccatcggtgcggctttcttctcgcagaccctggcggtcaacgatgagacggtcaagttcgaaatctgggacacggccggccaggaaaggtaccacagcttggcgcccatgtactatcgcggtgccgcggccgccatcgtcgtctatgacatcaccaacgcggcctcttttacacgtgcaaagaaatgggttcaagaacttcaagcacaagggaatccaaacacagtaatggctcttgctgggaacaaggctgatatgttggaggcaaggcaggtgccagtggaagaagcgacgacttatgcacaagagaatgggctcttcttcattgaaacgtctgccaaaacagccatcaatgtgaacgacgtattctatgagctcgcaaagagactgctcgcagggcagcaggcgc

SEQ ID NO: 62220 - DNA, 179 bp, Triticum aestivum
  Clone ID: PAT_TA_62220
tccgccgctccctcccccgaaaaccctagcctttccccgcgccgcccccgccgtcgccccgtcgtccccaggtaaggtggatggtgagatggtgaaattcaatatcgtttatccccaacggtcactttaataagcatttgggggaactatgtgaagacgtggttcaaccggcgtcgccc

SEQ ID NO: 62221 - DNA, 407 bp, Triticum aestivum
  unsure (1)..(407): unsure at all n locations
  Clone ID: PAT_TA_62221
attactctccgcangcgaactgaatccaccgcgccgcggaccgaatctcccccatcccccgggggaggcgacgactccgcagaagacgaaggtgactgtcacgcatgcaccgagtgctgatgcgtcgcaacggcagggaagtcaccttgacctgtgccggaggcttcggtgaagagccagtgccgggctacggtgccgccaagatctgagagacgaaccactcccggaaaccatatcgaagatatctgttctgcggcgaggactgatgcggagtgaagacattcgtacccagatgctccgtgctctcttaagagagattaggcaccttatacagctccatgctatgacattttcctttgagacaataatattgtagaagtctcttgctgtgcgctattcactccctt

SEQ ID NO: 62222 - DNA, 467 bp, Triticum aestivum
  Clone ID: PAT_TA_62222
ccgctcgaggccccggccgggcccgggatctaaaccaaatctataccctgtttcactactgtcagaacacttcgaacaatggcttcaggcgcagttaccgttcctcctggaaaatacgagtttctcgtcgttgttcatgacaagcccggtatgcttgagaagcgacttgaagttccaggacagcatttccataacatgaaaccccatggtgaaaacggaaactggaaaaagggaaggggcctcccccactttggttcccaaaaacaaaagccccagaacttggaattcccccgaaacacaccttgtttgctttgttgattccccaaaacaagggcgaaaaaacttgagcaaggaaatctatgccccttctggggtttgaaaaatggacaaggtccaaatctaccctttcaaggctgctttcgaattcaactaaaatcaataatccaatctcttttactcgattaacc

SEQ ID NO: 62223 - DNA, 635 bp, Triticum aestivum
  Clone ID: PAT_TA_62223
actaccgaacgactcccgagtacgcgacagcagcaaggacgtgcgtcgataatatcacagatattatttcctcagtcccataccaactggggtggtttagcaaccgcagggaactccttgagagagccaatctatccgcatttgggtgtggagaggaagatgccctcaagggtctaccaggttatttcttgacttggcccctgacctgtgtccagggtcaggactacacgactgatgcgcagcgagcatgggtcaaagggcgacttcaatttatcggctctcatctgggcgtcagatatgcccacgttctacgtcaacttaacatccgcgtcccgtcaatggttatccgccgagacggcttaatggcccacccatattctggtggataccattttgaaaagctcttggcgtcccagaacgcacccgcaatggcaagatatactttgaattccaatccaccacaccatggccttccaaaggaacgggcccacccacaaaaacatgaactggtgaacaaaggttccgggtccatggataaccaaaaaaaggtggcgccagggttggttccgctttaaaaattccggctttatatggcctggagggtggattgctgggaaggttgaattattggggtc

SEQ ID NO: 62224 - DNA, 789 bp, Triticum aestivum
  Clone ID: PAT_TA_62224
aagtgactgactcagtttatcagacccatttttgtctcgaggattcattcccgtcaagaagtgcatccgacttccgggtcaatggctggccgccggcgaggacagcgcagcaaaaacaagctcaagacagcgtcgaggagcgacatcccgtcagggccgacaaccgtccaccaaatccccgatcacctcctcgagctcgtgctcctccgcgtcggctcttccgtcgccctcgtccgagccgccttcacctgtaagcgctggctccgccttgtcgcggacacctcattcctggcccggttccgctccctccacgcagcccacgtcgccggtcactaccacgtcgtcgaccggccctaccgcgagaagctgccgcccgacgggaacaaccaggtgttcgtgccagaccccacggctgccgacgccatcgacagacgccacttctccctcgatttcctcccggaatgcgatggctcctcgtcctgggagctcgccgacagccgcggcagcctcctcctcttttacagggcgagaacagactggacggggcagcttcgcttcccggacctcgtcgtctgcgagccgctctcgcgacggtaccaggggatcgcctacccgccggcgatgcgtggccacctgtgcttcggcgcgttcctgctcgacggcagcgccgtcgacgagacgggtggctgcaacggcatgtcaaacttccgggtgatcgtcgcggtctacgaatacgtcgcgcatgcccgtgccgcaccccgggcctgcgtgttctcctcgggcgccgac

SEQ ID NO: 62225 - DNA, 734 bp, Triticum aestivum
  unsure (1)..(734): unsure at all n locations
  Clone ID: PAT_TA_62225
aatctcagaaacaagctctcaagccactatctatctagctagctactagctagataacacacttgactcgatcgatcatcagcaacgtaaacccatagatcgatcatggcggcgcgcgccattgtcgtcctggtctcgctcatccttgcggtggtcgccggcggcgcgtcggcgcagctgtcgtcgggcttctactcccgctcgtgcccgggcatgctcaaagccgtgcgctcggcgctgcggccggcgatcgccagggagcggcgcgtgggcgcctccatcgtccgcctcttcttccacgactgcttcgtccagggctgcgacgcctcgctgctgctggacgacgccccgggcctgagcggcgagaagaacgccaagcccaacaagaactccgtcagggggttcgacgtcatcgacgccatcaagacggccgtcgagaaggagtgtcccggcgtcgtctcctgtgccgacatcctcgccatcgccgccgaggagagcgtcgtcttgctgggtggcccgagttgggaggtgaagatgggacggagggactcgacgacggcgagcttcaacggcgccgagaacaacatcccaccaccgacatcggggctcgcaaaccttacgtcgctcttcgccgcgcaggggctctcccagaaagacatggtcgccctctcaggagcccacacgatcggncaagcacgctgcacatttcttccggagcacatctacaacgacac

SEQ ID NO: 62226 - DNA, 802 bp, Triticum aestivum
  unsure (1)..(802): unsure at all n locations
  Clone ID: PAT_TA_62226
atcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcggngccctccagttatcgatctatctaccatctcgtcgtcttcgtcagcaagttatcttcagttcctgtgtcagtcagtctgagtcgtcgtgtgtgtcgttgagtcctgtggtgtttttgatcgcgagctcgagtgtcgctctgtccggg

SEQ ID NO: 62227 - DNA, 653 bp, Triticum aestivum
  Clone ID: PAT_TA_62227
agcttccgcaccatacttgacacgtgatcaccctgatcacgagggcatctatctcgttctcggctgataatatgaatacacgctcctattctctgcatctgagagctctcttcgaagaacccctgcttactgatcatgcatgtcctgaacaagagtgccaacgaactgttctgcaacgattccactaccctctacactgtccactcctacgatcactctgaactggatgacatgaataactgcctcggtgcatgcaaactgcagaaaagaatacaattgagctgctctccgcatacgcatctacaagcatccataacgactctgacgcgtgcacccacaacacttatttgtccaatgagccccacttaatgagcaagggtttactgaacctattgccgtagctaacctactataagactgacttgacctgagatctgatcttgatatactgcatcgaagatgtacctcaatctcccggccagcctcattgcgatgctggacaatatacacaatctaaacatcactgagacgcgttcgaatgacacttgatttctgagaatacgacgcattatgctccacatactatttatattggtgctaacacactggatcttgactctgatgaatggtgtgtgctgcatgctgctacgagc

SEQ ID NO: 62228 - DNA, 792 bp, Triticum aestivum
  unsure (1)..(792): unsure at all n locations
  Clone ID: PAT_TA_62228
atttcatagcagcaaccatgacagaacaccttccaaataagcaaaaaggccgcgagagggatcgcataaagaggaccaaagatggagtcactcagttgccgcgcaaaaagttctatcgccagcgagcgcatgcgaatcctttctctgaccatatgctagaatatcccaaatcgcctgatcatatggactggtcgccatacttccctcactatgttcaagaaggaacatcagaagactcttcaaagcctcctcgtctgacaaaagatgttgagattgtcgatattggttgcggtttcggaggtctcacagttgctctggctcccaagatgccggatactctcacacttggcctggagattcgcacacaagtggcagggtacgttcaagagcgtataaaagcgctgcgatcacaaaactcggacaacatgtatcagaacgttgcctgcatccgagcaaacacgatgaagttcctccccaacttcttcaggaaggcccagctctccaagatcttcatctgctttcccgaccctcacttcaaggccagaaagcacaaggctagaattgtatcaacaacactgaactcggagtacgcttatgcgctccgacccggtggcatcgtgtacaccattaccgatgttgaggatttgcatttgtggatggttcagcatctcgaggctcaccctgccttcgagaggatttccaaggaagaagaagaggcggacgagtgtgttcatgtcatgtcgactgaaaccgaagagagcaagaaggtcacaaggaataacnnggacaaag

SEQ ID NO: 62229 - DNA, 473 bp, Triticum aestivum
  Clone ID: PAT_TA_62229
gtgttttctctaggcttgcagagccgaggtaacagagaaagaaagagagggacggagaaattttagtggtgtagaagctgagcagagctcaatggggctttgctgtggccgctcggatgtcaaggtgctccccaagaacaactccttggcttcctcgccctcgccgtccgttatagattccagggatggcgccaataacaagcagcctcaaggcgtaaagaaggaaggcaaagataagaaaaggagcagccttgaccggcccgccatggcgtcgccccgcctccccttccattgctcgacccgacctaatgtaatagagtttgcagattttcagaacaagagtgcatacagtatacagtcctgtaggctctcttattaccttacgcccgggcttgcctcgcttgttccgctgaagatttcatttgtactgtgtccagcgcgtactgttttattcatggacggccgtgtgattc

SEQ ID NO: 62230 - DNA, 571 bp, Triticum aestivum
  Clone ID: PAT_TA_62230
aatcaccatcctccacctccacctctcccaacacaaggcaatcccacgcagagacagaaagaagcagcgggggcggcgaagatgtccgggagaggcaagggaggaaaggggctgggcaagggcggcgccaagcgccaccgcaaggtgctccgcgacaacatccaggggatcaccaagccggagatccggcggctggcgcggcggggcggtgtgaagctgcatctccgggctcatctacgaggagacccgcggcgtgctgaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccaccaacgccgggctcctccagccggcaacgagataaattgtcactataaagctagcagaatttgtccagggttcgtgagtgtcttcggcgttgtttgctttgctctgttcctgcttgatgttgggatcgatgtactagtaccaagactgaatggaaatcgaatttgggaattac

SEQ ID NO: 62231 - DNA, 733 bp, Triticum aestivum
  unsure (1)..(733): unsure at all n locations
  Clone ID: PAT_TA_62231
actaccaggtgctcgaggaggtcgatcgatggcgtcggagaaagacgcggcgctcgcccccgtgcccaacgacaaccccaccatatttgacaagatcatcaaaaaggagataccttctacggtggtgtatgaggatgagaaggtcctcgctttcagagacataaatcctcaagctccgacccacattgtaatcattcccaaagtcaaggatggattaaccggcctttcaaaggcagaagagaggcatgtagagatacttggctgcccctctacgctgcaaaagttatcgctaagcaggaaggacttgaagatggctaccgtattgtcatcaatgatggccctagtggatgtcaatctgtttaccacatccatgtccatctccttggagggaggcagatgaactggcccccaggctaaagaagctcttggttgtcggtcaatcttcatggcagctatgtcctttgcatctcaatcgaataattcctgtaattgacataacagtttgtgcgaggaacatttgctctatctatggaatagccgaaaccatcctgctgtgaatgtatggacaagaaacttgaagctgaatcgtctcattgatgcgtgttgtgttctttctattcagtctgctattttacttgtttagtactccctctgccccataatataagagcgttttggacnctnnnnnnnnnnnnnnnnnnnnnnnnnnnnnnnnnnnnnnnnnnnnnnnncc

SEQ ID NO: 62232 - DNA, 569 bp, Triticum aestivum
  Clone ID: PAT_TA_62232
attggtgtcatcggcatggccattggtggcgaacgccgtcttaccattcccgcccacctcgcctacggctcccgtggcctccccggcattcccgccaacagcaccttgatcttcgatgtcaagcttctggagatcaagtgagcgtagcaactgctatgacttccactagtttgagttgccgactcgacaccagcctcgtataataataccccttagagagcggtggcagaaggcaataaacaagttgatggtacggagatacctacccttcccaggtttctatatatcatctgctacgcgatcgatatcgtgccgcatatgaggataaagagctctgggcctgtgcccgacctctacaaagagccaatgttttatgcaaaaacatgaggggagcagtttaggtggtaaccaggtgtgatggggcgaggaccgtcctgcgttgcatgatatgaattggcgtacgataaaaagggtcattgtttctttttgctgttgattgcggggtttccctcgaatctggaatgatattgtagagttgagcagataaaatgttatttcttgcctcttcg

SEQ ID NO: 62233 - DNA, 766 bp, Triticum aestivum
  Clone ID: PAT_TA_62233
gcacgacatataatgcaaatagaacggccaagagctaaaatcatgagcagcagggtggatgagtcggagctaaggaaggtcttccagatgttcgacaagaatggtgacggccagatcaccaagaaggagctaggtgagttgctcaagaacctagggatctacatcgcggacgacgagatggacgcgaccatggccaagattgataccaacggtgatggctgcatcgacgtcgaggagttcggcctactatatcgctccatcctcgatgaaggcgatgggcctaacggtggcaacatgggcgacgaggaggaggagatgagggaggcgttcagtgtcttcgaccagaacggtgacggctatatcaccattgaagagctgcggtccgtgctggcaagcctcggcctcaagcagggtcgcaccgttgaggaatgccgccagatgatcaacaaggtcgacgccaatggcgacggccgcgtcgacttcaaggagttcagccaaatgatgcgcggtggcgcggccaatcatgaggattgactttattgaatgggaatggttcattgtggtactattagtagttgtagataattaattcactttaacatgccaacgattcaatgtggattgtatacatatataaatacaaatacatgagtatgaaacgaccaactcttctcttttaaaaagacggtgaggctgccttcgtccatggtttcatttttttggctggattggattcattatatgttgtaaatggtatttatcatgg

SEQ ID NO: 62234 - DNA, 622 bp, Triticum aestivum
  Clone ID: PAT_TA_62234
actctcacttcccgaagaagtaacagagcaagttcatccattctcaactctcagaaaacatcaggcggcagcagacagcggaagctagcaatggccggagatctgggtaagagcagcggcggcgccagggtgtgcgtgaccggagccaccgggttcgtcggctcctggctcgtcaggaagctcctcgacgcaggctacaccgtccacgccaccatgcgaggcaccggagacgaggagaaagtggggcggctgcggcggctggtggtccccggcggggtggcgccggagcggctggtgctgttcgaggccgacctctacgaccccgccagcttcgcgccggccatcgccgggtgccagtccgtcttcctcatcgccacgccgttcgccgacggcgccgcggaggcggccgtgggcgcggtgcgctccatcctccggcagtgcgaggagtccggtacggtgaagcgcgtcatccacaccgcgtccatgtctacagcctcgccgctcaccgccgccgggtacaaggacttcatcgacgagtcctgctggaccccgttcgacgtggactaccctctccggagtgctgacttcgataagtacatgctgacgaagctcctgtcagaga

SEQ ID NO: 62235 - DNA, 361 bp, Triticum aestivum
  Clone ID: PAT_TA_62235
attcctcggcggactccctccctctctcctgccataatatcatcgtggcctctccctcccgctccctccatcctctctgattgcccccgcgctcgccatggaggccgccgcgtccacgctgttcctctccgccgacgcgtccctcgccgccggtcgccgcctcctcctcgtcccttctcggcccgcgcgcgcggcacggaggggcgccgcgcccagcaggtgccggcgggcgtccgtccgcgcgtacgtcgaggtggccgcgccagcgccggcgccggcctctggaaacggcctcgtcgggaataacaacggagtgtacactgattggagacttcatgacgtacagggaggatctccatgc

SEQ ID NO: 62236 - DNA, 671 bp, Triticum aestivum
  Clone ID: PAT_TA_62236
aagactagagatacagagcagagcagagctgatagacagccggacagcgagagagagggagggaggctgggagggtgtgagcggaaggcggcgtgcgcatggcaggaggagagcatggagccaacggcctgcaagagcacgaccacgccggagctctggaggaaggaagaggaggaggagcgaatcaaccagcagggtgcgaggatgcagagcaagctctgagcagcaccggcaaccagcccatgatctccgtccagttcgtgcagaaggtcctcgccgagatcctggggacctacctgctcatcttcgccggctgcgcggcggtggccgtgaaccagaggacagccggcacggtgacgttcccgggcgtctgcatcacctggggcctggcggtcatggtgatggtctactccgtcggccacatctccggggcgcacctcaaccccgccgtcacgctcgccttcgccacctgcggccgcttcccgtggaggcaggtcccggcctacgcggcggcgcaggtggtcgggtcgacgttggcgagcctcacgctgcggctgctgttcgggggcgagccggagcacttcttcgggaccgtgccgtcccgggtcggacgtccagtcgctggtgctggagttcatcatcaccttctacctcatgttcgtcattctccg

SEQ ID NO: 62237 - DNA, 812 bp, Triticum aestivum
  unsure (1)..(812): unsure at all n locations
  Clone ID: PAT_TA_62237
aaaactcatccttaaaacctaatcaaacctgactaattcgcaacgtcggtagacccgtaaagccggcgcaatgcagcgagacgatcgctctcgggattccgagggctctggttctcgtcgccggtggtacgagtctcgcgatcgcgatcttactccaagagctggagatcagggagactcacactcacgctcctcctactcgcgtcagcaaccgccataccagcaacaacaacaaccttattcacccatgtatcaatcaccaacgcagcagcgacagtatgaaccgcaaagacaggatcaattccaaatgtaccaacaatcaccacagcaaaatccggcattaccacaacgaccacagcagtatcagtatccgtaccagaaccagtatcagcagcagcagcagccctactacaacgcgccgcctcaatcgatgcctggttataatagtccttaccagcagcagcaggccctgcaacagcagaacccgcaacgaccgcaaacaccttcgagtgtcttttcatcctccagcgacacatcaacgtcgctgctagatatttcacgattcaaggatacgaaggaatatggtggcctacttggcacatttttcaaggcgccctcggaacgggttaaacagcgtctccaccgaaagaaaagtaagaagcgccgcgtcctttactttggcaactcttcctcccctctctgtgactctgatttagcttatggaaacggctatgtgcgancacctaagagccgtaccttnaagccccgaaagtcaagtcgtatttctggggcagggtacgggtctgccgccg

SEQ ID NO: 62238 - DNA, 743 bp, Triticum aestivum
  unsure (1)..(743): unsure at all n locations
  Clone ID: PAT_TA_62238
ngacacgatcaatatttcattgcacctacgacgtctaaaaaccacgaccagaagccaaaatgtccttgacaacagatcccgatccttccgatggctgcccagcctttatccccctcgaagcgaaccctgagcttatgaccactctcattcacaagctcggtgtctcggacgctctcgagatccacgatgtatactccctgaccgaaccagagatgctggcattcatcccccgtcctgcgctcgcccttttgctcgtattccccatcagtgccgtgtacgagagtcaacgaatggctgaggacagcttggtggacgaatacaagggcaagggagatactgagcccgtcttgtggtggcctcagacgattcgaaatgcttgtggtcttatgggattgctacacgctgttaccaacggaaacgcacgaaactttatcgaggagggctctaccctcgacaaggtcatcaagaagagcatgcctctcgacgctcgcggccgcgcaaaggttctcgaatcgacacccgaactagcgactgctcataaagaggctgctacccaaggcgacacgcccgcccctgctgctgaggacaacgtcgagctgcactacgtttgcttcgctaagggaacagataacggactttgggaactcgacggacgacgaaagggacccattcgacgaggcgacttggatgataatgaagacgtgcttagttccaaggggttggcactgggtgcgctcaagttc

SEQ ID NO: 62239 - DNA, 667 bp, Triticum aestivum
  Clone ID: PAT_TA_62239
tcaggcaactatgcagcctatgctagcccttggtctgctcctgctgctgagcctcgacggaggtgtagccgtggcggcggaagacggccagttcgcctaccaaggcttcgccgccgcgaacctcaccctggacggcgtcgccgccgtcacgcccaacggcctcctgctgctcaccgacacggagtaccagacaacaggccatgccttccaccccgcaccactccgcttcctcgacagctccaccacgatgacgaacagcgccgccatggcgcggtccttctccgcgtccttcgtgttcgccattaggtcaagatacgatggcctgaccagctacgggcttgccttcgtcgtcgcgctgacctcgaacctctcagctgccgagagcgggcggtacctgggcctcctcaacgcgacaaatggcacggccagcgatcccatcttggcggttgagctcgacaccatcatcaggggcggagccaggatttgagtatgaggggggcgaagaggccaataccaagaaatcgtatataacatatacaaaatacgattataggcgtcttttagatatatatcaccgggatcaaattgcaatgacatatactccctccgtttctttatctaaggtgcattttttataatttaaaagaaaatgacacttttattacta

SEQ ID NO: 62240 - DNA, 750 bp, Triticum aestivum
  Clone ID: PAT_TA_62240
aaaaaaaaaaagcgctgcctccactccacctactcccctccttgttttcagcgccagccaaccaaaaccaatcctctcgacctctcccaccgactagcgcctcccctgatcccctcgtccacctcttgtagcccgagcaccggccggccactggagctcctccgcgaccagcactcctaggagaacgccatggaagctacaaggagctcaagccctccgcctggccaagttccgctgcgccaagcctgcttcctctccagcatcgcgcccgtcgctgctggcccgtcgctgtgccgattctcctctgcaacgatcaacagaactctcgccgaagccgccgcccctgagctccacccgcgccgtcgttgcctggatccggcgccggtcagccggatccgcaccgtctgcacctcgcccgccttcctgggagcccgctgccgctcgagtccgcgctgcatcctcttcttcctcgtgctacgtcctcttctttcccctgcatcgagaggagcagagtgccgcgtgcagtcgtgttggccgcagcctactctagcgaggcccagcgcgccccttcgtggcctgccccgcctcatccaccgaactgggccagggccaaaagtgagcagcgcccaaccccctctcctgttcctgttgggccaggaaagttcagcccatagtttttttcctgttgctgtgaatttagctatttttcataggattgctattttacagaaaagcccttgttgaccatgc

SEQ ID NO: 62241 - DNA, 381 bp, Triticum aestivum
  unsure (1)..(381): unsure at all n locations
  Clone ID: PAT_TA_62241
ngaagtcacgcaagaagcacacaagaagctcatagccattcaaagcctcttcatctccgaagctccaacccaaccgaggatgtcttgctgcggaggaaactgcggctgcggcaccgcctgcaagggcggcaacggctgcggcggctgcaacatgtacccagaggccgaggccgccggcgccaccctcctcgtctccgccacgaccacccacaaggctatctccggcgccatggagatgggggcagagaacgccgcgctgagcctgcacgcagcggaaatgaagcaccagctgcgcctgctcctgctgaagctggtaaaccgatcatcgaccatatgcctgcaccgcgccgagcgtacctcatcaatccgtaccgatctacc

SEQ ID NO: 62242 - DNA, 210 bp, Triticum aestivum
  Clone ID: PAT_TA_62242
acgtaagagagagagagagagaagaggagcactcgaccccgccgtcgcagcgccaaccaaaccctcgtcgtcgtctccgatcccgccgtcgccgccgcagccatgccgttcaccccgggaccctactccgggaagagcaccctcgccctctgctccagggtctccgccggcggaatcggagacggctacgggtgcgtgaagctcggcata

SEQ ID NO: 62243 - DNA, 651 bp, Triticum aestivum
  unsure (1)..(651): unsure at all n locations
  Clone ID: PAT_TA_62243
aggaaaaccggattccgaaggaaaagganagactaaaccctgaaaaaaaaaaaaaaaaaaaaaaaaaaaaaaaaaaaaaaaaaaaaaagaaaaatagaaaaaacataaaaaaaaaaagaggaaaagaaccccccaatcccgccccctgcccctgctcttcctccctttccccgacccctggggctgccactgagtctcctgccctaatccgggcggaggaggagatggccccgggggtggaggggagagcggagccgggggcccccgagggagcgatgcaccgccccctggaccccgggggagtggcgaacccggcacccgtcgaggcgggaaaggcggcggcggtgctggcggtgaaggttccctaggaggcgcttgtgggggacgcgcgcgttgccttttcgacccgctgcaggtgggggtgcgcggcatcttgctgcccggcgctgatctacctgcatctggcgtcgccgccgttttaggggagctgatcctttgtccagggggtcgccgacgtggaggcatcggtgtgcctctgtacggcgctccggccaatatcgtggggatgggccttaacctgcgcgtcgactctcgggtaagggggaactactgcgggaagagcgccccctcggaattcgcgtgcccccccta

SEQ ID NO: 62244 - DNA, 626 bp, Triticum aestivum
  unsure (1)..(626): unsure at all n locations
  Clone ID: PAT_TA_62244
gccgctcgaggggccggccgggcccggnntttccaaaaaaaaaaaaaaaaaaaaaaaaaaaaaaaaaaaaaaaaaaaaaaaaaaaaaaaaaatccctcacaccttgaatcgggcgtcttcacaacaaaaaatcctgtcccgcatccgatcaatcatggtctctatggaacaacacttctctcaacgatgcatttggtgttgatgcaccgggcgacaaacccgaagtaacaaaggtcaacagcccttatctattgggataccgtcctacaaactccaatggacccgtaattctcggcatcggaggcggaggctacatcgaactcgtgcttggccgcgaaggcggggatgtctccaagtgactgaatacccttgggttttacgcttttgttctggtgcaccggtttcccaacagggatacgggtccacaagcaccgttggatgacgccaaacgagctttgaagatcatggcacagagcggtcttgcaccaaaaggtgtcaatatttgtggcctttcgccaggtggccatcagggcgctgaacttctggcagaataccctcaggggtgaacatcgcctgatcctgaaatccctcaagccgaattcgccatccttggttatggaccgatt

SEQ ID NO: 62245 - DNA, 763 bp, Triticum aestivum
  Clone ID: PAT_TA_62245
ccggccgggccgggaattccaccgcctcacccaccgccaccgcctcccacgctgcactccggcgacccgcgaagatgcagatcttcgtcaagacgccgtcggggaagacgatcacgctcgaggtcgagggcggccacgacatcgccgacgtcaaggccaggatccacgacaaggaagatgtgccgccggatcagcagcgcctcatcttcgcagggaagcagctggaagaaggccacacgctggcggactacaacatccagaaggagtccacgcttcacctcgtgctccacctccacggcggcaggggcggcaccggcaaggggggaacctacccgaagatcgagcccaacctccttcagctcgccctcaagtacaggcagcttaagctcgtctgccgcaagtgctatgcacgccttcccgtcaggtctgccaactgccgcaagaagaaatgtggccactgcaacgagacgaggaccaagaagaagctgaaacccagggacccatgaagcactgcactggccagcaagagaaagggatgcccaagtgacacgcaccagctgaatttaccctaccgtctccttatattagctccttatattagcttcttgttaccttttaagttcctgctgctgctgggtttaaacaccctaaatgcgtactctagctgaatagtactatggattcctgttgcatcatgggttctgttgatgatcccctaaatactcttgatggtgatgccgtgcttaagggatgctagttacgt

SEQ ID NO: 62246 - DNA, 532 bp, Triticum aestivum
  Clone ID: PAT_TA_62246
ccgtacagcgtctccgtctccggagagaagcttgtgtccaaacggaaggggacacggggtggaagtggaacgttcaccgggaaggggagggaccaacgccgccgctccaccgttcaggcccggtagcagtggaaatgtgcgctctcaagccttcgacgctgggatagtcccacctcggagaaattacaagcattacgaccagtttatacatcgaaagcttcgcagagttaccgtagaacaattgttctacggtcttggcttaaaaaaagcttcgcagagtgctcgccgagttcggtggcgcgaacttgtaacccagatgatgagggggtaattgacagtcactgctggcccggtcgtgtcggcccacagcccaattacatgaggggagcaggcttctgggcccggtcgtgtcggccccttgcccaattacaagtggggagaagctgactgtcattttttatttttctttcttttttatgattcctgtttgtttatatttttttatacttacttcgctctatttacatcctat

SEQ ID NO: 62247 - DNA, 731 bp, Triticum aestivum
  Clone ID: PAT_TA_62247
gccgggccggacagatcccgaagccaaaggtaatccaatccgcacataaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccg

SEQ ID NO: 62248 - DNA, 867 bp, Triticum aestivum
  unsure (1)..(867): unsure at all n locations
  Clone ID: PAT_TA_62248
cgggcgctcgagccggccgggccggggtcttcccctccctcgcgagtccgaagtcaaggtgaaaaccctcgaggcgaagcgagagtcagataggataccgcgagagacgagagtcgagtgagagggtggaagggaagccgagatgaagctcaacgtgaagaccctcaagggcacaagcttcgagatcgaggcgacccccgaggcctcggtgggtgaggtcaagagaatcatcgagagtgctcaggggcagaatgtgtaccctgcggatcagctgatgatcatatatcaaggaaaaattcttaaggatgataccactctggaagttaataaggttgcagagaacagcttccttgttataatgctgtctaagccgaaggcgtcgtctagtggtgcttctactgcttcaaagacacctgttagtcagtctcaacctgccactccacctgcccctgttacctcagctgcaagatcaccaccttcacaggcacctgttgctgcatctgaaccggcgcctcccagtgcacagccttcagctgtctctgatactccatctcctgcagtaactgcatcaggcgatgctgatgtatacagtcaggctgcatcaaaccttgtctctggcggcagtctagaacagacagtccaacaaattcttgacatgggcggtggaacctgggaacgtgatatggttgtccgtgcattacgtgctgcatataacaaccctgagagggctattgactatctgtattctggaatacctgaatctgtagaggncccacctgtggctcgagcacctgctcctgctcacaggcaccaaacctgcaggctcctcaggctcangctgcacctctaccacagtgcagccatctg

SEQ ID NO: 62249 - DNA, 676 bp, Triticum aestivum
  unsure (1)..(676): unsure at all n locations
  Clone ID: PAT_TA_62249
agtttattcgaagcattcccatccaccgccgccgccgcagccgcccgccgcattccgaggggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggcgtgctccccaacatcaaccccgtgctgctccccaagaaggncctcgagaaggccgagaaggagtcccagtcgcccaagtcgcccaaagaggaaggcccccgctcccgcccccgtcgccaagaagacccccaagaagaaggccgtcgacaaaaagaccgccgccgctgaccagaagaaggccgccgccgacgtcgaggaggaggtcgccgccgacgagtataaaaggccaagttgcgtcccgtagctctgcatctgagatgggagagaaagagagagat

SEQ ID NO: 62250 - DNA, 819 bp, Triticum aestivum
  Clone ID: PAT_TA_62250
gacttgtgcctcatcaagccaactgctcctgattcctgaagcggtaaaaagagcgagctttgagattggcagcaatggcgacgaaaccactagttggctctccgctctcggcctctcctgctgctcaaagcacccctgaccctggccttccaactggtgttgctgctcaaggcacccccacccctggcccttccagtggtggtggtggtaccggtgctgctgctccagtccccgacggtggccctaaaagtggcagcgctatactgttgaactaattgttggtggagctgtttgaatgtcacgtcctcatggacaccttaggcaaaccaactaaaaagagcttttattcgctagtcaagctggcttgcctgttgggttacagtttgagaggaaacgctaacaagtacaggatgcaaccagttaattaaaggaatccaattgggtcacctcccgtgtttcacggataagttcttgttctgcttcagatctccgaccttgtcttgtgcaagtttcaaactgtaatatgtttgttcccagttcggtcaagggttcgaccgccctcttgttcgttaagcatggagtttgaatgtttgataaccacaaccttggttcttataactgatgttgttttaagtatggatatatggcttgaatacgcacatctgatcaatagtatctatgggtctagagcagtgtaattcagatgccatcgatctgtgacattattcaagttgtatgtcgaggttaaacatgagatgcgtgtggcaaggtcaaacacagatatatgttgaggtgaaaaaaaaaaaaaaaaaaggccct

SEQ ID NO: 62251 - DNA, 254 bp, Triticum aestivum
  Clone ID: PAT_TA_62251
ctgggctctagggtagtccacggcatgtacgtcacatcgaatctcggagctcattgacccgagacatccgtaagattagcttgttgtaccaagtagactacgcactgatgctcagcggctcaagttaatggttcacgtgacggttcatatctgttactctccttacttcatgtctctgtacattcattttgagattcgaagcagtgcctaacagcttagtgtttagtcaaataatgtgtgatacaattctccgt

SEQ ID NO: 62252 - DNA, 569 bp, Triticum aestivum
  Clone ID: PAT_TA_62252
cggccgggccgggaacctaacaaaaccatcactccacgagcagacgggactgggaagagctttgctcgacaagttcaggagttaggaccaaccaacgatgaagagcagcacgctggtggcgatcctagtcctccaggccgtcatggtcatgggaatcctctcacactcactggccgccgacgacaatttcccgaagtgctgcgacaactgcaactcctggtcgggggcccaattctgtgacgacgtgggccccaagtgccgcgacggctgcgtgaactgccacgtggtgcagacgaggcccgtgaagacgttccggtgtggcgatggacgcgccgccctcccagagaatccctgcccgccgccgtgcaaaaagaactgatcgctcgctcgagctcaccacacagggagatcgacgttgcgccgaaaataaataagaaagctccgacgagatgagcagaaacggccggtgtggtgtacatgcacgtggcccacgcccagcaacacttgagagatagtgtatacatatgcgtcacagctcaatcaaataaaaagtcagtttgtttgtgcgt

SEQ ID NO: 62253 - DNA, 764 bp, Triticum aestivum
  Clone ID: PAT_TA_62253
aaatatatattaccaacaacctctgcacgccctccaacatctcaaccgctatcccggtataaactcgcaagatggcttcaagacactccatgcaacttttccgggcgctacgcacgtctcagtccactatccgtcagcccgtcaaccgaatctctgtctgccgtttctactcaacatctaccgaagatgcgcccgctcctctgctctccaagctcaaggctgatctcaagactgccatgcgcgccaaggacaccccccgtctgaccgtcatccgatccatcatgtccgccaacctcaatgcttccaagacatcaacccccatcaagaccgatgttcaactcgtcgcattaatccgcaagatccaaaagggtgctcaggatgctgccgccgaggccaaggctgccaaccgcgatgatcttgttcagaaggaggaggagcagatcaaggtgctaaacgagtacattaccaacagcggtgttgagagcttgactgaggctcagctcaaggccatggtacaggatgctgttgaggcttccaaggctgctggtattcaggccaagtccatcatgggagatgttatgaagcgattgtccggtgccctcgagggtaaggatgttgacaagaaggagttgtctaagatggtcaaggaacttaccggttaagatggttgatgcatgtatatgcatggtgtaaaatatgtatactatcgtataaaccagcgtcacgattgtcatgaaaccaattagatacccgctggttgcacg

SEQ ID NO: 62254 - DNA, 179 bp, Triticum aestivum
  Clone ID: PAT_TA_62254
ctgtgacgagcttgattcggccggactcgaattggatctcctttaacagtttaactagtctaaatatatgtagatttcattttttctgcggacagagtacacaataaaatgagtaaattgcaagaaaccaccacattgaaggctaggttagcagaaaacactactattttttttttggc

SEQ ID NO: 62255 - DNA, 498 bp, Triticum aestivum
  Clone ID: PAT_TA_62255
attttcatatatgaatacctcaaagctagatgtcttccacggatcggaagcaatccgaggatttccgagcaggttaaagtcaccggaatcacagccggaatcggcgcttctattgcatccctgctctttgtccctgtctatgtgcgcgaaaacaaggatgcgtctcccagaaaaggaccctcccagtcatccgttgcaaccacaggtactgttcacttcagcattgagtcggaacaaggctcggaagccttcagcacgcggtcctttttctattgcgaaaggtatcctgatgagagatggagtttcgggactgattaaaggtgctactgtcacctgtatagcggccgctgcgagtaacgtgctgtttttaagctgctatgaagggctgaagttgtattatgttcaatatggtgcgaagctagaaattatttaatagtgtttcttgtcccagactaatacgatgaatcttgatacaatatgaaaagatacaatataggt

SEQ ID NO: 62256 - DNA, 245 bp, Triticum aestivum
  Clone ID: PAT_TA_62256
catccgcgggcggcgacaagaggcggtcgatcgatcgagtgaaaggaattctttggtttattcgtatgctttgttgtatgttgtacttctgttaagctttaggtgttcggcgtccatggtgatggtgccgcttgtaatgttgggggtggcaacttcacctttttctagcatttccccaagttatgggtcttgtaaattccaagtctcaataaacggaacaaaaacttgcctttttgtacacaacg

SEQ ID NO: 62257 - DNA, 683 bp, Triticum aestivum
  Clone ID: PAT_TA_62257
ggccgggccgggacctctcacccctcccccgctcgccgttcctctgcctcgtgcagtcctgccttcttccccctagtcaccactccctgccgcccaggcgaccagaccggcgacggtctggcggcggcggcggcggctacagttgaaccgagaaggtggccgcggcgactgcagctgaagcagagggtggccggcggcttgacggccgggaggcagaccgcgggcggactccgacggagctcggttcagaactgcagagcagattgcgtggtaaccagcctccatcaactgctcctcatatatgtcgtcgttgctgcagccttgcacgctgatttgggtccatcaaccatcggatggtggtaaaccatcagaggacaggttttccaccaatctgtgccaagcactagtagtctagtgactaatatagatgatgtttcttcactcatttttgtgtgtgtgttactgagtggaattgctatgccctgtagaaccgtaaggtggctttatgctctccttgaattttggggtctttctttagtggttatcctgtgatctgatggaaagagatctcccacaatctagtatcatggttgggtgcaacaccgcatggtccatctagtaatgaaagaataattattgtataaagatttagatcctaaaactcctgatgaggacgtaccccc

SEQ ID NO: 62258 - DNA, 849 bp, Triticum aestivum
  unsure (1)..(849): unsure at all n locations
  Clone ID: PAT_TA_62258
ccggcctggccggaagaatcgccgacgacttcttccttctctcctcccctcttcataccaatctctcctcctctgccatggcgacgtcgacttcgcgcgaccgcggcggctacccgccggactcgacgcggctgcgcatcggcgacgacatcgcctgggcggacgtcggcggcgtgtacgaccgcgacgactccctcaaggagaacaccaaccccaagtgcctcctcaaggcccacaacccgagcgcgcccggccagcaccaccaccaccaccacaacggcgccgcgtcgcagcgcttctcggggaacctgaagcccacggcggcgcccatcatcggcctctccgggaagctcggccagggcggcgcgcggcggacccaccagcagcacccgcccgccatgttccccaagaaggccaagaccggcggcggcggccgcaacccgaggcccgccgtcccggaggacgagcccagctcccccaaggtctcgtgcatcgggaaggtgctctccgagcgcgagagggcgcggcgcaggcctcgcccgcccccctcggagcgccctccttccggctgctgccctgggctcggcttcctcatgcgccgcagccgctcgcggaagagtgccgtggagagcgtcgactggtccccgcctcccccgccaccggnggngaggcggagggaggcgaaggcggccgagacggaggaggccgcgccggcgccggcgcccgggctgggaggngtcatgcggttcgcgtcggggaaggcggcggcggatttggccggcccagatggaggtggacgaccgcgtggcgaaatccgggccgttgtagcgcgggcaggagatttaattt

SEQ ID NO: 62259 - DNA, 414 bp, Triticum aestivum
  Clone ID: PAT_TA_62259
aaataagattaagaaggaatcccttccctcttgcccggctgtgggcaaaaaggcccccggccggccctctcgcgccctccttctagcagcgccaacaatattgtttacaagctggccagagacggtttagacgacgatgatcaatgatgatgatttcatggacatctcaggcaggaggcgttgtggtgtcgataagcctcccaagttggtatacttccccacaatgctcagtcaccacatttctcagccatggcacaagattttctcgttgttaagatttccattttatctgtatcacttgggtggaagtttaatcataggttatatggcatttatatatatttatttttagtttgttttttaaatcattttctcaatggcagtattaattatagtctggatggcgttttattc

SEQ ID NO: 62260 - DNA, 680 bp, Triticum aestivum
  Clone ID: PAT_TA_62260
tttatgtgaactatagaaggccggccgggtcgggaccccagacatcttccattgttattgttgagaagaaaacgtactttacctaccacgaggagcactaaacaagcacctatcgttgcattgcgctaactagatggaaaagtacacgaattcctttcctgcaaggaccatactcctgtgtgtgcttctcttgtactctacgatccatacagagtgccaaatcatgcagggcctagcaaatgagaagatcaatttaccaacaggattgtgcatccatagaccagaaaagttgtgcccaactaagccattttgtttctgttgtttagtgaaccgcgaatgctatcttgcaatggatgcttgcgtcagtaactgtgcaaagtctgcttcatcaggcatagaggcttcacagaaatacggtctatcctctcgcaaaaaaagaaagaaagaaatacggtctatcaccttcccatgtaatgcaccgatgagtagcacattgtatctttgtcctggtgggaagccccggtgatcaacactacatggtgctttcccttttggtggccgacatgaataaaatatttatttccatgcattgcatgatgtagcgctgtagtatccctagtatttaatacaagagtttggtggtgcacattgtacaccacatgcttatgactatgttgtga

SEQ ID NO: 62261 - DNA, 352 bp, Triticum aestivum
  Clone ID: PAT_TA_62261
atgttcgcagcagagacagcaggtaaaaagaaatgaggcgattttcaaattgaaaaacgagatgtctcgaattatgtacacacagttcggagatgagtcagtcattgccacagcaaacgcaaacacatcagaccgaaccaacagctactccggaaacaacgcttccagtagtcgtaggccctttatatcctttccttgcactcgcaaaccaccaaacactaaccaaaaatgtcaaaccaccccaaattacacatgtgtaattcatactttgaggcgatgtaggtaaagcataaggaaaacagtaaatgacactccagataaggagataagcacaagcaatgccattgacaat

SEQ ID NO: 62262 - DNA, 662 bp, Triticum aestivum
  Clone ID: PAT_TA_62262
ccggccgggccgggatcatctccttcctccacccacacccgatcaactagtagaggcagagcagacagagggttcgagagcgtacggtgtcaggtcaagaatggcggcgtcagggagcgctcagagccgacgcttcgctgtagcgtgcggcgtcctcagccgctgcatcaaggcggccgaggcgcggccggtggtcctccccctcatgcccggagccgaagtgcccgctgaagacgagcgcgcggcgggtcctgcgccggcgagcgcgcacatgaccatcttctacggcggccaggtgctgttgctcgacgaggtcccggacgacagggcggccgagctgctccgtgtcgctgccgcagcaggcggcgcgcgaggggacggcgacctgcccatggcgaggaaggcgtcactgcagcggttcatggagaagcgcaaggggaggctcgccgcgcgcgccgtcccctacagccggcccgacggcgacacggcctcctgtaatcgtctcacgcttaccctctgattcgtgttcatgcgtagtagagtagcctgagtaatttacggtccacgcaaatgtgtggctgctgttggagtccaaattgttgacacactcgcttgtccccgtcgctctgatttattatgatcagaaattattgctgttgtcc

SEQ ID NO: 62263 - DNA, 609 bp, Triticum aestivum
  Clone ID: PAT_TA_62263
ccggccgggccgggaaatcaatccctcgccggcgaagcacccacacccaaacccctccggctccaatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccggggaccgtggcgctccgggagatccgcaagtaccagaagagcacggagctgctcatccgcaagctccccttccagcggctggtgcgggagatcgcgcaggacttcaagaccgacctgaggttccagtcctccgccgtctccgcgctccaggaggccgccgaggcgtacctggtcgggcttttcgaggacaccaacctgtgcgccatccacgccaagcgcgtcaccatcatgcccaaggacatccagctcgcccgccgcatccgcggggagcgcgcctaggttttcggtcgccgccggtcaagctactgggttgtagcgcttcctgtctggtgtcttctgttcggtggtgttgatatgatgtgtcgtcttgtcccattcccatgtagcatgatgctgaaatgaaatggcagtg

SEQ ID NO: 62264 - DNA, 661 bp, Triticum aestivum
  Clone ID: PAT_TA_62264
tggaattccatgcttatgatacaccgaggctgtcgggcagatgcatggacgtgaggattatcaaagagtggcagatgttacagggtattcaagtagctctgttgaactgaggattccaaatagttctctggaatctattgttggagctggtggtgtcaatctagcagagatccgccagatctctggtgcaagaatgaagttacttgaagcccatcctggttctttggaatccatcatggagatccaaggtatgccggaccaagtgagagtggcgcagagccttctgcaaggcttcattggtgccaacagccagagcgtgcagccatcccagtcttctcgcgacgtccattacccaaggtggaactaaaccctagaggcttgttgtgaagaacaacggaacaccgtgcaaactccaggtcgattgccatgctgccacattaactaggttgagcggtgtaacttagatcatgtttgttgacaaaaataatctgggctttggttatttccaaggatgtactgctaaaagtgcttgttttcttagtctttttaccccccttttgagtgaaatacatctaatgacaagagttgcaaaaactctgtagtcattgtacacatggaacctggatggttgaagctgtttttatatgcaatgctatttgag

SEQ ID NO: 62265 - DNA, 371 bp, Triticum aestivum
  Clone ID: PAT_TA_62265
gctcgagacggccgggccggactctccccatcagctctcttctctcctcccttgatcccgaagaagaagaagaagccgtagcttgcacgaggaaggagatggaggcgaagaggtcgaggccggccgccatggctgcgctgtgcgtgctcctcctcctggtgcttctccccggccaggtggccgccaagccctagttctgccagtgcttctacctactgccttccccgtgttccagcacacccactccttcccccatccacccccctctgtctcccccccctcccctccccccccccctccctcccctccccctcctcctgcccccccccccccccccccccctcccccccccccgccccccccccccctgc

SEQ ID NO: 62266 - DNA, 465 bp, Triticum aestivum
  Clone ID: PAT_TA_62266
ggccgggccgggttttctagctatcgacgaagccatcgcattctcggagggtgaagaaactggtggaagtcacaaggcccgcttcggagagattgaacagcgaggaatggcattgacgcccaagggacgacgactatacgatgatctcattaatgagtggcgagagacatcgagtagcctcactgaagccgagtcgaaagagaagcatctagccaagatctttgagagattccctgacgatatggaaacacttcgaaaagagaaactggcctacttttcatacaagcctgtccacaacgcgtccatagcccaagacgctgatatcaactctcttatcagttctggagctgttgaggttgagcccattacatacgaagacttcctgccagtcagtgccgcagggatttttcactcaaatcttggtgatgacggtggtatgatccacacagtcgtcgctgacaaaaa

SEQ ID NO: 62267 - DNA, 799 bp, Triticum aestivum
  Clone ID: PAT_TA_62267
ggccgggccgggcttttatatactcgctgatctcctggcgcattgtgattctctcaagcattgcacacgaccgcttacttcttacccaaccgcttctaatactgtctaattcacaatgtctacaacaaccaccacaaccaaccagcctatcacggccgcatctatgcttcgtctcttcccggacattgatactagctcagcgcctctctccggtcacgatgaggagcagattcgtcttatggacgaggtttgcattgtcctcgacgaggacgacaagcccattggaacagccagcaagaagatttgccatctcatgaccaacattgacaagggcctccttcaccgtgccttctccgtcttcctctttaacgacaagaacgagctcctcctccaacagcgcgccaccgagaagatcacttccccgacatgtggaccaacacttgctgctctcaccctcttcacatccctaccgagactggttccactctcgaggactctatcgcgggtgtcaagcgagctgcccagcgcaagcttgagcatgaattgggtatcaagaaggagcaggtccccttcgaggactttcacttcctgacccgtattcactacaaggctcccagtgacggaatgtggggtgagcatgagattgactacattctttttatcaaggccaacgtcgaccttgacatcaacaagaacgaggtccgagatacccaatacgttactcccgagagcctcaagcaacaattcgacgatcccagcctggttttcactccttggttcaagctcatctgcaactcta

SEQ ID NO: 62268 - DNA, 491 bp, Triticum aestivum
  Clone ID: PAT_TA_62268
tcatcccgttctgtccagtcactagcaaggcttttgctacctcttcctgcgactcgatcatgagctaccagcagggctacccgccaccgggcactgcagcagcgtaccctccgccgggccaccaccagcaggcctacgtcgcgccgccgccggctatgtaccagcaggaccaacagtaccctcctgccggcgccgacaccaccagccgcggcggacacggccacggcggcgatggcttcttgaaaggatgctgcgcggcgctgtgctgctgctgcctcctcgacgcctgcttctgatcgacttcgtcccatgttgttccaccggcacgatcaggcgtggcagatagattatatagagtatcttcatactttttttgcttctttttaaaacgtggttgatgtgttgagtactagtcccagaacaagatctttttttttgtttttttttggagaggcagaacaagatttcttgtgtgtgatattttttttaac

SEQ ID NO: 62269 - DNA, 613 bp, Triticum aestivum
  Clone ID: PAT_TA_62269
cattacgtcgaggagactataacgcaactggtgtcgagggtcccattaaacgtcattccctcactcttctggcttcagacgaccccacagtccatgaagaacctgagtttgcgcacacaattctttctcaggatcgaattcgtcttgcttcaaagggcgccattgctagagctggtggtaaccaacatcattccaaaaactttgttgagaacacatttggctgggaaggtggtttctttgctcctctcttttggaatcttggcgtcaacagccagaacaatgccgccgaagcacctgccggggtccacgttgaagatgtgaatgaggaagctaggcacatggcgccgccatcagaagagacactgaggcttcgcggtctcgttggtcgagcctatatgatggacctttctgtactcgccgagtcgagtgacaagatagtatgcaccgtgagctcgatggggtgccggttgctggctgtgatgatgggctgggaggatagtatggagaatggtggttggcacaacgtggacggcacctatggctggacaggtatcgactggtaaatgaccaacaaattactagttacatctattatattttcttggattgtcac

SEQ ID NO: 62270 - DNA, 528 bp, Triticum aestivum
  unsure (1)..(528): unsure at all n locations
  Clone ID: PAT_TA_62270
cccccccccccccccccccccccacntaaacttaacaaaacaacaccaacggccgctcgggccggccgggcncgggactcgctcagactcagctagctaacatacaggcaggccatcaggaggagccacngaggaagaaacaaccagcgcatatatccccctccctccctccctcccgccggcagctgacctgagctgagccaccgttcgcccaactcgcctctacaacacagagcacccccggcgcccggatctcttgctcatctccctctccgctctttgaatcgctcaccaccgccatgcctaagcaccacaagaacgcgcacgctccgaagctccgcccctgggacaacgccgcccacgccccccacacgctccactcccacaacgcacgccagggcaagggctttaatcttttcaccaccccccgaccccgcccgagaacccccgagcgcctcctcctccctccgccgaccccgccgctcgccataacccgctcctctcgaccagcgccaggcacgggtctcc

SEQ ID NO: 62271 - DNA, 793 bp, Triticum aestivum
  unsure (1)..(793): unsure at all n locations
  Clone ID: PAT_TA_62271
ggccgggccgggaactgtaagtcaacatcaactaacacctgtacatttctacccgcacattcgtctctcaactctcgacaactataaacgaaaacattattcattgtagaacaaaaacaaaacgcccattatggttctcgaggcggttatggttgtcgttgacaacagcgaaagcagcagaaatagcgactaccaaccaacccgattcgattcgcaagtggatgccgtcaacatcactttccagtctatcacacaaggaaaccccgagtcatctgtcggattgatgagtatgggtggcaagggacccgaggtgttggtgaccctcaccactgagcagggcaagatcctcgagggcctgcatcgaacgaagaagaagattggtggctcttcccatctgaagacaggtatccaggtggctacccttgccttgaagcaccgacagaaccgatcccaacgtcaacgaataatagtcttcgtctgctctcctgtcgaggaatcagagaaggagcttaccacactcgccaagaagatgaagaaggccaacatctcagttgactttgttttgttcggcgatctcgacgacgacagcaccaagaataagctgcaactgttcatcgatacggtcaagaccaacgaaggctgtcacttggtggtcattcctcctagtagtaagctactcagtgaccaactcgtctcttccccattcttttgggcgagaacgctggtggatctggcggagctggaggtgcaggcggtggcaacgacgangtcgagttcggtttcgatcctgcga

SEQ ID NO: 62272 - DNA, 776 bp, Triticum aestivum
  Clone ID: PAT_TA_62272
tctttaaatcattctcaaagcctataaagcagaaagaacagagagaaagacaccgcgtcaccggcgaactcaaagcgatggacaccgctcccgctcccgctcccgctaagccgtccttgtccaggaagccctcgccgtcgttccgcctccgcaacggcagcctcaatgccctgcgcctgcgccgcgtgttcgacctcttcgaccgcaacggcgacggcgagatcaccctcgacgagatggcggccgcgctcgacacgctcggcctcggcgccgaccgcgccagcctggaggccaccgtcggcgcctacatcccggccggcgccgccgggctcggcttcgaggacttcgagggcctccaccgcgctctcggcgacgcgctcttcggccccatcgtcgaggaggagcccggcaaggagggcgaggccgaggacgaggacatgaaggaggcgttccgggtcttcgacgagaacggcgacgggttcatctcggcggccgagctgcaggccgtgctcaagaagctgggcctggcggaggcgcggaacctggcggcggtgcaggagatgatctgcaacgtcgaccgcgaccgcgacggccaggtcgacttcggcgagttcaagtgcatgatgcaggggatcaccgtgtggggagcttgacggcgtcttcccttggtcccatctcctgtttctcatgttctaagcatgggaggatcggaacgaggaacaaccacaagatccgtagatcgcttcagagttcagaccttaaaaatgaaagtcagt

SEQ ID NO: 62273 - DNA, 369 bp, Triticum aestivum
  Clone ID: PAT_TA_62273
ccggccgggccgggttgctccaaggagggaattgatctgtctcaggtcattgccgtcggcgatggcgccaacgacttgctgatgctggataaggcaggtctgggcgtcgcgtggaatgcaaagccgcgagtgcagatggaggccaacgctcgcctgaacggagagagtctactcgacctattgttcttgcttggcttcaccgctgaggagattgacgcattggctgtataagttgttagtgttggatgaggagagttctcatgaacaatgaaggcaggggtttaggatatgatatggaaagctgggtgcgttgtgttgtgttgggttattgagataccaggcagcaacgagaaacaagacttctttggg

SEQ ID NO: 62274 - DNA, 622 bp, Triticum aestivum
  Clone ID: PAT_TA_62274
aactgctttcaaggcatacacctacaaatcaagctcccagctcccaatcagctagtcagcagcaacactaccgcctctcaaaaaagaagatcgatgaatagtcactcgatcatggcggtgccgtcggtgttcgccgccttcgacaaggacggcgacggcaaggtttctgtgtccgagctacggcgctgcatggaggcgacgctgggcgaggacgtgcccgaggaggaggcggcggtgacccttgctgcggtggacgcggacggcgacgggctgctaaaccaagaagagttctcgagactggccaccgccggcacccatgaagaggacgatgccgacgtcaagcgaaggtgcctgagggaggcattcgggatgtacgcgtcgtcgtctgcggaagacacgattaccccagcgagcttgaggcggacgctgagcaggctggggtcgcacgagctgggcgtggaggagtgcagggcaatgatctgcaggttcgacctcgacggggacggcaaactctcgttcgacgagttccggatcatgatgatggcctgatcatcgacttgatctcttattggcattcttctagatcacatacaatgtagacttaattcattgggtcgatcac

SEQ ID NO: 62275 - DNA, 823 bp, Triticum aestivum
  Clone ID: PAT_TA_62275
acattcgatccgatccatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttggcggactacaacattcagaaggagtcaacccttcacttggtgctccgtctccgtggtggccagtaagctcctggccatggagctgcttttgtctctggggtc

SEQ ID NO: 62276 - DNA, 781 bp, Triticum aestivum
  Clone ID: PAT_TA_62276
gaaataaaaaaaagtgtgctccaagcctcaagtgctgtgtactagtactactactactacgtgtgtgtgtgtgatacactagtgagtgtgtgagtagtacgtgtgtgtgctcatccaccggtcatctatcagtgtactcgagtgctagcgagtagttctgggctgacaaggagctgggatgaaatccctggcatggcgccccccgcgtcgcgcttcctgtggtcggtggtgccggcgggagtggacgtcggcgcggacgaggtcttgggcctggcgatgcggatcgggtacaggcagcgccgcggccacggcgtgggtggtggtgttgacaacgagaatgtgtggcgtcgcgaggtgttgcggtacgacatgcgtaccgacgccacggccacggtggcggaactggtcggcagggagaagcacgacgacttcgtcgtcttcggctaccactccagcatggcgccattgtactagcagctaattaaaacctctccatctcaaggttttttctgacagtaatttgatggaactcgatcatcgcaggtactgatagtattctggatacttcacttttcagctatctatgtatgtctccgtttctaaatataagcctttttagcaatttcaatacggactacaaaccaatgtatacagacatattttagagtgtatattcacttattttgctctccatgtagtccatcttgaaatatctaaaaagacttatatttagaaacggaggaagtattatattatcaaaacataatggtctattttgacc

SEQ ID NO: 62277 - DNA, 645 bp, Triticum aestivum
  Clone ID: PAT_TA_62277
atttgcgccgccgcctcccccgaagccatccgtatccccacgctcgctcgccgcggccgcccgacgcgatggctcccaccaagaaggttaagaagagcggggagaacatcaacaacaagctgcagctggtgatgaagagcggcaagtatacgctcggctacaagaccgtcctcaagacgctgcgcagctccaaggggaagctgataatcctcgcaaacaactgcccgcccctgaggaagtcagagattgagtactacgctatgttggcgaaaattagcgtgcaccatttccatggaaacaatgttgatcttggaacagcctgcggcaagtactaccgggtgtgctgcctcagcatccttgaccctggttcgttgccgttcagatcacttgcatttgtttctactttctcactgtgatatctgctgacactggttacatccttcaggtgactcggacatcatcagcaccaccaccaccacccagtgaagagaagagaagagagctctccacctattttatttagtcgagttgtagggtcctgttgtgctctcgaaaccactcttgttatcttcggtttatgtacctttttgcgacgctgagttggagctgtcatacagataatacttcatatggttgttccgctgg

SEQ ID NO: 62278 - DNA, 611 bp, Triticum aestivum
  Clone ID: PAT_TA_62278
ccggccgggccggggaatcacccaaaccccagcgcctcaacaaagccctgctgcacctgctccgatcgccgcgaggaaccagcgagagaccccggagccagaggaggaggaggagatgagctactacaaccagcagccacccgtcggcgccccgccgccgcaaggtgcgcgccccgtcgattcccgctacggggacaagggcggatacccaccgccggggtaccctccggccggctacccacccccggcgcagggctacccgccggccggctacccccagcagggctacccgccgcagtacgcgcagcagccgccgccccaccagcagcagcagcagagcagcgggccttccttcatggagggatgcctggccgccctttgctgctgctgtctcctggacgcctgcttctgaggagggaggaagaagacgacgatcaacttcgtggaactgggactgagctatcctctctgacggagaaatgctgctagtagcttaaatattatttctcgtcgggcattatcgcctactttgcttgatccatgtttatgaacctctctgcattgcaactattcgcttggttgtcgactgatgattatattatgcctggtgc

SEQ ID NO: 62279 - DNA, 520 bp, Triticum aestivum
  Clone ID: PAT_TA_62279
ccggccgggccgggaaatccaacggtcagccgaaccaagcttcgcttcagttcttgcgcagttttcacaactcgagtgctaaacaccgtcgtgggagaggtgcatgtgatgatggagtacgaaccacagagcttcttctcctggccggcggcgctggcgtcgtggctggcgagcttctgcggcggctctgatggcggcggccacggcgagccggtcgccggcgacggcccgaccaggcagatggccgcggctgcgaaacacctcaacggcgctcacaagattcggttctcctagctagctcttccggctgctaccttctgcttcacccaatggaatatactagtagtataatgatactttcccttctcgctatctgccgtggtgtgtgcgagaggggaagcgtgatgtaaccctctgcggtgaactttctttctccggtactgaccgatcgatcgatggatggatcacgatccaaagttggaaacgataggcatctcacgtgccatgaaggcgacagccc

SEQ ID NO: 62280 - DNA, 828 bp, Triticum aestivum
  unsure (1)..(828): unsure at all n locations
  Clone ID: PAT_TA_62280
gaagtgaccccaagaaagtttccgatcgaatcgaagcaaggccttctcgcccacctccaagatgcagatctttgtgaagaccctcaccggcaagaccatcacccttgaggtcgagtcctctgacacgatcgacaacgtcaaggcgaagatccaggacaaggagggcatccctccggaccagcagcgcctcatcttcgctggcaagcagcttgaggacggtcgcacccttgctgactacaacatccagaaggagtccaccctccacctggtgctccgcctgcgtggtggcatgcagatcttcgtcaagaccctcaccggcaagaccatcacgctcgaggtcgagtcttcagacaccatcgacaacgtcaaggcgaagatccaggacaaggagggcatccctccggaccagcagcgcctcatctttgctggcaagcagttggaggacggccgcacccttgccgactacaacatccagaaggagtcgaccctccatctcgtcctcaggctccgcggaggcatcatcgagccatccctgcaggctcttgcccgcaagtacaaccaggagaagatgatctgccgcaaatgctacgcgcgcctgcacccaagggctgtcaactgccgcaagaagaagtgtggccacagcaaccagctgaggcccaagaagaagatcaagaactagagtgctactagtcagtttcatggaccggttgaatccattgctgtgttagcgtttatgctattgtcgtctcgttgtcgttgaacctattttactttgctttcagccctcaatcgntgtggtgatgataaatgacagtattggtatatggt

SEQ ID NO: 62281 - DNA, 710 bp, Triticum aestivum
  Clone ID: PAT_TA_62281
gccgctcaggcggcgggcgggatttactgttcagttacatccccacggtcgacaccgtgcctacccgtttggcgaacacccgcacgcaccagcttccacgattccgacgataagggacgtgtcagaaagaaccgcacgtatcccgcgggtcgagctcttgatgatggtcagcaccaccaccgcaccaacatggacaagaaccatcccaccatacttcaagaaaggacgcgatgcgacaattccacaagcagcagaaccacttcgaggaaggccatcatcaaccgcgaccaactcggacctctcgttccccgagacatccgtgacgcctacgacgagctagagaagaaggacatcgtatccgtcctcgactcatccctcccacgctcatactccaaggtcctcggcaaagcggccgcctcgcctgatatccgcatctggtcgaccgagcccgttgaagtccaccgccttgctgatgagaacaactcgcacttcagtggctgcctggacctcgtcgcttatgagaaacatggccactgatccgtatgcgctagatgaggagaatgggctcgtatgggaagttctactgacctttaacagaacgctctgctcacccgacgtagaacatagcctgcgggcactggattatgaagagtcttcctgcgcgcggttacgttgggccagggacctaggtcggtcggcttcgggcattg

SEQ ID NO: 62282 - DNA, 639 bp, Triticum aestivum
  Clone ID: PAT_TA_62282
caggccggccgggccgggaacttctcccatgcgagaacgtagacggaggagacgacaacagaaagggagagacgacgcccaccgatagaagccgagatatcgcgacccgcaacgtctttacttcccaccgataagcttcctagggcttctaaatgtctgccctcttcgactgccaatgcgctcatgactcgcgtctccctgttcgttcatattgccacgaacagacatataacgcaccactttatcccaagcatcatgaacagaaataacaacggattgcgtgggcatctataaggaaatgcgacgagagataggcgaaagactgaccgcctatataggatatgctgtggcctcagtgtctgcatccatactcctcaagtaaaccgcatatgcgcaacgatatgccctagcaatgtactattaaacatattacaactcgataaggagcggaaggcaatcacacggaccaaagaacctcatcaggcgcgagtattgacattgtctaggcaatatacacgatccctcgcagatcatgatgatgaaagaattcgacatttgcaccggcgagttactacaaaagaaacaaataaagtggccatactgcctcgagccatacgtgactactgatatcatcaccct

SEQ ID NO: 62283 - DNA, 623 bp, Triticum aestivum
  Clone ID: PAT_TA_62283
tattacgccgctgtgatttcctgcgttgttctatgtagttttcctgcaggtgtcatgcgccgtttccaggcaccccgcggaaagtaagttcgagcttcgacagaacgtcccggcggtgatgacggtgaacggcttccagcagggagaggggggcggcgggccggcgtcgtgcgacggccagttccacagcgacgacgagttcgtggtgtcgctgtcctcggagtggtacgccggcggggcacggtgcggcaggtacatccgcatcgtcgactcgttcaatattggcataaacgtcaaggtggtcgacgagtgcgccggctgcgacaacgaggtgggcgcctcatcccatatctggaagagcctcaatcttgacacaagccaaggtgaggtcaacatcagatggtccgacctggacttctaaactgcagaaaaaagcatgcatgcatggcgtcattcgatcgttcagcaccagctcgtgacgatatcgatgttcacgttcaagtttcagctttcaagtgtgtaatcactgggatatgcatgaatcccttaatgtgtcagcgtcgtttattgttttcccggccgtctacgaggcagaatttacttgaataataatgtgataaccg

SEQ ID NO: 62284 - DNA, 547 bp, Triticum aestivum
  Clone ID: PAT_TA_62284
accaagttcatcttcttctccttgaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcgg

SEQ ID NO: 62285 - DNA, 612 bp, Triticum aestivum
  Clone ID: PAT_TA_62285
cggcccgggtcaccgcctccacccaccaaaatccccaaatcccctctcttcccaagctactcggagcaggcagccatgtcggggcgcggcaagggcggcaaggggctcggcaagggcggcgcgaagcgccaccgcaaggtcctgcgcgacaacatccagggcatcaccaagccggcgatcccggaggctggccccggaggggcggtccgccatgaaccaaaacacccccccgaccaacaccccactccccccacccccccgggggggggcttcccaacttcctaaacccaaaagggaataaaaaaaccctcccgccgtgggccgccgaccggcgccctcccacccaacaaaaaaaaaacccttttttcccccccccccccccgggaaaaaaaaaaaccgcccccccataatctctcccccgccccccaaaaaaaccaccccccccgcccctccccacacccccccctcttaccccccccccccccccggcccggcaaccccaaagaagcgtgtgccccccccgcccacccctccctgccccctcactaaacaggaagaataacaaatctcctcgcgctgcctctatcccccatctctccccccccccccccc

SEQ ID NO: 62286 - DNA, 645 bp, Triticum aestivum
  Clone ID: PAT_TA_62286
ctctctccccaaccctcgtccctgccctcctcctcctccgtcttcgtcgccgacgacacctcgccccagcccacgccctgtccgcgatcatgatcaagaccatcctgaagctccgcatggatggacgatccccgacgaggtcgacagagacggtgaccacgaaaatgatctcgatgacgagaacacggacgacgatgacccgaaacttcgagcgcctcaacctcgacttccggctgcaataggggacacgacagctcaaggtggacgcactgactcggaccccgcaggaacatgggcgccatccacaccgacatctcccacgcccagaaactcatccccggactacacacgggcacttccgctacagatgcgacttcgagtatgatctgttccccatccgcgcctccatcaccgacggcgaacggtaggtcagatatcatgatagcattcctctgggagaaggaggcgaacatatatgacttgctcgacggagccaccgtcttgctatgcatgaaatgcgtggcttgcatcatgctccatgtgaaggatatcaattatccgtcccgacttggactgactcatgattgaaatatgcaccgttcatcatgttcgatatcaggaagttcttgggccccatatacctcg

SEQ ID NO: 62287 - DNA, 594 bp, Triticum aestivum
  Clone ID: PAT_TA_62287
cgggacaagcaagcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatgtatggcgcctcaacttcg

SEQ ID NO: 62288 - DNA, 587 bp, Triticum aestivum
  Clone ID: PAT_TA_62288
acccgcaagcacccagcctcctcagtcctctcccatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaattgtgtttgcgcccacgacgccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaacttc

SEQ ID NO: 62289 - DNA, 632 bp, Triticum aestivum
  Clone ID: PAT_TA_62289
aacagccagatccccaccccctaccagtagtgctctcccggtgtgacttgcgagctcgatcgcgcaatggcggctcgcgctgggaaggccctcgccttggccatgctgatctccttcctcgtggtccaggggacaacggggaaactgacggaaaactgctactgcgtgttctacaattggtgctttaactttggccctaagccacgcgaccacgtcatctgcatggagaaaagcctcaagcattgtttcaaggggtgcccgcgtactgctactactccttacgtgacgccactggccgatcttgtcaaccccggtgtgttatcttttcccgcaagttacagacgagggcagcatggccgttcctgccgggggtgccgatcacggcgagttccacgtcactgagggcagcgtggctgctcctgccgggggtgccgatcacggcaagttcaacgtcgctgaagaggatgcagctccgtgagggctgcgagaggctggctggagacttggaggacagacacagtttggccgcggtataggccgagaaactctttagaataaaagccttcttgtagtgaaagtctgtcatgcactgtacaagatctctggctctggcaataaataaacagaattac

SEQ ID NO: 62290 - DNA, 690 bp, Triticum aestivum
  Clone ID: PAT_TA_62290
ataagtgatatcctggtgaataaagaacactggaatcatttgctttgtctcttgtttgtttcccgattcctttctaacacattatcatcacgctcccgcggagcgattccatcggcgctcaacagcgagaacgaagaaacaggaaagcggcaacgtcgtggagcaactccggcgatctccatctacaggtgcatcgctgccttggagcgattggattaggagtcaagtccaagagcattggagaatcaagaacagataaagaagcaacttgctcgtcgaggacgcatgcagtagcaggcgcggtggagaacccagcctcggcgtactcgccggccactacgacggagacacgcggcgttcccgcgctctgtcaaatgtgatgggccctccccatcacgactcgcggtggagattgcagcggcgtcttcggcgtagttcgctcccgcggctcctactcgacgacgtggtggacctttgccctggggtgcggcgctatccgctgaccccactcctccaggtgcgaccagccgtggcggagatggagcaggctctccctccgcctggcagagtgcagcctgcacccggcgctggccaggcccgagcccgtcgcgaggcttcctccggcatggttcctggaagcggagacgacggtgcgcccacagcagcggcccctcccgcgacgaaagcagc

SEQ ID NO: 62291 - DNA, 575 bp, Triticum aestivum
  Clone ID: PAT_TA_62291
accgtacgcatgcgtctcaccccactgcagaagactgcacaatgaacacgcgcaggatagaggccgccggcgcaaggcctctacggatcagacacggaacaacacaaaacagcaatcaggtcaaggaaaaaagacagaaggacaacggaggtatctgactccgcccagctgaggtgaaacctagagagcatctgtgcgtgatgcgactagcctgaacgctaataaatcgtagattgagcctcgactcctcgagttctagggtaaagcaatcgaggatgaagctcccgtgaacgcctgaggtgtcgatgggctgttgatttgcgaacaatgaaacggctctcaggccatgcgtgcagctatggagggacatatcccccagctaggtgcaagcactgttcgttcgactggaatatattattgcgctttaatcttcctggagctacatctttgcatccagtcttgcatgatcatctatattttggtgcagcgacgttgtccaccttgtatcaaatccgaggtagactgcgacatgaatgtacctcttagagatttttggaacgagaaaagaaaagaaa

SEQ ID NO: 62292 - DNA, 583 bp, Triticum aestivum
  Clone ID: PAT_TA_62292
acaatttcccattctcccgattttctcgctccctacagagtcagcgaccagggtcgcggtcatagagacggcgccatcggcgaccgaaacgtgccggccatggcggcgcggtagctgcccttgccggagcagcgcacaacggactgaatccagtgcgctcctctggcgagcgtggctccggcgtcgcacacatggcgccctgtgctgcaggaggtccatttcgccggcggctgcgcggcaggggattcattcgaaggcggcggcggcgtgcaaggcgcagaaagccaggcggcgcgcgcgtccgcgagcacagcagaggcgactgcgtcttccttccgcgcgccatcccgaagggcagcggcgttccggccatgggattcctgaacggcgtcggccgtgcagaccccgaaggccggcatgctcaaaaagcataagatccagcccctctttagttcagtttctgtcgatttgaggcgtgggatttgaccttttagtgttccaaaaatctagagttagggttcgtctgaatttgggggaaaatgaggctttctgtaatttcgccaattcatcatgttttaatcac

SEQ ID NO: 62293 - DNA, 503 bp, Triticum aestivum
  Clone ID: PAT_TA_62293
aaaccagcaagcaagaagcacacaggaagctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacc

SEQ ID NO: 62294 - DNA, 302 bp, Triticum aestivum
  Clone ID: PAT_TA_62294
ttttaatggtgcgtggcaagtatactgcaatgatgacgatgttccggttcatgatgatgatgatgatggatgctctcttagttaagttgtaggaatgatgttcccgtcggatgatgttccctagttaagtttagttaagttgtagggatattgaaagatgctttctgattaagtttcactgtcaagaaaatatttagattatgcatcacattttgatgaaaaaaaaaaaaaaaaaaaaaaaaaaaaaaaaaaaaaacaaaaaaaaaaaaaaaaaaggccccataggaacacaagaggacgaa

SEQ ID NO: 62295 - DNA, 696 bp, Triticum aestivum
  Clone ID: PAT_TA_62295
atcgctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcatggatctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcgcggccctccagttatcgatctatctaccatctcgtcctcttcg

SEQ ID NO: 62296 - DNA, 623 bp, Triticum aestivum
  Clone ID: PAT_TA_62296
tatacgaagaagacgcacccaacaagaaccgcgcgagagaggaagccaagccatggccatgtcgctctccctcgcgcgcctggccctgccgccggtcctccaggccctcccgggcaggaggccggcccactccgccctcgccttcccggccaactcattcttcggcgcgccgctggccgtggccgccgccggcgccgccgcgctgtccccggcggccccgctcccgcgccccctcgccgtcgtcgccgccgggaaggggtacaagatgaagacgcacaaggcgtcggcgaagcggttcagggtgacgggcaccgggaagatcgtgcggcgctgtttcgggaagcagcatctgctcagcaagaagaacgccaagcgcaggaagaggctctccaagatggtccaagttaacaagagcgactacagcaacgtgatgggtgcgctgccctacctcaaagtgaacaagaaagcaggctgagatctaccaggtctccgtaaaatgactgccactgagtttctgttcacccacttgtaattttgtgcatctttatctgtatgccttttttttctcttaaagacataccaatgccagacttcacattccaagcaaccataaactactattc

SEQ ID NO: 62297 - DNA, 558 bp, Triticum aestivum
  unsure (1)..(558): unsure at all n locations
  Clone ID: PAT_TA_62297
gcccgcagttcctcctgtgcgcgatgctcttcccatccgccaagaagctcctcctgcacgtgatgcgcgtcccttccgccaggaggctcctcccgccgcacgccaagaggcgccccctgccgcccgccagccggacggtgctgctccagctgcatctactgaacgctggcgtcctggatctaggacctctgcaaattcgtcatccacctcctcctcgtccaccggctggaggcgctgaagctgcctggcctgaaaagcgctgtgctctgcccgctgtctgagatttttgccgtcctacttccatgtcttggagcttcatgcacaatggatgtctttcactgatatgcgggagcacggttacttaaatttgcttgttgcgcatctaaattttcgaattgaaaccttgcactgtttctcagtcatgtttgatgttttgagagccacagtactccatgcataatgtgttgctctttggtgtcttatattacagaatatgctgttaaaaaatcctttcntaaaaaaaaaaaaaaaaaaagcccctaaggtttcnagaggacg

SEQ ID NO: 62298 - DNA, 581 bp, Triticum aestivum
  unsure (1)..(581): unsure at all n locations
  Clone ID: PAT_TA_62298
ggccgggccgggattcaaagnggggatncnactcctccacatagcgnagaaagagctttgcgctgaaagnncatcagcaactatgaagggcaccattctngcggcgaaacggatcctccaggccgncctggncatgggagncctctcgcacgncaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacnctgcgggggaccttgtttttttttaccgaccgcgcccacggccggcatatgannaggggcccgcccaaaacnaaanaaaaagccccgaacaaaaaagaacaaaggggcaagcgggggcaaaggcgggggggggggggcccacaaaaaaagggggaaacccggagagggggggggggccccccgcccccggggggggaacccccccccccaaaaaaaaaaaaaaagggggggggggnccccgggcggcccccccccc

SEQ ID NO: 62299 - DNA, 675 bp, Triticum aestivum
  Clone ID: PAT_TA_62299
atcaactccagaacacacagcttagagcttgctcaagtgaagtgagctgatcagatcgaccaataacaaatccccaagaacagcctactagctacccaccaattcgctcgatcagcaatggcagacagattgacgaagctggcgtcgcagcgggcggtggtgatctttggggcgagcaactgcttcatgtgccacacggtgaagacgctcttcacagagctgggcgtgagctggacggtgcacgagctggacaaggacccccgcgggaaggacgtcgagagggcgctcgttggcatggtcggacggagcccgcccgtgccagccgtcttcatcggtggcaggcttatcggcaccaccgaccaggtcatgacgctgcacgtcggcggccagctcgtgccgctcctccgccaggccggcgccctgtggctttgaagagtcatgggcagcagtggctgatggtgcgagcagttatgtgcgatcgcagcctcgaaatcgagcgaagctagtgatcatgtagtgcgtgcactgcagtgcagctacgtaattttgaaaaggtcatcaaacatattaacggttatgacctttcagttgtacctcgttgtcatgaaaagagtagaaaggatgcttttgtagagatgagcatcctgagccatatttaaagagcttatgcctgtc

SEQ ID NO: 62300 - DNA, 446 bp, Triticum aestivum
  Clone ID: PAT_TA_62300
aatcattcagaagaaaaacaagagagaagaaaagagaattaggactagccatcactcatcctcatggcgatcttcaagaggaacaccgccgcgctgatcttggccgccctcgcagtcatggccgccgtcctctcctcatgttgctacgcagacgagggagagaggtgctttccgcctatctcggggccggactgcaacctgaggcagtgcaggaagctgtgcggggagaagtcgagagcacactgctacatggcgttggccgacgtccagcccatgggggtaaccgcctgctgctgctctccgctcaagcgcgcgaagactgctcctgctgtcttgtaaacttcgtcggaacgatgaagagatcaataatctagtttttttatggcatgcatgtgtgatgtgtgtctttaatttagcacgggacgtgagcttcctcctttttggct

SEQ ID NO: 62301 - DNA, 495 bp, Triticum aestivum
  Clone ID: PAT_TA_62301
aaagaagaagcacacaggaagctcctagccaacaccaatcaaggcctccatccaatcccaagcaacctcgaatatgtcttgctgcggaggaaactgcggatgcggcaccgcctgcaagtgcggcaacggctgcggtggctgcaacatgtaccccgaggttgaggccgccggcgccaccctcctcgtctccgccactgccactcacaaggggagctccggcggcatggagatggcggccgagaacggcggctgcggctgcacccagtgcaagtgcggcaccagctgcggctgctcctgctgcagctgctagatcattgatcatgcatgcgccgcgtgcatcatatctatgatctacgtatccatctactaccatgtaatgccacctgatcgagggtctttgtatgtatgtagtatgtacgcacctgcctgcatgagcagagcgggtgccattccatgcatgtaaacccctaaataaaatctcccgtggttttgctc

SEQ ID NO: 62302 - DNA, 629 bp, Triticum aestivum
  Clone ID: PAT_TA_62302
accacctccgcctccaccgcatccgccacgacccatcgaccccaagtcatgccccgatcagatccaaattcagcacaggatgctacaaaacctgtgggacaacacggaggacgggcctccaccggacacgcggctccacaagctccgccgagctgccgacacacaaccgccatcgccatcaaaacagctgaaggatgagagcaactaagcatcctccgccaatggcaacaaccccgacaactccggagaggccgtatgcgccaactccgccacgcgacgaacagcgtgctgacactaccgatatccaaccccggagaggaatcctggccaccgagagcgtccgattacagccgtcatagaccggcggcagacaaaactcccgcagcgcctacgatctgagttcacagtagaccagagtacgacaaggagcaacgactcgctgaataagaccactcccgtcaaagaactgatcgtagggaggacaacaaatagtaagacgacggccatgcttgctgctcttttgctatctaaccatgcgtatggtacggagtggtccgaggatgcatgagatctgtactatgattcgtactactgactaccaatgcgtgtaaaactatacatctggatcg

SEQ ID NO: 62303 - DNA, 708 bp, Triticum aestivum
  Clone ID: PAT_TA_62303
atcattgtcatgacacaccatcaaaagcataccactcatcacaacgtagaaatcaaactacgacccggcctcttcacgcaggccacgaattcgaccaaggacgtcacccggcgcaacccatgaggcgctgcgctcacaacatgcagcctatttcccagccgccgatccgccgcgttgcgtgtccagccagcgggataatgatctctcgagtcatcaaccaggatacctcccggagcgataaaaatattcctctataactcatccgcgaccgcgtcacctacaccgaaaagtccgtcgtcgaccgcccagacatgaacgcaagatacacactctagagacaggttcgatccactctacaggaattcagctggctaggcccgagagtgccacgccctgctcacagacgccatccgaactctctagaattggtagtctgatctcactggatacctatgagactgggatcgtccctcgatgtaagagtcgacagcaccctccatgaaagaaacgtgaaggacatttgaaacaagcatgatgcggaaaaccttatcgattaccttcgtgacagagaagaccgaaaaagcgccacggcctctagcacacgttcaaaatgaaccagcgccctaagcatctgtggacttctcgatgttccgtcacatactaaatcgagagacaataatttatgcacagatttgcattcagactatg

SEQ ID NO: 62304 - DNA, 587 bp, Triticum aestivum
  Clone ID: PAT_TA_62304
gggatcccaacccccgtcccggcaaacgcgttgaagaccattgcagcaggcacggtcaggagagccggagtcgatgtcggcggtggcaagctagagttccatcggggcgtcgggaggaaccgcgctcgtcctcagacatgggggcagagtgaaaccgaacaacgagcggagccagacctcgcaaggaatatacgctcggcaacgaccacccgcaatgagcgctcaggcggagggaaggagagagacggcaaagagagatgtgactcggcccagatgaaggccacgataaagaggatcatgtgcgagatgcgcgagcctgaaggataataattctttgatggagcctccactcctcgcgttcgaggggaaagcagcagaggccgacgccaccgcgtacgcgtgaggtgtccatgggctgttgtttgcgaacaatgacctgcctctcaggcaatgcgtgcagctatggagggacatatgccccccttggtgcagccatcgttggtgcgactggaacatatcattgcgcctaaatcctcctggagctagatatttgcatcccgtatcgcatgtccatctatatgttggtg

SEQ ID NO: 62305 - DNA, 243 bp, Triticum aestivum
  Clone ID: PAT_TA_62305
gggccgggtttccaactcatgtctctcgactccggccagttagcctcttcttcttctctagcgagcgagcaagttaggcttggaggtgaccgaaaatgccggacagcacgatcgccgtggggagccaccgcgaggtgtacgaggtgggcgccctcaaggcggcgctcgccgagtacatactccacgctcatctttgccttcgcccgccagggttccggatatggactctcaaaaagatgcgcc

SEQ ID NO: 62306 - DNA, 846 bp, Triticum aestivum
  unsure (1)..(846): unsure at all n locations
  Clone ID: PAT_TA_62306
gccgccacactccgctccgccctcctctcctcctgcgccctccgccggctcgcctccgcctccgcgccgcgcgccccccgcctcgcccagcccaaggggttcgcccgggctcgccggtcctacccggccgcgttcgccgcctccgccatgtcgacgtcgtcgggggccaaggaggcgccggccaacaacccgggcctgcaggccgaggtcgaccccgccaccaagggctacttcatgcagcagacacttgaaaagctcataaatgctaattcaactgaggttgattgggaacgttccttctatttgaatttagtcgctcacacgtcatatactgttcagtggcattgtgcagtatcagcaatcttcgcaatcgtgcagacaaaagcaagcggttgcctccaatttacaaggtttcaaaaactgtatatgcatcccctagccgtgtaaatttccgccttgatcaaagaaaggctgtagagacagtacctgcatatccgaacatttatttctcagttgatgacttcgatgatccttttgatgctgtggttttgtcagacccagaacactgctattgtgtgattctcaatgcgcatgatggggcagcatttcctgaagaaagcgaatcaagcaatgtcggttcaaatacaatctgggatcaactctgggagcagtggagagaacccaccaaaggttcactctcttcctanatgaaggtttcatcgtgatgaccgcagctctcttctatgtgatggtagtttagatgatcgatatcgacttttaatgtgaaagacaactcgcggtctcgagacttgtaatataatgttctatctttgttccggcttttca

SEQ ID NO: 62307 - DNA, 560 bp, Triticum aestivum
  Clone ID: PAT_TA_62307
cgattcgaggaggcatggcctgcgggtcctctatgctcacggttgcgcgcgacggggggccgtgctgcaaccgttgcgtggtcacggctttggggcggctgcgaggacggcgtatgcggagcgggtgctggaaaggacgtccacgcgcgctggagacggtggccagcgatgctgcaaccggccacggcgacagcaaccgctatcccaatttgatgcgatgagcaacgaccggtgaggatagagacgaccatttttcctttttgctggaaccaactcttgttttttgctggaacaggcgtcccaatttgctgccatagcgagaaaaaacttgtgaggatggcgacagcaatttttctttttgctggaaccagctccctattttgctggaaacggcatcgcagggtgctgggacgggcgaactcgtgttttgctacagtcaatcactggaagttcttcctcatgagtcgttttgctggaaccggtgttcagttttgttggaaccgggtaattttttgctacaatcatcgatggagtccttgatgaatgagttgtttttgctg

SEQ ID NO: 62308 - DNA, 320 bp, Triticum aestivum
  Clone ID: PAT_TA_62308
accaccaatcctcccaccttcaatctcattccccccccccccgcttctatacaaaaccagaactcctctcccctgcgaaatgtcttgatcgcttatcaaagagacaccaaggaagacgagaataatgcgacgtgagagcaccccgactgctcactgccccgaagccgacaacacatggacaggggcaagcaaggccagacgacggaaatgaaggaccagagccactgagagggcggagacgcgcaaggatcaacaacgccctacgagcacgatgaaaggcgtgcacgtcaggtggaggatgatcctccaaggacaagaag

SEQ ID NO: 62309 - DNA, 475 bp, Triticum aestivum
  Clone ID: PAT_TA_62309
catcctcaacgtccgcgaccagatccagatattgagcaactcagtgtacaagagcgtggagcaccgggtgatcgtgaacgccaaggaggagcgcatctccctcgcgctcttctacaacccgagaggggacgtcccgatagcgccggcggcggagctggtgacgccggaccggccgtccctctaccccccgatgaccttcgacgagtacagggtgtacataaggaagaacgggcccaggggcaaggcgcagctggagggcttcaagggccaagccgtcaattaattaaccgggtcttgcggcgtgtatgattaatctgatggcaaataactcatgtcttgtatgagcgctagcccctacatatgatatgtgtacgtgtggctaaactgcatgccgactcgtgtagtagtatgtcctgtatgatatgtgtaccccaatcaaaattaaaggacgatatgctatgcatatatgctgatt

SEQ ID NO: 62310 - DNA, 646 bp, Triticum aestivum
  Clone ID: PAT_TA_62310
cccatctcgctccaccttcccctgcacacaacccaccaccggaatccccacccgccctctcgaagcagcagctagcgatggcccccaaggcggcggagaagaagccggcggcgaagaagcccgcggaggaggagccggcgacggagaaggccccggccgggaagaagcccaaggccgagaagcggctgccggcggccaagacggcggccaaggagggcgaaggcaagacgaggggccggaagaatgtcggcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgccggcgaggccgccaagctcgcccgctacaacaagaagcccaccatcacctcccgggaggtccagacctccgtccgcctcgtcctccccggcgagctcgccaagcacgccgtctccgagggcaccaaggccgtcaccaagttcacctcctcgtagattctattctttgtagaaatgtagatggttctgttacttttagtgggtgttgactctggctatctgcaaatcgttcaagtaatagtcatggatggaagttgctg

SEQ ID NO: 62311 - DNA, 629 bp, Triticum aestivum
  Clone ID: PAT_TA_62311
atctgcctccccttcgccttccttacctcgagggcagctaccggcgcgccgcggcaagccagccagaccgtcactgcttgaggcgttctgacggattcacgaggatgccgaaggatacgggtgatgccaagctcctgatccagtccctgaacaaggcctatgccgccacgcccgcaaatctcaagatcattgatctgtatgttgttttcgccatagtgactgcccttgttcaggttgcttacatgggagtagttgggtcatttcccttcaactcgttcctctcaggtgtcctgtcatgcataggaactgcagtgcttgctgtgtgcctccgtattcaagtcaacaaggacaacaaggaattcaaggatcttcctccagaaagggcctttgcagattttgtcctgtgcaatctggtgctccacctggtgatcatgaacttcctcggataagccactgtcctacgagtttctgagattttgtagtgtccgtcctaatgtttgagactgtcatcatgttagatattcatgtggtatcacacaactgtcggcgtgatccgagagtttctctgtgagctataataattttgtggatttagtattaacaatgtatgaaaatgagaacttaatttc

SEQ ID NO: 62312 - DNA, 666 bp, Triticum aestivum
  unsure (1)..(666): unsure at all n locations
  Clone ID: PAT_TA_62312
caccaaactcacccacctcttcccccgccctctggagcacaagtccgagctagctagaagaagcctccgtctccaaccatataccatggcggcatcggtggcctgcgccttcttcttcgacgccgagccggtgggcgagcccggcatgccggcgctggacgcgtgcgcgctctgcgccaagccgctggcgcgcgacagcgacgtcttcatgtacagaggggacacgcccttctgcagcgaggagtgccgccacgagcagatgcacctcgacgctgtctgcgccaggcaggccgcccggaggctgcagcggttcacggcggaggcggagtgccaccgtgggcagcggcagtccaggaaggtgtccatcgcgagctagccggccggccccggaaagtattgtttggatccaaaatatctggattctgaagaaaacaacatctgtattctgaagaaccatcgatgtctcttgggaggcgttgtctgatgtctccctctccggccggtgctctagctttggcgccgcctacgagaggcagggcagcatcaggcggcacgaagcacaggtgcctgtagcttcccgcatgtgtccatgacaagctaattaagctgcccggatgggagtaaattgtacttgttcaaaaaannnnnnnnnnnnnnnnnnnnnna

SEQ ID NO: 62313 - DNA, 498 bp, Triticum aestivum
  Clone ID: PAT_TA_62313
accttctcagcggctcccgcgggcgcctcactcccacctactccgcggcccccgccggcgcctcgccccccaccttctccgcggcccccgccggcgcctcgcccccaccttctccgcggctcctgccggcgccaggctccccacgcgacggtcgcctcccttcgccaaccggccacctcccgcttcaggcagttcaggcgtcgccccttcgcctccttctggctgccctcggcgacgctccagccgccactccgcctcgtccctggtgggaggtccgtcaccggtccatccagcggtccaaacccaccgcccgaggccgttcaccttcgcagcacccctttccagcagccatcgtgaggtgttcagtccagctcctgcaaccaacacaggccgttgccccttttgccacaacggcaccagcacaaacacgagcgtggtcatcctcaaccagttcctcacgcggcctccccgcaagccctgctcgtgtatgcttacacc

SEQ ID NO: 62314 - DNA, 505 bp, Triticum aestivum
  Clone ID: PAT_TA_62314
ggcccgctcgaggccggcccggccaacccggcgccctggcacaccgcgcacacggccggcgccgcgctcaccgccatcttccagggcgccgtcgcgctcctggcattcacccgcaccgccgacttcctcgccgagctccagtcctacgtccgcgacgacgacggcgccgtcatcctcaagatggtcggcgggctcggcaccgccatcttcgtcctcgagtgggccgccctcgcgctcgccttctccctgcgcctcgacgaggacgacgacggtgacgatgacctccgccgcgccaagaactgggccgacgcctaccatgtctgagcggcgagcctccgcgctccctgcatcttcacccgctgtggggagcggcgcctccttggtgttactgctgtcgctattcttttgtgctagtagtactgtgtgtaccgtggtctcagattcttttgtactatgatatgatgtcaaggcaaatgtatattgcttttgacctatttaatcgaag

SEQ ID NO: 62315 - DNA, 826 bp, Triticum aestivum
  unsure (1)..(826): unsure at all n locations
  Clone ID: PAT_TA_62315
ctcgtctcgcctcgcctccctccccgtggcaccgcagcgccaccgcgccggcaccgcccgtcaccaccaccacgcgccgcccggctccccgagctccgccgccagggatctttgccggccacgaagctcgccgtcggcctcgccttcgctggttctagccgggatccaccggatccggcgccccacgcccagatccgtcggtccccgtcactggcgcccctccaccgccgccctcgggcctcgccggagcatcgccccgcctcgccaacgtcacgccgaacccccctgccttcccctcgatctggtgggatcgggaggaggagcgacccgtgagccccggcccaacagcgccaagcccagccacttcttcggctgggccggagccggcctgcttcggcctcctccgcggcctgccctcagcctcctcaccgaatgggccgagcccatggttccggtaacgttgcaattgtgaggatttgatcgactacgcccgttcatcttcttcatggactcgttcatcttccttgcgggatttcagttgcaggtacaggttcatgcgatgatcatgacgcgagagcgacgcttgcttgcgttgagttcttcttctgcttcttcttcgatcaggggataggttccaggtcggcagcctgagctagcagggtggatgtcgtttgagtttctgtttgtgattcatccgtagtcggatgatgctcttatgtattgtgatgttgtattcatgtggcattgtatgccttatgtatgtatccccatctattatgtaatgttgatgtaatgatatccaccttgcanaagcatttcaatatgc

SEQ ID NO: 62316 - DNA, 502 bp, Triticum aestivum
  unsure (1)..(502): unsure at all n locations
  Clone ID: PAT_TA_62316
ggcctggccgggnaaaatctaaaaaaaaaaaaaaaaaaaaaaaaaaaaaaaaaaaaaaaaaaaaaaaaaaaaaaaaaaaacaagcttccttcaaccatggtctctcaggaggacctgggctgggttcctgggcgtgatccgggccacggtcctggtcgcgacggggggaagaaggccttgttccccgccagaggggatttaagcactgggaacggaaacagaataacaccgtatggaaatatctaccaggcaccttcttatgcggcgccgacgggcccacccccaggatatcctcctccaaagtagtctgaagccttggaggcgatcgaaagttgaagcacgggaatacttttgtagcgagcatgaaaaaataatttgccaagggggtactcggggttgataaataaacatagggaggcactgatgctcaattgtacatcgatccattcccctctccgaaaaaacgccaccgaaggactctgttgttagtcgttcttttcac

SEQ ID NO: 62317 - DNA, 811 bp, Triticum aestivum
  unsure (1)..(811): unsure at all n locations
  Clone ID: PAT_TA_62317
atcaactacttgacagcgtcagtggtcggagcagaggtagctagctagcacagtgccaagctgaagctgtgcagcgcgcggcctgaggccgcctaaggtttttgcccctggtctcgagctgctagctctacatatacgtctcgcggtggggttcgtggcaatggccgccgtcgagtgcggcggtggggactggcccttctccgccgaggaagcgtacgccgattcctctgcgctgttggcggagatcggctgggcggccggttttgtcgacgacgcctgcgccggggagctgcttccgccgctggatccgcctccggccacaccaacggggtctctatggaaggggccggcgcctcgtcgagctccaccgatgacggtgccacgcgggaggctgcggacgccgacggcaggccggccgccgcgacagaggcagcgagcaagccggcgccggcgccagccccggggaagacgatgaaaaagcagaagcgggcgcggcacccacggttcgcgttcatgaccaagacggagatagaccacctcgaggacggataccgctggaggaagtacggacagaaggccgtcaagaacagtcctttcccaaggagctactaccggtgcaccaacaacaagtgcacagtgaagaagcgcgtggagcgctcctctgacgacccctccgtcgtcatcaccacctacgagggncagcactgccaccacaccgtcaccttcccgcgcggggccggngccgccaccctcgccagccagatggtcttctcgggacaccaccaccaacaacctcgtgtacaacgacttg

SEQ ID NO: 62318 - DNA, 691 bp, Triticum aestivum
  Clone ID: PAT_TA_62318
aatgcaccaatccaccatcgaccagcagcgcctcctactgtcagcctcagcatcatcataagttaggaatggggaccgggaccatgaggctctcctccccggggacggccggcacccctacgaatgcctccagggcggcacccgttcggagagggccgcatcaccatgcgaaagacgggggacaaaccccacgtggcaccgcccagcatcccgagacacggatccgaccgcgtgctctagctcggaccgctctccgcagaccccccgagctacctcaccggtcagcttcccggcgactacggttgggacaccgcgggactctccggccacccccagaccttcgctgataaacgccagctgcaggtgatccaatgtcgctgggtcatgctgggcgcgctcggctgcgtctacccgtagctgctcgtccacttcgcggtcaagatgggcgaggtcgtgtgcatcaaggccgtctcccacatcttcggtgacggggacctcaactacctcgcccaccccgatgtgtggcacgaggagagcatcgtacgtcatctgtgtctgccagatgatgatcatgttcaccgtggaggacataccgcgtgcgcgtctgcccgactctccagataaaggacccgttctacaccgatgatagcttcgacctcctggttctcgccgaggaccccgaggcgttcgc

SEQ ID NO: 62319 - DNA, 521 bp, Triticum aestivum
  unsure (1)..(521): unsure at all n locations
  Clone ID: PAT_TA_62319
ggaatccgcaagaagcacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcttgcatgcacttccagaagcagnaccgatcatatcgatctactactaccataccatgtaaccgctaccagaaaaagaaacttatctatgcacctgacctgcatcagcagtcaggtgccctgccatgcttgttgcaaacaggcccccctaaataaaatctccctggcctaaatacaaaaaaaacaacaaaa

SEQ ID NO: 62320 - DNA, 679 bp, Triticum aestivum
  unsure (1)..(679): unsure at all n locations
  Clone ID: PAT_TA_62320
cgggccgggntttaccaaaaagagaaaaaaaaaaaaaaaaaaatttaaaaaaaaaaaaaaaaaaaaaaaaaaaaaaaaaaaaaaaaaaaaaaacctcttctcttctcttgtcagggggggggggcggccggggttcccctcctccccaacctcgttgttgttcgggggttccatctccgcccccgacttcgccacggccccaacgggggggaggccgaggggggggttcgtccccgcggccggggggggggggttcggggcctcggcctcggggccgggggggtccatgttgttgcggaacggaggcgccacgttgttcgtcaccgccggggccaactccctcgggggggccttcaacgcgctcaccgagggccgcctcgtccagaaaagtttgagaaaaaaggttgggcatgggctatccggggtctttttcatggtttcagggccactcttcagaaattcaaccggggaaaggttcttcgcgggggaagccccatttctcaattgcgcgaggtttctcacctacgggctcggtttctactcggacaaagttctagaaaaatcggggacccgggaaggaaaacgagaggaattgctgagaggccctctgaactatgccatcgggctacggatcattgttcaagccttcgggggggactcccctatcgggatcatctcc

SEQ ID NO: 62321 - DNA, 791 bp, Triticum aestivum
  unsure (1)..(791): unsure at all n locations
  Clone ID: PAT_TA_62321
agggcgcttctcctcctcctttcccctcagcttgttacccaaactcccaccaaaacatatgatacactcaacatcatcataatccttcatcatgggtgtcaagcagttctttaaagaccgccctctaaaggtcaaagatagcaaagttaccaaagcagctgaactcaccttgcgagaatccatctggcccattgctctcgtcacggtcctcttcttcctttggggtttcagttatggccttctcgatacgctgaacaagcatttccaaaaggtcctcgatattgatcgtgctcgatctgcaggtcttcaagctgcgtattttggtgcttatccttnttcctcgcttggacacgctgcctggattcttcgccattactcgtacaaggctgtttttatctggggtctcagcttatacgctatcggcgcattgattgccatcccatgtatcaaagccaagtcctttgctggtttctgcatgtccattttcatcattggtaatggacttggttcgcttgagacagctgccaaccctttcatcactgtctgtggtcctcctcgatactcggaaattcgcatcaacatttcccaggcctttaatggtgtcggcactgtcattgctcctgtgctaggttcatatgtctttttcaacaacctcgacgatgaagaggcattggccaacgtgcagtgggtatatctatccatcgccgtcttcgtcttgatcctggcttgtctcttttacatctcccaaatcccctgaatcactgatgctgacatggcattccaagcccaag

SEQ ID NO: 62322 - DNA, 576 bp, Triticum aestivum
  Clone ID: PAT_TA_62322
acccccaagcacaccagcctcctcactcctctcacccgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagatggccggcggggagaccggcggctgcgactgcaccacctgcaagtgcggcacggcctgcggctgctcctgctgtatttgctactgagccggcgcccaggaggccggccggcgaggcgagcacgaggatgaggaggacaactggacaagcaaccaccaccaccaccaccaccatcactagccgctgcatgcgcccgcccgcgcgcgcgctgaataaaataaaaccgtcgtgtgttccttaactctgcacctgtacgcccgtgttttccaccatcagtgtccttgctcatggcctcaactctaatacatggcgcctcctcta

SEQ ID NO: 62323 - DNA, 720 bp, Triticum aestivum
  Clone ID: PAT_TA_62323
aaccgtcgcgcacgactgttgggcagttgcccacatctatcttcagttttggctcgaccagcgccgacggtcgctgacgccaacgccatggcgccgcgccttctgcctcaaacccctgcggttgtcgagattgaaggcgatgccctcgcctacgtatccacgccgaccggggcctccatgttcaccttcggctccgacgcgaggagcatgacgagcgccctggtcgcgcctccgtctttgccgcgcgtcgatgctgatgtgctccgcctgccgtccccaacttcgggcacgtcacctccttcaccgtgcgcaggcgctcgccgccgccttttggtcatcggcctcccgctagccagaccgccgggagactcgccaatgagcagccgcgggcatcgcgctggcacctggagcctggccactaagctcgtgaacagcgcctccaacggcgtcaccacgaggaccctgctccctggtggatccccgactaggaagagggtgcccgaaacactgctcgccgatgtggagctctgctgcagtgttactggaggaagtcgcatggtggtctccgctgtttctggtggaggattcgaggatggagagactacttgcttcctctcgctccttatctcattgactcaccgaatacactgcatacgtgccatgtgcatgcggcacaccagcatactgtcctgtctatttaactagaaacttactttattg

SEQ ID NO: 62324 - DNA, 410 bp, Triticum aestivum
  Clone ID: PAT_TA_62324
cccccccccccccacaccctcttcagaagaagtcgataaagatattaggaagagaggtaggaacttgactcgagatgggatcaaagccggctcgttctttgtcgggaaggcccctcccaagcctctgacttggaaagctggccataagtcatgcctgtgtaccagaagtgcaaggaaaagttactggaactgaaccggaaccgaagctcccggtgcaacatctacaataatagaagaccacagaaatatggcatgctaaggatacacttgcagagtctggcctgaaatatggcgaatgagttgcaagccgacccaccaatgaatgtttataccatctatgcgactcatgaatttgcgcaccagaggataaatgccaacacacttcgaggaccctcaccctgcatggccat

SEQ ID NO: 62325 - DNA, 805 bp, Triticum aestivum
  Clone ID: PAT_TA_62325
atcgaatcgtcaaggacgacccagccctcggagcccttcgccgccgccgatgtctgagaggagccgccgccgtcttccccaccaagagatccaccctctcccccgccaacgccgtcctccactcaccttctttccttgcggggaggccccagatcgagttgagcaagtcagcggggtggcggccagatccgccacggccacatctcgtcgagatgggccgcgctgggagaggtagatcgagggggcgggcaccgtgtgtgtcttctctctcgggacgccacccccgaccctatccagtgaggaggcagactctgtgtgcgtctcctccgacgacgacacgctggaccgagggccatgctggaacacccgagccagcaccatgatgcatggggtcgttgaacacatctaccccaaagagagcaagcctggtcttccaggcccctttcggattcagatgaagaggggccatgtcagataggatgtagctgggaaatccaaatgtacttttttgacaagtaatgctaacattagaaataattagaaagacaatcaaggacaatgcacaagaacaaaatacttaaaaaaacatagatatgacttggggcatacaaaggtgtccatatatctgggtaaaccaaaccatattttaatcgaaaaggtgaaagcgtacacagctcaaaggaattctgtctacatctgaaacgataaacccgatgaagatccttccaaggtgcttcagttgtgcctcttctcacactgaaccaggccattggcggagtagtcgaagaaagcacgctgcactagc

SEQ ID NO: 62326 - DNA, 845 bp, Triticum aestivum
  unsure (1)..(845): unsure at all n locations
  Clone ID: PAT_TA_62326
atccgccnngtgttgaattcgggaatggttgagaacaaacaaaacatgacaatcaatggtcaattgaggttccatgtgtaacgcccgctttgtcagccgttacgtgcagttgaggcaggagcgtctctgcagagcaacatacaaactgcttgctaccaaagtacctcgcattgaggctaccctggaacctggccaaacaaatagctatctttctcgctatcgctatctaggagttgagtctatttctccgttttcgtcttctctccactaaactcgtctttgacctgctcatagagtaatcccgaccgagcctcagcactcaccaatcttgaccaaccaaacagcctcgcgacaatggcttacgacgacagagacacgatagtcgtgagtggcgaagatgcaattgagccacaagagaatgtatcagaatactctcttccattatcggtgcccgatcaagggcttgatgatggttcgcaccccattgttgatcagctgccagacgcgtctgcatcaccactagctcagcaggagacaagcacagcatctacatcaaagggcatcaagaaagccaaaagtaaaaagagagttgtcgtgaagaaggcggccagaagatcaaaatggaaccaagacaacatcttgacggaccccaaatcacctctagcttcggctgatctcagaagtatattgtcaaatcctatggcctgggaaattctagaaaatgaagagagggcagaaatactagcactctntccagattctcagcacatcctcagtgcaggcacagaagacgcctgtccctgatttgcatcgctcatgaatgatgacagcttttcgctatgact

SEQ ID NO: 62327 - DNA, 756 bp, Triticum aestivum
  Clone ID: PAT_TA_62327
ctccacctcccacctcatcgccgccgcatggtttgactccatcgcctcctccctcctcctcttcgtctccggtaggacaggtagttaacagctccagcagccatgggtaaaggagaagatccacatcagcattgaggtcattggccatgttgactctggcaagtcaaccacgactggccacctcatctacgagcttggaggcattgacaagcgtgcgatcgagaggttcgagaaggaagccgctgagatgaacaagaggtctttcaagtatgcctgggtgcttgacaagctcaagggtgagcgtgagaggggtatcaccattgatattgctctctggaagttcgagcaccaccaagcactcctgcactgtcattgatgctcctggtcaccgtgatttcatcaagaacatgatcactgggacctcccaggctgattgtgctgtgcttatcattgactccaccactggtggttttgaggctggtatctccaaggatggccagacccgtgagcacgctctccttgcgttcactcttggtgtgaagcagatgatctgctgctgcaacaagatggatgccaccactcctaagtactcgaagggccgttatgaataaattgtcaaggaagtctcttcatacctgaagaaggtcggatacaaccctgacaaggttcccttcgcttccatctctgggttcgaggatgacaacatgattgagaggtccaccaaccttgactggtacagggccccacccttcttga

SEQ ID NO: 62328 - DNA, 268 bp, Triticum aestivum
  unsure (1)..(268): unsure at all n locations
  Clone ID: PAT_TA_62328
gggncgggncttcactcagngacagagagcagncagtagcctcctccgncgncacccatgggaggaggagggatcgngnggggncgnctcgnggnggagngnagggctggggnagaanancnnnntggnttnnnnnngnnnngnnnnagnggnnngnngnnnnngnggaatctcntgatctggaactggaccatccncggaaaagcgggaaatgattgnnaaagnnggtactacncnctaactctcccnntnnanngangactaccct

SEQ ID NO: 62329 - DNA, 735 bp, Triticum aestivum
  unsure (1)..(735): unsure at all n locations
  Clone ID: PAT_TA_62329
tctccgaccntcccgggaaacctcccatcgaagcgaaccaagggtctctcctcctcctcctcaagatgnagatcttcgtgaagacccttaccggnaagaccatcacacttgaggtcgagtcctctgacaccatcgacaatgtgaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtggtatgcagattttctttaataccttgcaccgccccccaccatcaccctggaggttgagtcctcggacaccatcgacaacgtcaaggccaagatccaggacaaggagggcattcccccggcacagcagcgtcttatcttcgccggcaagcagcttgaggatggccgcacccttgcggattacaacatccagaaggaatcccaccctccacctgcaactccaggcttcgcggaggccatgcaaatcctttgacaagaccctcactggcaagaccattacccctggaggttgagtcctccgacaccattgacaatgcgaaggccaagatccaggaccacagagggcatccccccggaacagcagcgccctgatctttgcccgccaaccagctcccaggaggcccgccccccctgcccgaattccacaccaccgaaagaacccccccc

SEQ ID NO: 62330 - DNA, 547 bp, Triticum aestivum
  Clone ID: PAT_TA_62330
gctccaccttccttccatttcctacaacacttctctgcctcctcttccttcacccccttccggcgcctccaaaccctagcccgtcgagccagccggaagaagcggcgaaacattatggggtgggccgcgcggttcctgactgcggtctcattcctcgccgcgggcgtcctcttcgcgccggacgcgctcttcggcggggcccccggccgcccagccgcgggcgtcgcggcggcgaggctggcccatgtactctgcttcgccaccgcatggggagccgcgctctgggtcaccttcatcggcggcatcgtcatgttcaagcatttgccaagacaccagttcgggagtctgcaagggaagatgttcccagcatacttcatgttgatatcggggtgttcagctatatcggttgcagcatttgcatacctcaacccatggaagacagcatcaactattgagcgttaccagcttggtttccttcttgctgccctcggctttgacctgtcccaatcttctggtcttcccccccatgactatccagatgatgatg

SEQ ID NO: 62331 - DNA, 756 bp, Triticum aestivum
  unsure (1)..(756): unsure at all n locations
  Clone ID: PAT_TA_62331
gggnncgggaagagcccngaagngaaaggtaatcccaatccccacagaaatccccatctcaaaaccctagccctcatccccgatcccggngagcgagatggccaacccgagggtgttcttcgacatggccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcgtttttttccatctacggcgcgaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttccgccgtcgccgccgccgccccgtgtgtccccgtgccggggcgccgatctaaataagagagtcgtgtgtcctgccccgtccttcccctgggccctccgatgaaatccccgtggttgg

SEQ ID NO: 62332 - DNA, 807 bp, Triticum aestivum
  unsure (1)..(807): unsure at all n locations
  Clone ID: PAT_TA_62332
ggccgggccggatgtagcttggngaatcatgtatacaaatgagtgatttgtgtctagaatctcatgcaccgttgtcagccttattaaagatagaaactctgccacttgatgctaccgctgcaacagaaatgttgtcaggcttactcaagatggccattagatcactccatgccggtagtgttgtaacagaacatgggtcagtagcattactgtagttgtgccttacgtcgcagggtaattggctcgtagtactgctaccttcaaagaatcgaagagaggtaaatatcacttttgacattgtgtgtttgttatgcgatttacggatttatctgttgcagcactcctatgtgctatatgctgcttgaggtcatatacgaaatgtgctgaggttcttcttcctttggatgaatataggtgaggaaaggacagttggcgtgcttgactgtgtgaggatccaagaaggttaaggattcagaaatgataggcatactgtttgatgtggctgttcattcatgggagtgacttcgaatcactgggaaaatgtatcatacttgcacacgctgacatgtcacgcccacgatcagtcccgcctgcagcctgacatgacatgttaatttggcagatttcctgtgtttagacttgaacatactgtttaacctcgtgtgaatattacaaaggaataggttgatgtgtgagaaggattcctgagctccatgctcttgtacaagctgatcctgtctactacgtagcttttaagcttgcctgtctatacatctttttctgaaaaaaaaaaaaaaaaagccccta

SEQ ID NO: 62333 - DNA, 452 bp, Triticum aestivum
  unsure (1)..(452): unsure at all n locations
  Clone ID: PAT_TA_62333
tccgcccccacgccctacaacctgcagtgccagctcgtctcccccgtctgtgccgaggacaagtccggcggagtcccggccccctcccccccgcccccccccccctccccccccccccccgccccccccgccgccgcctccgctgcccccacccccgccgccgccgccgcctctctctcccccccccccccccccacctgccgcaaaggcccccaaggatgaggattataaagaccagcccaatcagccgagccacgacccccctgcctcccccctcttccaccccaccttctctaccctgcccctccccccatccgccccccccccccatcgccccaccccctctgccccccccccccccccgcgccccccgccgaacccccccccacacgcctccccccccccatgccccgtgccccccccccngcccccccgcccccccccctcccccc

SEQ ID NO: 62334 - DNA, 454 bp, Triticum aestivum
  Clone ID: PAT_TA_62334
tgctgtgctctacacgttttaggtccaggtctcgagcggcggcggcggcggcggcggagatgagggcggtgaacggcgaggtggtctcgtcgaagccggtgggcttacacaaggccgcccgcgtgttcagccgcttcgcggccagagaggcgtcaaggctgcccgccggggcgggcgtgctggtcctctgcgcggccgaggccgccgccgagctccacgccttccgctgcgcccgtgtggatcccgatggcgaggctgagacggaggtggtgcagggcggagatgggcggcgcaagaagaggaggaagacggggcgcgaaggtgtgttactatagtaggctcttttgaaaaaaaaaatccatgtgttactgtgctagcgactagtctgttgttcttgatgctgttaaatccatttgttactgtggtagcgactagtaataatttgtctggtggc

SEQ ID NO: 62335 - DNA, 465 bp, Triticum aestivum
  unsure (1)..(465): unsure at all n locations
  Clone ID: PAT_TA_62335
ngaacccgccaccaggccctgatgccaactatggtcctcgtcctgtacctcaacggcaacaattgcttgagtctcaatcacctggcagttacgagcctcagcagccttacccaggtttcaagccatatcaaccatagagtagattatgaactgaaggaaaacaaaggcgttcgctacttgtttcggcattttctggccatggagttgttttttgaatcttggtttaaggggtttgacttggttttctatgcataggcgtttatggttggtctacatggcactcattaggatacgggtccaaatcctctgtcggttttggttgggaacccaatgatgtacttcttgttctcgctatttggcgagatgcccacgggcaatttaagcatagatctcgctgttagctataagatgaattggcatagagcttgatacgagtaacgtagctaacatctgttctcttctcgc

SEQ ID NO: 62336 - DNA, 204 bp, Triticum aestivum
  unsure (1)..(204): unsure at all n locations
  Clone ID: PAT_TA_62336
ggggtctcccagngaattcgacagcccccgagttctccggatccgatggccgtcacgttctccgacctccacaccgccgacgggntcaagggcctcgaggngcacctcgccggnaagacctacatctccggcgatgggatcaccaaggacgacgnnnagggggtcgcggnggngnccgngangcccngggncgagntcccgaac

SEQ ID NO: 62337 - DNA, 744 bp, Triticum aestivum
  unsure (1)..(744): unsure at all n locations
  Clone ID: PAT_TA_62337
gccggctcgagccggccgggccgggctcgtcgcagtctctcctctgctctcccgctccctcctagctaggntagggttttactttcccctccgacaaggtttcaccggagacgcgtgccaccatgactgccgccgagntgctccgctcccagntcgaggagnacaacatcgaggaagatgagnctatccttgaggatgatgatgacgaccatcaagacgataacgaggatgaggatgaaatggatgacgatgatgttgagggaggtgatggtagtggaagatctaggagtgagaagaaggggaggaaagncatggagaggnttggnatgaagggcattactggtgtgagncgtgttattttattttagagccacaccgctacgtttgtcctctccnagncagaagtnnttnagagntcgnactcaaaaacatatgtcatgttcggggaggtcaagatggaggacatggacgctaagctgcctgaccgaagcggccggggcaagctccaggcgcccgggacccgggcacgccatcctcaaagggggaagccccccgtgggagcaaccccangaagaaggaggaggtcgatcaagacgggcggttgccaacaaaggatgttggagcgtgcgatggggggagggcctcctgggttccagggccccgggntcggtgaaaggcggttccaagggcgataaatggtgaacctttgtccactccccctcgtaggagtttaactaaataagg

SEQ ID NO: 62338 - DNA, 663 bp, Triticum aestivum
  Clone ID: PAT_TA_62338
acctttgaagctgccgccggcgatcgacccacccaacctccgcaatggcggcgcacaagtacatcatccctgtcctcctcctccttctcctaaccactgccggcggcgaggccccacgtgatgaccgagatcccctcctccacaccccggtaccgccgccgcctacgcctgccgcacaccgctcctccactctcctcatagttctgctcagcttagctgctgccttcgtgctagcctgcttcgcatgcttggtttaccgctgctgctgggctcctggcgacgacggcgaggatgtccacccaccgccgccgccgccgccgcagatagtggtacttatggcgcctcccgctgtggtgcaggtgtagcagtgaagatggcagacgcaggcggagtcgcggaagtaccttgggacttggtggaatggattcggtgtgtgctgctgctgcctgggtggactggagtgccatggatcgtacgtagaactgggtaaataaatagtattaatgtactatcaattggcttcgcatgcaatggtggttgtatagttgaatcatggtggtttagttggttaatgggtgcttcaattaggacttataatcgagagtcgtcagtcataatcgagtgtggtgttgattgattcaataaagggaaacgctctgaacc

SEQ ID NO: 62339 - DNA, 504 bp, Triticum aestivum
  unsure (1)..(504): unsure at all n locations
  Clone ID: PAT_TA_62339
ttctccttccccttcccatccaccacacccagcctcntcgatntgnaacatcctggtccccctggatgnacgagggatntcgggncgncgnanccttngggagttccctcccctccccgccttctttccgtggntctgcagacgnaagggatctcgggtcgccgtcgcccttcgagagttccctctcctccacgccttctttccatggngcgagggaccaagcgncatgtatagacttacatacgtgctggtggncactgtcctgtaaccccgccgncagnagggttttttttgaccagggcccccaagntaaggagtganatggtggtgnggtgnccancaccatntgtgagaaccttggaaatctaggaagatgcaagtacaaccagaagactatccaaattggaggatcccacatcatatatgggagcaagagatccaaaactggtaaatacatgcactaattcaattcaaataggagaagggaacaatgtgaacgaaggc

SEQ ID NO: 62340 - DNA, 849 bp, Triticum aestivum
  unsure (1)..(849): unsure at all n locations
  Clone ID: PAT_TA_62340
gttgcccgtgttgccgccccgaccgccgcctccaccacccacccacccacaccgcgncggnctcttccccctgtcccgtctcccccatggnctccgncgncgcatccgncgtctccttcgncaggnccgtnaaggnaatnaatgggaantcggtctccttctctgctccaaggaaaggtaatgtatccttccgtcttcagtcagttccccagagattttctgttttctgtgttgtcaaaaaggagatagtataaaaggtttgtgatattgtgaagagtcagtttgtgtttgttgaganactgtagtttctggttcctctangtttgntgattttggtgtcgattccttggataggtttgagattgttttgggtttttaggaggtttttgggattnngngtggaggagtcgagtgtgtagatcatcgtaatggtggaagatgtccgtcaatctcatcgacagtcttgttgtaaattaaatatattttttttgtaatattgtgttacctactgtaatcgttgttgttggagatgattnngtttgatttgttataattttatgtggatagtttgggatatttgtaatagtgtttttggntgttttgttatatttaatatatttttttttaatttaatgttgaaaggaaatttttttttggttgaaantgtgtttgtataattaatttaaaaaaaaaaaaattgtntcttaggttttttatttgttttttttattttaatttattttttttatttttattttttttgtgtttntttggttgtttttatatttttatttttttattttttaatggtattctttgttttaatatttttttttgttaaattttttt

SEQ ID NO: 62341 - DNA, 589 bp, Triticum aestivum
  Clone ID: PAT_TA_62341
gccgcttcgagccggcctggccgggaccagcacaccagcctcctcctcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggtgcacaggaggccggccggcagaggcgagcacgaggatgaggaggagaagcaagcaatcatcatcaccaccaccaccacccagcgtatcactaccactagccgccgcatgcgctcgcgcgcgcgctaaataaaataaaaccgtcatgtgttccttagttctgtacgaccagtgtccctcctcatgcctccacttctaatgaatatatggcgcctcaactttgaacgatat

SEQ ID NO: 62342 - DNA, 442 bp, Triticum aestivum
  unsure (1)..(442): unsure at all n locations
  Clone ID: PAT_TA_62342
cctcggggncgncgagctctggcgccccgngggngnggggncgngggtgggngccgncggcgngntcctcgtgctcntcgtggcccnnntctccgtnntcctcgnnngncgccgccgccgggggtgcggacgccttgtccggnagtaggaggatgtccccggggtgnncgcgtccccctccccgtcgtcggggtccgtgtgctgcgtccggctnaggggtggggggtctcgtgacggaggatgatctgagggtcgtggtggtgatgctgggggttggtgtccgtttgngtgatctccccccccgccatcccgtcatcggcgngggtaacgaggtcgttgcctgcgaagacgttgtagcgaacagtgaccgcggatggctcatcgctacactatatttagggtgacaactcatgaggcgttgctcgaggaccacccattgagg

SEQ ID NO: 62343 - DNA, 261 bp, Triticum aestivum
  unsure (1)..(261): unsure at all n locations
  Clone ID: PAT_TA_62343
gggttcctcctctacctccgctttcctctcgngccgccgcagncgccacctcctccgcaggnagnccaccgcgaagngaggtcgaataagncatggnagacgccaagggcacgacggnggncaccctccgnacccgnaagttnatgancaaccgnctggtcgnccgnaagnagttcgtggtcgaggtnatccaccccggncgggccaacgtctncaagggggagntgaaggagaggntggncaaggggtangaggngaagg

SEQ ID NO: 62344 - DNA, 723 bp, Triticum aestivum
  Clone ID: PAT_TA_62344
cgcctcccactgccattctccgctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgacctcgagaccttcgccaagaaccgggagctggaggtcatccactgccgctgggccatgctcggtgcgctcggttgcgtcttccccgagctgctcgcccgcaacggcgtcaagttcggcgaggccgtctggttcaggccggctcccagatcttcagcgagggcggcctcgactacctcggcaaccccagcctggtgcacgcgcaaagaatcctcccatctgggcctgccagggggtgctcatggggcgccgtggaagggctaccgcgtcctcggggggcccgccggggtgaaaatgggggaaccgcttctacccccggggggggttttcgaccccctggggcttcgccagggaacccgaggggcttgggggggttaagggggaagggagttaagagaaggggggg

SEQ ID NO: 62345 - DNA, 743 bp, Triticum aestivum
  Clone ID: PAT_TA_62345
cgtcatacaccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggaggcagcttcgaccccctgggcctcgccgatgaccccgaggcattcgcggagctccagggtgaggagatcaagaacgggcgcctcgccatg

SEQ ID NO: 62346 - DNA, 698 bp, Triticum aestivum
  Clone ID: PAT_TA_62346
acttctccacactaccagttcactcctctcctatccccaccctctcaccccttgaaagagtgagagagtgtaccatgagtcccattaattaagaaacaaggcgtgacatatgtgatgcctctattgctggtgctagtgctctgcgcaccaacgggatgctagctgcgagccacgatgcctatgtgcagatgtgcatctcggatatcctctccaatggcatgtctaatggcaagtgctgcaccaaccgtgccgtctctcgagattcggtccgccttctcgccagtgaatgcctagatgaccctcattctacacagcgatcacatcacgcagaacaccacgtgagactgcacaccctcagcacttcattccgcctcgccgaccttgactaggtaggatacttatgaaacctgtttaatatgtttatgtagatgccgccatgagagtgtatgattatactaagaccgagctatgagaaaaccggttactgcactgaacgcttatgcatgctaactactatgagcattatatcttggtgcaagagtgatgaatagaatgtatgaggaaagatctagacttggccgaaatatgtcttccgtgctgatgttgcttgaatatataatttggagtttactccgtctgctcttatggctttaaaaaaaaaaaaaaaaaaaagggcccctaagggccccctaggggcc

SEQ ID NO: 62347 - DNA, 801 bp, Triticum aestivum
  unsure (1)..(801): unsure at all n locations
  Clone ID: PAT_TA_62347
tttcttccccttggntcnaatcatgaaaggnatnnatggnttnggnggggtcggggggtttgtggncagggntggggtnnngaagncggatgncgatgtcgtagccgntaactgacccttcatcataaccgagtacatgatcatatgtgttatgnatgatactgtgctnggaaagtgtgaagnaacatgaagtgaaggtgtaggggtccaaaaaacttttattgtgtgagaaggaggttgggggggttggntgaaggaatttaatagatatcccctcgccccctgntgntggtggtgagtagnttgttgagnnnnngggggttttntctgaaaaagacaaagatgttgttcacattaaagggtggtgccaaatgaaaggtatcatttttgactcccagtgaggatgatccctaatgtaagactgtggagtaaatgaataattgaatgaaaaaacagataatttacattaggtccaaagctagctgtaatactaaattgtccttgtttcatttgcataagggtatacaaattgaataaataaggtatttgttgaaggttttgaagaaaaaaatgttaatgtcttgaatatgaaaactcaaaaaaaatgtngaatggacctatacaaaaaaagacagaaaaaaaagggaaaggctgtcaattttcaaacaataatctccaagaaancattgtataccgaaaaggttgtttgggaaggggttccccaaaataaactgaaaagggactggaaaaggcantcccggancccaatggntaagggttaaggttgtgaaattaattgtt

SEQ ID NO: 62348 - DNA, 530 bp, Triticum aestivum
  unsure (1)..(530): unsure at all n locations
  Clone ID: PAT_TA_62348
ggattttggaactggacttttacnctgattgatgaagatgaaaatgggntggncnagattgnncgnaattggaggggaattggnttcgagttctttacggatgctggncagnatgnnattnggnttggggatgatggacanngnagaaaaattggnntnggntnnnatatttattatntnnnngnngnccgncngntgagnnnacntggnngggnngnannnnttggtntggnngggtcccctggaatcagattacttcctcctaagagaggggggcgctggggactgccttttctcttatcgcgacaggagnagaagcgcataccgaatgccatccctcagggtcacaagcggaacttaaattgccagttctttcacccatttgcatgtcctgaacgaaggctgggggccactccccgccgccaccccattggggatcattaccccgntgnacccgngcnntttttttttttccccggggccccgnncttgggntggcttttncgnnggnnnnntnnggccccccgggg

SEQ ID NO: 62349 - DNA, 634 bp, Triticum aestivum
  Clone ID: PAT_TA_62349
agcctccggatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttgggatctagtgcttctgggtgtttg

SEQ ID NO: 62350 - DNA, 725 bp, Triticum aestivum
  Clone ID: PAT_TA_62350
ctgggcctgcgtgctcatactggaggccgtcgtgcccgcgctggccgacccggacccggagatcggggcggcgcggcccatggtgccgcaggcggcccgcgacagggcccgcggcatggccgacgagtggaaggaggccgccgagcgcaagggcggggtggagggcgccaagccgcccgacgcccacgccttcctgcagcacgtcgccaccttcgccgtggcggagaaggaggacaaggagctgtacaagaggattgtcctcagcttctcctggcgcaggcagatgccacgcctcgctctcacgcttggcctcgaggatgacatggaagaaatcattgaagagcttatcacaaaggggcaacaacttgatgccgtgaactttgcatatgaggctggtcttctggaaaaattctccccagtccctcttttgaaatcctacctggaggattctaagaagatatattgcatttcagataacgtgagcactagcagtggccaatctggggtcaatgcaaataagaaggagcagtctgtgcttcgggctgttataaagtgtgttgaggaccacaaactcgaaggcgagtttccattggaggatctgcggaaacggctggaaagattggagatggccaaaaccgagaaaaaaaaagcagccctcagctgttccagtggcggcccagcaagcaagcgcatccaagggagcgctggggggacaatgtccccct

SEQ ID NO: 62351 - DNA, 628 bp, Triticum aestivum
  Clone ID: PAT_TA_62351
cttgtgtccaaattctagccttcacccagccccaaatatctccatatcttcagagattgtagctccgcgatgaatttcgatttatctaggcttgtctatgagtgactccttagcagtattaaaaagtttaaggattctacaaaggttgcttccaagagatcaatcacagatggcggctgtcactatgcttgagctgtgacttatttcttttcttttattccctttttatgctgcttcctttgtttattgttatttaattatcttttctttatttttctgctaggtttcttaccttgaccgtgtgcactctgggttgaattctcttcctgacagcaagcctataattctggtatggagaggtaacaaagttaaggatttctcggaattacataagagcaacagtcgttcgtatggcaagaggccgttgaagcgtttatcaccatcagtttacgcacaggttagtccttgtttgtctttttcttaactttctttgccaacttttttatcatagttagctctcaccgaatattctaccttttttttgtggtcagaagtcttgtgaaaagttttcttgttcagtaaacctataagatcccctttgccaataaaatttcaacttcaaaagttc

SEQ ID NO: 62352 - DNA, 513 bp, Triticum aestivum
  unsure (1)..(513): unsure at all n locations
  Clone ID: PAT_TA_62352
cttaccctncnctcgtctccctcctctctacgacggagagggataccaatactcatggccatgcgcgcgctcgcgccctcctccatcaggtagccgccgcgctccgctcggncccttgctgcgccgggcccgccggaccttgatttgccgaccgttgcgcccgggagcacggggcgccgccgcagtgccttcccttcgcctccctgcttctcttccgcgtctgcaggcttcccctcgagctcatgtcgtggcagttgtcgccctgattcccgacccaccctggtgctggtacctctttcttttccgcccctgccgggggctccgcgaggccgatttcggtggggtctctatcttggctnngcggatgtgctgccatcctccctcgagtgtcgacggcagacgagcccaaaggacatcccgcgtctcaccgcccccatccttcggtggagagtcgctctaggtcccgtgcgtcatcactgcttggtcgcgcttcatatgggtgtccctatcgaa

SEQ ID NO: 62353 - DNA, 867 bp, Triticum aestivum
  unsure (1)..(867): unsure at all n locations
  Clone ID: PAT_TA_62353
cggcgggcgggacttccagctccaccattctctagtcgatcttcacgctctcctcgccgccaagatgttcgggttcgggcaccaccacaaggaccaggcgccggnggngtcgggncccaaccagatcttcaagatctactggcgggnctcggaggactactgcctcgccgnccgcgacggngaggtggtgctcgcccccgtcaaccccaaggacgagacccagcactggntcaaggacatgcgcttcagcaccaccgtcaaggacgaggagggcatgccggncttcgcgctcgtcaacaagggcaccggcctcgccgtcaagnactccatcgcgcagtcccactctttttagntggngccgntcaacccggngnangaggacgngtngggggtgggganggagagnaaggaagggggnaagggtttccgctgcatccgcatggtcaacaacaccccgcctccacttcgacgcccctcaacggggacaaggaccacgggggggtgcacgacgggacccaccgncgggctctggggaggggnggaaggggggaaacccagtgctgggaagatccgggccggggggccgaggggcaccgcccgccgtggaggcccgggngcccccctggggcaaaaaacgnccaccgccctgggggggggggggcccccccgtgggacgnccgggggcatctttctgcaaggggccgggagggagtacggcccttcacggcccggnaacgggaaccggnngggctccccccccccccancccccggggaggaactaaccaggacggggaatnnagggaaatggggggcngggaaanaagaaaagggggggagaggaagggtcnccctgggctttgggaaa

SEQ ID NO: 62354 - DNA, 505 bp, Triticum aestivum
  unsure (1)..(505): unsure at all n locations
  Clone ID: PAT_TA_62354
atcttcagtggctacattgtctatgacacgggcagcatcatcaagcgttacaagtatgacgagtatgtctgggctgccgtcacgctctaccttgacatcatcaatctgttcctgggcctgctgactctgtttagggcgtgtgacaactaggcacgtctccctgcccctgctctctcgtgcttcaaatcccgtcgacgaatttggtatcctgatgagtccttgacatgaagaattgtataccctggtctgtctcgctggcacggtgaaaatgttgcttactttagttgagttgatccctagtagagagaaaacataagaaaaccgtgcgtcggttctatcctatggatggtggatgtgatgatgtatttagacgtgctggattggtcgattggtggtgctgggtttatttagctgggtctttgacatgctggactggtggtgctgggtttatgtagctgcgtggcttacggacgagggcaatattgttttctagcacnaagnanng

SEQ ID NO: 62355 - DNA, 282 bp, Triticum aestivum
  Clone ID: PAT_TA_62355
ttctctcacactctctctcagactcacaagcaagcaaggaagaaaggatctcctcaagacgacaggaaagagctcctcctcctacctccaagctcttccactccgcctgtaaggacgccagggccttcatcgcctcctacaccgcctccgactacgccccgaacgccgactcctccgttctcgcaaacagcaggaataacgcactcgacgccatcaccaacctcggccggaactccaagctacgaggcgaatacgcgcaccacatccagcgccaccgcctcc

SEQ ID NO: 62356 - DNA, 346 bp, Triticum aestivum
  Clone ID: PAT_TA_62356
tgttatttccgatctcccagccccgacccccaccagacctccgccgcaaaccgaatccctcgccccgccccgccccgtcccgaaatcctagctaggcagtcatgggcaacccggagaagatgatggacgagatcttcaacctccagctcacgcccaactcgctgcaggggcacgcgcgcacacgcgagaaggaggagaaggagcagaagctcaaggggaagaaggccctcgcgacgccccccgtggacggcgcgcgcatctacgtcgagaacgccttccgtctgcgcaccgatcccatgaactccctccgcctcccctcccgcctccacgccgccgtctcccgcct

SEQ ID NO: 62357 - DNA, 781 bp, Triticum aestivum
  unsure (1)..(781): unsure at all n locations
  Clone ID: PAT_TA_62357
atcatatctcagctttctcggtctgcccggaggagagaccaacggaaacgacgatgacagggacgatggagatgtgactgagtacggctactaggggctggtagcagtgccctacggcttcactctctttgtgcatgaactaccactgctcggccgtgcgcatgaaggagacgtgttctaccccaccatggacgccacccattcggacaacgaggacgacgagcgatgcaactgagggcaaagggatcttcacaactctgttgagatggtggcgctctttttccccacgctggtgctccgacgcactgcagggacccggtcatcgccgtcgacttgcaggtgatctacgacgtctgcaggatcttctactttgacgcctacgacaccgacgtctcgaacaacctctacaagattgacggacacaacttcgcattcattgtgtgactggtcttctgatcgcgcgtttgcttctcatacactcttgtactcaggaaaagcgatctgacgtgcacgtactgatggctggcttgatggcctgtgtagcacacgagtacatataggcgtgttcatgacgtctcttctcgtgtgaaatctatgcgggtgccactgatatactctcaccatgtaaaggtgtgtgatagatggatgatagcatctatcctctactgatgtgcgcacagttatagatatatatgtcgaaagctactgtatttcttgtgccagatctgcaggacatgttatgctcgtaggtatctccagcgacgctgctgntgttgcgtgc

SEQ ID NO: 62358 - DNA, 510 bp, Triticum aestivum
  Clone ID: PAT_TA_62358
accatcacactccactagcttaaccacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacccgcttgtgtggag

SEQ ID NO: 62359 - DNA, 536 bp, Triticum aestivum
  Clone ID: PAT_TA_62359
gcctctcttctccgtacgattgtgaggctaaggagatggaggcgaagaagaaagcggccgccgttgctgccctgtgcatgctcctcctcctcacgctgccaaatccatcccaccagaagccatccaagcaggggccgctgtccgacgtcgactgcgagtgctatcggcagtgctaccccaggtgcaaggacatcaccccgtcgtggttctgcaaggtcaagtgcgccactcgctgccccttgagcggcccaggccacaccttcgacgggatactcgtctgcttcgacgcctgcgactcgcactccatctgtgacctgccggcgccgttggccaatgctgaggtttgtaagcattggtgcttgggcgccaactaagcttgaagagccaagagctggtcagtcatgggatcacagtcagtcaataaaatggttctgatttctgcaccagtcaataaaatgtgttgcgctttggtgcatgatgcatcacttgtgagaaaatttgttaatcttaaaataaagtgtgacaaatccccgtct

SEQ ID NO: 62360 - DNA, 585 bp, Triticum aestivum
  Clone ID: PAT_TA_62360
accatcgcagcagacatcggagcgaactctctactctcagcgtccgtccggagacacgactacacgtcccatgggcggccatgacgataccttcgctctgcgactgatccgcctcgaaaactcgcgccctgccaacgagcactccacaccttgcttcacctcgccggaagtccgccaacacaagtgaccagttcgcgtgaccgctacaacccccagtcttctgagacaatgtcgccggaaccacactacgactcgagattcaggagcttgctcttagcctagcttgagcgccagatgcaagagcggcgcctcctgctgcaccataatgtgcacggcatgatactacgatccggatgccgctcggcatccatcatgttatctaatttgggtgtgggatgagtttctcaggtgctctgccactgataagcgacctgcattagacgaatatgctatgagtggctgacgtggtcagagaatggatcactgtactgtctacgccaatggtaaggacctctgcgtactgtaggaagacacctattattgggacggcttgaatagctgatcaaaagatattatttgaattga

SEQ ID NO: 62361 - DNA, 782 bp, Triticum aestivum
  Clone ID: PAT_TA_62361
aatcccgccatacaccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccctgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggcggcagcttcgaccccctgggcctcgccgatgaccccgaggcattcgcggagctcaaggtgaaggagattcagaacggccgcctcgccatgttctccatgttcggcttcttcgtgcaagccatcg

SEQ ID NO: 62362 - DNA, 155 bp, Triticum aestivum
  Clone ID: PAT_TA_62362
gatcccaggagcgtcatcactcgagaatgtttggctcgcacctgctcctgctactggtggcgctctcttcattccacggccacctcgacgcccgccatggccggaggcacgcgcctgcagccgtcgccgccgtacgctatatccgccctggcggc

SEQ ID NO: 62363 - DNA, 598 bp, Triticum aestivum
  unsure (1)..(598): unsure at all n locations
  Clone ID: PAT_TA_62363
annttnnnttttttttttttttttttcgtgccgtctcgagccggccgggccgggttctccaccttttcagccgcagctatgagctattgccgctccttccaactggccccaaacaaacagaccccaaggctccctaccgcatctctttttttcttgaggcagagatacgattcatttcagttcagctgggatgccgacgccgggctgtcgcgccgcgcgcttgtggtgccgctgggccgagctctgtacgggctagagtttgccctgcccgaggacgcgtcgccgcaaggctgcggtcgctaggggagccgggaactgccgtcgcgaccgatgtcaccatcgcgtgaggcaccaggtccgcacgacgggggcgcggacaactgcgccgccgccgccggggagggtgaggccacgtaccgccggaggagcatcgatgccgcgctttgcagaggatggctcccgtctctcgttcgacatcatttaagagctgcgagaatatttgagaacatcagcggaaggggtaatagcaccagtattgtgtgaaggcggcagctgacaggtctcagctcgcctaaagccaacctgaagcccccagcca

SEQ ID NO: 62364 - DNA, 843 bp, Triticum aestivum
  unsure (1)..(843): unsure at all n locations
  Clone ID: PAT_TA_62364
ctcccctccaccccatcgccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacnagggccccacccttctcgaggncctggaccagatcaatgagccccnagagncctcagacnagcccctccgtcttccccttcaggacgtgtacaagattggcggcattggaact

SEQ ID NO: 62365 - DNA, 682 bp, Triticum aestivum
  Clone ID: PAT_TA_62365
ctcgacgctgctcacctaccaccagatcgaggagaggaacatcagatcggaggaggagaaaaggggatcgagggaagagaagggatcgagggtttcgggaggctggcgacctggctgatccaccgcgaggcctctccgctctgaccgacgcccgcgctgctcttctcctaccccgaccgcgaggcctctccgctctgaccgacgcccgcgctgctcttctcctaccccgacgaccgcgctgctcttctccaacctcaacgaccgctgctgatcttctccaacaccgacgcccgcatcgctctgcttcaactcagacgcccgttgcagctgttcgtccccaactccgatgatagccgctgtggcatctcctgcggggcgccggactcctggtgattctttgctccgggtggtcggctgatctcccgtgaaggccaccacgattccttcacaaggccgggacctctgctgttctccttcgcctgcaacatctacagcttcgaattgaagctcaccaagaccataggctctgaacttctctcttctcctgtcattgttttctgaatatatgcattgttggatctgaaaattgctctgtttcctatgtacccttgctgaaatctcatgtattcttgctggatggttgtgacacttgctgaatattcagatagtagttattctccat

SEQ ID NO: 62366 - DNA, 706 bp, Triticum aestivum
  Clone ID: PAT_TA_62366
atagactccgctctacaccctgccttctccccttctcacccctctccctcgcaaagaaaagccgacgccgccgaatctccaccaggcgagcaagatggaggtgtgtgaacaaccacaacaccagggactactccaagcgcgtccaagcggagccccagaaaaggagacaggggaataccgattacagggatcaggagtcaagctcactaaccagataacaacggcagaacacgcccaagcaccggcgtgttgcacgacgttaccaacacagatgtcactgcggaaattgtgcaccctaccattgctgctgatattgagatggcttgctgactattcccagtgagcttcctcgggatgggattgtcagatggcctcaccaattatgctcgtcgagtactgcactgagtctcgcttttgtcccgacgggcggtcccgtgcccagagatatatccggaatatgaggggaaagccgaggccaccgcggaggacttctctgctgagccaactgatgagacgacgactatccgcgcactcttgtatgccagccttattaggacaactactgtaaaccgtgcgtgtgttgccctcaagggagatgtgaatgtggtgcatgatattccgcaaagtagatacagactggctggcttcaaaaaggatgagaaacagctgcactctgacattcccgcagaacatctatggatggcat

SEQ ID NO: 62367 - DNA, 330 bp, Triticum aestivum
  Clone ID: PAT_TA_62367
cccggcccgtttgtcttgctatccggtttcgtctcgccctcgtctccagcggcccggacggcgagccggagacggcgcccatctcaatctcaacgtagcggcacatcgattcccggcgaccaaacgatgcggcggccggcggcgagtgtctctgtagcatcgaaggttcagtctgtacccaagaaggccaaagagatgatacacttttctagagatcagctgattgggttggcatttgttgcatttggcatcatattatttgtgggtttcttctacgcagctgttgtgtccaaaaatgcttccgccttatgagaactggcttctaatctg

SEQ ID NO: 62368 - DNA, 679 bp, Triticum aestivum
  Clone ID: PAT_TA_62368
aaatctccttctcagtcgctgccttccgtcccctcctagctgcttctctcggctccgagtccacactggggcaagtatcgacgccgcgacgtccaggccgacccacaccgtgcggtggtgtgcgcctggatttcggggggccgcaccgactcgtccccggggagctgcgtcgtggtgggcgttgccaccgaacgcgaagggaagcgatgactccactgcccgagcggcggcggacggcaggatatggcgctagcgagatggttcgttgagccgcggcagaggcagctgtcgctggttaggaaggcagcaacacagccacggttcaggccgtccatctctgtccgatgctgccgcgctgaggcaccaagcgagccgcatcgagtcggcactctacaggcgcctggctgaggcggctccgttgtgctgggatgctgtcgtcccttcttcaatggcgtccgtcgcagacggcgtcctcacccccagagctaaagtttagtgggcttaaattccaactgggccactaagttaatgggctgccacgtcattccatgtcagcagatgatgtggcatacaagttaacgtcgttataagcacttcagttaggtgcaattcacgacggacaaaatccgtcacggagtgtacaatcatcaattatgacgcgatatacatgacagatttc

SEQ ID NO: 62369 - DNA, 591 bp, Triticum aestivum
  Clone ID: PAT_TA_62369
acaccccaagcacacctgcctcctcactcctcacagtcgcagcatcctctcagtcctcaccttcctcccctcgccaccacccaccaaggaaaggaggatgtcttgctgcggcggcaactgcggatgcggcgccggctgcaagtgcggtaacggctgcggagactgcaagatgttccccgacgttgaggccaccgccggcgccgccgccatggtcatgcccaccgcctcccacaaagggagctccgacgagttcaagacgggcggcggggagaccggcggatgctactgcaccacctgcaagtgcggcacgggctgcagctgctcctgctagcatctgtaactgagccggcgcccaggatgccgaccgtagaggctagcacgaggatgatgaggacaactggacaagcaaccaccaccaccaccaccaccatcactagccgctgaatgcgcccggccgcgcgcgcgctgaataaaataaaaccgtcgtgtgttccttaactctggacctgtacgcccgagttttccaccaggagtgtccttgctcatgcctccaactctaatacatggtgcctcctcaaaagaaaaagaaaa

SEQ ID NO: 62370 - DNA, 174 bp, Triticum aestivum
  Clone ID: PAT_TA_62370
cggccgctcgagccggcgggccgggatttcccactaagcgtgagctccttgctcttgcctctaccgacgatgctgacgatctctcccaaagcagccgtccatgtggtccagggccctgagcccgctcctcgtgaggaactccccctccgccccggtgaggagcgtgacgcctgc

SEQ ID NO: 62371 - DNA, 659 bp, Triticum aestivum
  Clone ID: PAT_TA_62371
gatattggctgactcactatcagacgacgacttccgtaaggttttacctagatttcagccagagaatcttgagaagaatgccctgatatttgagagtgttaacgccatggcaacaagaaaagggtgcacaccatcacaacttgcattggcatgggttcatcatcaggggagcgatgtttgccccatacctggcacaacaaaaatggagaatttcaatcagaatgtaggagcactgtctgtgaagctcacaccagaggagatggccgaactcgagtcgtacgctgccacaggtgatgtccatggtgaccgataccctgaaatgatgaatacttggaaggattctgagacccctccattgtcctcttggaaagttgagtcttgaataaactagctagctgttggttttccatgtattttttgtttcatgtttagcagtgcacgagcccacgtattgtgtggatgccgtccgcgtcgagtccggcaatggcatgtgtgtccatgtcgctgccatgcgtgcaacatggtctagctgcacgagcggtccgtgggatggcacagatcgtccggtttgtggactaataacttgagcacgacgtcttccttatgcaaataaattgagaaagagaacgtgagaaaagcagcaaatttgtacgctgcac

SEQ ID NO: 62372 - DNA, 811 bp, Triticum aestivum
  Clone ID: PAT_TA_62372
gttgcttttgctttcgccttcgccttcgccgtcgcctactctatatccaattcctcctatttctcgatttccccatcgcaacaatggcccaacccggcgtgcaatcattgaagtgtgtggtgaccggtgatggtgctgttggaaaggtatgtcggacagcaaactgtcgcgcgacgactgtcgactctcgctgactcgatctagacctgtctactcatttcctacaccacaaatgcattccccggcgaatacatccctacagtctttgacaactactctgctagtgttatggtagatggcaagcctattagccttggcctctgggatactgctggtcaggaggattacgacagactgcgacccctctcatacccccagaccgatgtctttctcatctgcttctccatcgtcagccctccgtcattcgacaacgtaaaggcaaaggtaaattgatagcgacatcgcctcccgactctgctgacatctccagtggtaccccgagatcgaccatcatgcgccaaacatccccatcattctcgtcggaaccaagctcgatcttcgagaggacgcatccaccctcgagtctcttcgacagaagcgcatggagcctgtgtcatacgagcaggcgctgacttgcgccaaggagatcaaggcctacaagtacctcgagtgttctgctttgacccaaagaacctcaagagcgtctttgacgaggctatccgggccgttctcaacccccgacccacaccttcaaagcaaaagaagaacaatgctccatcctgtagatatccctaatcaacgacgtctcgac

SEQ ID NO: 62373 - DNA, 615 bp, Triticum aestivum
  unsure (1)..(615): unsure at all n locations
  Clone ID: PAT_TA_62373
ggagggtgggggggtagatgtttggggggaggnggggaggaggttggggtggggggnnnnnacgagccgcttcgagccggccgggaccgggaaatccaaaaaaaaaaaaaaaaaaaaaaaaaagacgcatccacctccatacccagcatcgccaaatttcacagcgacaaccgccgccatgggtatcgatctcgaccgccaccacgttaagggcactcaccgcactgcccccaagagcgacaatgtctacctcaagctcttggtgaagctctaccgcttcctggctcgccgaaccgatgcctctttcaacaaggttgttcttcgacgtctgtttacgtccaagatcaaccgacctcccgtctccttgtcccgcattgtcgccaacatcaacaaggaggccgagaagcgaaccgtcgttgttgtcggtaccatcaccgacgacaaccgtctgctcgagcgccccaaggtgaccgtcgctgctctgcgattcaccgccaccgcccgtgcccgcatcctcgctgctggcggcgaggctatcaccctgaaccagcttgctctcccgagacaccactggaagcaacaccctgaatcctccgtgggcccaaaaaccccccc

SEQ ID NO: 62374 - DNA, 833 bp, Triticum aestivum
  Clone ID: PAT_TA_62374
gatcccccctcttaacgacccctcccctcttttaccaccaccatgaacggagaagacccgccagagagaccccaggagatctcgtccatcatcaacggacttgagcgatacaaccctgaggctgttggtgctctcgagacctacctccaggaccaatgcgagcagaagttcactgactgcaatgccaaccgaacactattgaagctgtaccagctcaaccctgatcgcatcaaggatgaagtcatcaccaatgtcctggtcaagaccatgacccagttcccctccgcgcagttctctctcgctctccacctcatcaacccctcctcagttgtcactggcgacctcggtgaagctatcacaaagctccgatccctcaatggccaacttgagggtgctcagtactcccgcttctgggccgacctcgacgacgacatggttgccgatctgattgccgacatccccgactttgaggaggttgtccgtcaccgtatcgccctcctcgtttcacaggctttccgtgagatccagatcggccacctcgagtcatggctcggcctcaacgaggacgccactaagaagtttgtcactgaggtttgcggctggactgtcgatgccgaaggaaacgtcaaggttccctcaaaccccgacaacgaagccaagaaggctgagatccgtgaggacgtcaacgttgagcagttctccagggtgctccgacggtcatgggaggacactgtttaggctttttcagagttttagcggatcaaaagggatttcttgcgcacttccccccatacgatgggattcggacatgacgacccatgatgtggaaaagt

SEQ ID NO: 62375 - DNA, 810 bp, Triticum aestivum
  Clone ID: PAT_TA_62375
attcccatgactgcattcgtgcttgtctttacgcctgacatatctccctcccaaatgtcatccagaacccctctcagacgcttcaacaacctgaatctcggctctcttcttcgcaaacaaaatatcctcccccgaacagcaaatttctcccgaccttcacagagactaatcagtatctcgcgacccctcaagatgtccaacgacgacgactacatggccttcttgaacaaggcaaaccaggatactggcgcaggtgcatcgacacaggccaaggcagtattcaaggcaaaagatcaagacgctgaggtgcccaaggctatcgttgatgtgtgcaaaaaggccgtctacacatctgacgcagacgagcccttcgaagaggtgtctctcaagtggcagggcaagaatggtctacccacagagaccgaatttgccaagctcatcgatcactcctctcctgagtcggcagagatccagatcctcgaccctctgagctgggactctcatggcaagtacaccgacgtcatcgaagccgttcgcgaagcctctcatggcaacgatgtgcgcgtttaccaagtaacgagagactctacaagaatcgaatattgggttatttcacacgccgatggaaagctcattggtgccaaggccctctctgttgagagctaagttgtgtttttctgggattttgcctattctgagcgtttgaaatggaatatttatgatgagaatgatgaattgtgcaacagtggtatgctattgctaaggaataggcgctggccggtttttggtttgaatatagaactaatacat

SEQ ID NO: 62376 - DNA, 471 bp, Triticum aestivum
  Clone ID: PAT_TA_62376
ccctctccacccccagcatccatcatccacccacccccccggaatttcttgcgctatcgagcctggctcggctcgacagcagggatgtggcagccgtcgtggtgatgtgggaggcggtgctgatgatggctgggaggcaggcatcgccggtcctgtcgcgtgcgcaggtggactccatgctcgcggcgggagtggaaggagagacggggagggcaacatcgatcatgagagagtgctgatccggcgtgcaggggaagaacggcctggacccgcaggagaccgaacagcaagagactgtgtttttttttcacgagccccccccaccaaatcgagggcatcaatatgggtaaggtctcgggggaggccgagaaagaagaccagccagcgtgcgcctccccatcagaaagtccaccaaatgagacaatgtctactacactcaatacataatcctacccacatgcaagcatggaa

SEQ ID NO: 62377 - DNA, 514 bp, Triticum aestivum
  unsure (1)..(514): unsure at all n locations
  Clone ID: PAT_TA_62377
agctttaccacaccgcccntgacacgccgcctcttgccacagagaccgacacagggaagaaccaggagcgaagaagaaaaggaaagaagaggagatcagcgagccccgcgcgcgcactggagataggatccgcgatctcgagaggagcggagatggcgctcacgttcacgaagctagttcagccggctcttcgccacgaaggaaatgagggtactgatggcaaccctcaatgcggcggggaagaccaccatcctctactaagtcaagctcaaagagctctgcaccaccatccccacaagcaggtccaatgcccaaactgtagagtaccagaaattattttcaccgacccgccagccgcgagtcaggacgagatcacgcccctgaggaggactacttccagaacacccagagactcatggatgtcgagtacagccctgactaatagcgcgtgggtgacgcacaagatgagcttcaccggatgctgaatgaggatgatctgcgtgatgctgagctg

SEQ ID NO: 62378 - DNA, 618 bp, Triticum aestivum
  Clone ID: PAT_TA_62378
tggctccctccctccctccccgccgcgctccgcctcccgttcccctgcacgccgcggcgccgccgtctccgtcgccgcttctgacgacgaagatggtgaagaatacgtgctagtatttcaaaagggcccatagcgaccgttacattggcctctagaaaaggtggtgctggacaaagggaattgcttcccgcggcacgagaaagttcaagggatgcaccttgatgcccaacattggctactgctctgacaataacaccaggcactaccttcccagcaagaccaacaagcgcgctgactacaacgggtctgagatggacctgcttatgatgcacaacatgacctactgcgcggagatcgcccacaacgtctccaccaagaagcgcaaggacatcattgaccctgctgcgcagctcgacattgtgcttaccaacaagcttgccaggctccgccgccaggacgatgagcacactgccaggcgctatcgattggactggctccgatgcaggaaactactccgctgatctcttcttgtgtgactgccacgccagatctgctattccaaccttattgctcaccgtgtcgaactgtaatgtgtctaacatctactattgcctttat

SEQ ID NO: 62379 - DNA, 673 bp, Triticum aestivum
  Clone ID: PAT_TA_62379
gtctcctcacacgggtccgattctcctccctttcccccctcgggcgtggcgactattccctccgccggattgtactgctcaacaccggaacaagggcgaacgtcaagaaccgctcgttcggccgcaagctcgcctggcccaccgaagaaccaggtcgtgcggaccgcttcgccgggctccagatcccctccagtcgcatatggtgcttgctcgggaacaggcggcgactccaagggcgtcgggacgggcgccttcgcctacctcgaggccgtcctccaggacctggacgccgtgatggtgcagctcctggacaaccccgacatcgacgtcaacaaggcccgcatcctgccctcccacctgctgctggccgtgttcaacgaccaagaggtcgggaggttcctggcccacgtgaccatcgcccacggcggcgtgctgccctacatcaacccggcgcatgctccccaagaggagggtacagaaggagtccgggtcgaccaggatacgcggcaagtcccccgagaatgccgcacaaagaaggcttagactacagccggcgcgccgaattagcctacgcgttgaactgctctgtagtgacagtgatcaactgtttcgatgtaaatgctgtgttgaactcgttagaaaatttctctgatttgaccaaattgttttgttc

SEQ ID NO: 62380 - DNA, 731 bp, Triticum aestivum
  Clone ID: PAT_TA_62380
aatctttcaacacagactgtttcacaatgtgcagatatcgttttgtacttgctaaattctgggtgcagtactgcagtccttatcctcgttaaaaaaaaaaaaaaaaaaaaaaaaaaaaaaaaaaaaaaaaaaaaaaaaaaaaaaaaaaaaaaaaaaaaaaaaaagtccgcaaccaatcaatcaccagcgagcgacctaaacctccgctccgtctccgcctccgcgcaaaaccctagcggatccgtcaaccccgcggaaaggagggagggggtccgaaaatgcaaatcttcgtcaagacgctgaccggcaagaccatcacgctcgaggtcgaaagcagcgacaccatcgacaacgtcaaggccaagatccaggacaaggagggcattcctccagatcagcaaaggctaatttttgccggaaagcagttggaaaatgggcgaacattagctgattacaacattcaaaaagagtcgacgctccatttggtcctgaggcttaggggtggaactatgatcaaggtgaagacacttactgggaaggaaattgagattgatattgagcccactgacacaatcgacagaatcaaggaacgtgttgaggagaaagagggtattccacctgttcaacagaggctcatctatgctgggaagcaactcgctgatgacaaaactgctaaggactacaacatcgaaggtggttcagtgctccatcttgtgcttgctctgaggggc

SEQ ID NO: 62381 - DNA, 711 bp, Triticum aestivum
  Clone ID: PAT_TA_62381
agctacatcacggggtggcttctcctccccattttgtcctcggatgccggtccggatcggttccgttcggttcgttagggtttagaagtgaggaagaggaaggcatggcgggacgtcgagtatcgctgcttcatgggcggcctcgcctgggccaccgacgaccagtccctccagaacgccttctccaagtacggcgacgtcatcgactccaagatcatcactgacagggagacgggacgttcccgcgggttcgggttcttcaccttcgcgtccgacgaggcgatgctccaggcgatcgaggccatgaacggccaggacctgcacggccgcaacatcatcttcaacgaggcccagtcccgccgctccggtggaggcggcggcggcttctgcggcggcggcagcagcggcagctacggcagccagcgtcgtgaacgaggaggcgccggcggctacagcggcggcgccggtggctactgaggtggccgcagcggaggcggaggtggctacggcagccgggatggcggcggagactacggcagtcgaggcggcggcggcggctacggcggcagccgaggcggctccggcggtggcaactggagggagtgaatggcggggccgctccctggccagttatcctattcaccgatcctttttttacctgcctacaaaaagtgttatcaggtcgcctcccgaggaccctaaatctcgctc

SEQ ID NO: 62382 - DNA, 740 bp, Triticum aestivum
  Clone ID: PAT_TA_62382
ccgggatctctctcggggttggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcggggccctccagttatcgatctatctaccatctcgtcgtcttcgtcagcaagttatcttcagttcctgtgtcagtcagtctgagtc

SEQ ID NO: 62383 - DNA, 756 bp, Triticum aestivum
  Clone ID: PAT_TA_62383
actaagcccccgctttccgtgtttcttcttcacacttgacctgagctgaacaccaggaaaatgagtgtggaacaggacgtgaaggtggtggagtcgtgcatggtgactcccagcgaggagacgcctaggaaaggcttgtggatttccccgatcgacctcacgtgagccaccaggggccacactccgacggtgcacctgtaccttcccggctccggtcccgtcgatggcttcttcgacgtggccaggctcaaggcggcattggccaaggctctggtcgccttctaccccctggccggccgtctcggcatggactccaatggccgggcagagatcgattgcactggcgagggcgcgctctttgttgtcgctctctcagacctcaccgtcgaagacttcagcaagttgaagccgtcgcgggagctaaacaggctcttcattccccgcgtcgaggactactcgccgcccctcatgtgcggcctccaggtgaacttcctcaagggcggcggagtggccattgggatgacgctgcaccacacctccgccgacgccatgagcgcgttccacttcttgcagacctgggctgctttctccagggacgcggcggcagcggcggccctggagctcccgtgccacgaacgcaccctcctccgtcctcgctcccctcccgtcgtacaccccgacgctctcaccgtgttctgcccgagggtaggcaaatccgagccgccgggagccgttgagaacgtgattttcgtcctc

SEQ ID NO: 62384 - DNA, 279 bp, Triticum aestivum
  Clone ID: PAT_TA_62384
gctacatagaggggcagactcaatctgctgaccatcagcggcgctccctccctctcgcgcgcttctgcgccacgatcgaccgtttggtccatggagaaggcggcgtccttcgtctcctccctcctcggcggcggcggcgggggggacgggcaggcgggggagccggcggcgaccgtggcgtctatcctcatttaccccgtcaagtactgccggggcgtgtccgtgccgcaagaccccgacaccgccactcgggctcggctgagacctgcaccggttggc

SEQ ID NO: 62385 - DNA, 579 bp, Triticum aestivum
  Clone ID: PAT_TA_62385
atctctagaccctgttattgtgagaattcttatttcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactatt

SEQ ID NO: 62386 - DNA, 605 bp, Triticum aestivum
  Clone ID: PAT_TA_62386
cggccgggccgggatttttcctcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagttaccgg

SEQ ID NO: 62387 - DNA, 612 bp, Triticum aestivum
  Clone ID: PAT_TA_62387
gccgactcgagccggccgggccgggttctgcggtaacctcatctccacgccttttccgctcttgtcggcgcgggtgtcttgtccaacatgcagggcgtgctgggccatgctgcgtggcgatggctgttctggatcgagggcgccatcaccatgggcgttgccgtctctgctgcttttattcttcctgatttgcctcacaactcgcgtggtttcaccgaggaggagagacaggttgcgcaattgcgcatggtggaggatgtcggtgaggccgatgaggattctcgtgaggagagtgctttctacggtctcaagcttgcggccaaggatgtcaagatttacatcatgatgcttacctttaccgcgtacgtcgttggactctcgttcaatgccttttttcccagtttgacccagacacttggcttcggctacgttcccactcttctcatgagtgcgcccccatgggttttctcttgtattgcctcggtcatcaacgcttggcactctgacaagacaccaacaacaattctggcatattgcccgtccaatttgtgcccgaacaaatccgcttcccccatcacacatggccacccacgcctgtccccacgccaaacc

SEQ ID NO: 62388 - DNA, 747 bp, Triticum aestivum
  Clone ID: PAT_TA_62388
ggccgggaattcctagcctgactccgcaccccacccttccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggagctccgcctccgcggcggcgccaagaagcgttataagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggtaagtgcggcctcacctacgcctacaaccagaaggcttacaggttgcttgcgattgctctgctctttttactctacctatggagagcccaactcacttagatgtggcccgtttggtcgttaactgaaaccttgagccttatgtttccctgaatatttcatcacctactgctgaaacgcgatgcgggcttacgaaaaaacacaaaaaaaggccctaaggg

SEQ ID NO: 62389 - DNA, 801 bp, Triticum aestivum
  unsure (1)..(801): unsure at all n locations
  Clone ID: PAT_TA_62389
aacgagcggttctctctcctccgtccctttcactttccgagatctatccatctccaagccatggccggcggctccccgccgaatctctccctgatcgatccaggttcatgcccatgcctaattccgttcgccgcttcggaaagcttccacctttcgccgtgatccggtgagcacggtcttcggaaacaggatgggcgtacatgcgatcgatctggatgctgttccctgattgtcaccgatctgggcgctgtgttcccccatatgccctggctctctggccgttgtttctcatccgatctgaatcttggacgacgccatcttttgctgatagatgaacgcaagggggaaaggttcgatctttatgcagctcaactgtcttttatgtagtttatggctcagtcggtcccagatcaggatccagtaatggttgcaatgaccgcagcatgtgcaccagcactatcaggtgagaacatcggtctaagaaagtacatttatgtacctaacattctcttaatctcttgtgtgatgttgtttgcaagaaaatcgtttgtagctgtggaatcggtcgacagcattaaaaatcaagattacagcgatgctacctcatttgcagagattaattcccgcatgcttctaattgatgacttcagtactccaaaacagaaacaatcattctctcaagagcttaggtacattgaactgatcaagtgtatcagagtccatggaggtaaaaaactcccatgcagaagctggaatgcaagtggatgaagctcgattaataggaatcactanaacaggaca

SEQ ID NO: 62390 - DNA, 461 bp, Triticum aestivum
  unsure (1)..(461): unsure at all n locations
  Clone ID: PAT_TA_62390
tccactccccccgggtcgccaggaacctcgtgagctatatgcggagcagcagcacatggtcgcggcgtgcaagcccccccacgccgtgcggcgggcggcgctcccgctgcccgggccgtcgctccgacgagctttcccttgcaatccaggacctagccacacgcaagatcataatgaggcccaatagccatggggacctctatncattctccaccaactccggcgtgcaagctcttctcacggtggttggcagcgatgtgtggcatcggcgcttggggcatcctagtgacaagaccatctccactttagctcggttttttcttcccatcatgtaataaagacatgtcccaaaacaccctgtgtacggcatgtcaattacgcccagtggccccggctgcctttttcaacttcnaagacctttactacagcacctttgcccccgcacaaaaaaaaaataaaaa

SEQ ID NO: 62391 - DNA, 540 bp, Triticum aestivum
  Clone ID: PAT_TA_62391
ccctcccacacatcctccgcctccaccccacccgtaccgacccctctcctccaggcaaacccgcggggacggcaaccaagcaggggaccatagactacccgcttcgataataaaccgaaaaatggcgggcacgtgcccgccgggcacggaggtgcgcgccaggaccgaaagcatcccggaggccgcgggaacaccagaggcatgcaacaccacggcatcatcatctacaaaaaccatcccagtgactgcactaagggacggatgaccaacacccaccagctcacaaacggggtcaacacaccgacgacaaacataaagagggtctggaccgtgtcggcttcttgttaaagcaggcgaacacggggaggaaaagggcgccgtggttcacgccccgcatctagcgtacctcgaggcgatccgccagctgatgctgccgcaaaagcccatcgtccctctggataagcccgtcgccactaaccccgagaataacatactaggctctcttccgaatggcttgctagatgactacgtccatggtcg

SEQ ID NO: 62392 - DNA, 717 bp, Triticum aestivum
  Clone ID: PAT_TA_62392
cggccgctcgaggcggcgggccgggtctaatctccacagctgtccggatccttcatttgctctctatcctgccgccgtcggcggcagctccagatttccttccccatgattccgatcaagatcggcatgaatgagtttcggacggatcctgaggatcgaggccagggatgacgctccgcatccccgatgtcgagctcgtcgccgataacaaccccttcatcgccacacgactacatgcatctacactgtgcaagtatgacactgaccacgtatacgtcggaaccaccatgagattaacgtgaaggactccccgacccttctcttcttggacaaagatgttgcggagtctgactgcaggaacccatgatgaaatcccatggtgtgctagatagatgctgagtacactgcagagtccaccggcgtctatcactgacaaggacaaggatgcatgtctcattaagagtcggagccaagaaggctatcatttctgctctaactaaggatgctaacaaggttgctggtggtgacaatgctaaggaatacaaactggacatccacattgtctccaatgatatctgcaccactaactggcttgatcctcttgataacgctatcatggaatgggttgacattgttgagggttagatgagcacagtacatggcatgactgcaacccatatgactgatgatggtccttacctgcaagattggatagca

SEQ ID NO: 62393 - DNA, 830 bp, Triticum aestivum
  Clone ID: PAT_TA_62393
aatttgatcttttcctcatcttcttctctatcacaaagcagaatcaacctcagtcaacatgtctcaaggaaagacctttaccctcaacaccggtgccaagatccctcttctgggttacggcacatggcaagcctcccctggtgaggttggccaaggtgtctacgaggccctcaaggttggataccgccacttggatcttgccaaggtttacggaaaccagcccgagatcggcgaggccctcaagaagtctttcgccgagatccccggcctgaagcgtgaggacgtcttcatcacctccaagctctggaactcccagcacgaccccaaggtcgtcgccgccgctctcgatgactgcctccaggagctcggccttgagtaccttgacctctaccttgtccacttccccgtctctttcaagggcagccagaagcacgtcggccaggacctcttccccctcaccggtggaaacgagcctgatggcgatgttgagattgacgacagcatctccattgttgacacatggaaggccatgaccgaactccccaagtccaaggcccgcgccgtcggtgtttccaaccacaccaaggagcacctcgaggccctcatcaagggcactggcgtcacccctgctgccaaccagattgagcgccaccctctcctcatccagcctgagctcatcgcttactgcaaggagaagaacatccacgtcaccgcctactccgcctttggaaacaacatggtcgacgctcctctcctcttcacctaccccgaggtcaagggcgttgctgagcgtctcaccaaggagaaagggcaccgaggtcacacccaca

SEQ ID NO: 62394 - DNA, 599 bp, Triticum aestivum
  unsure (1)..(599): unsure at all n locations
  Clone ID: PAT_TA_62394
caaatctcanagatcccgaacagcgcaaccgtcgcaaacacacacctcgagagtcctacgacgccgaaagaaaaaaaaacaagcaagatggccggcaggaagggcggcgacaggaagaaggccgtgacccgctccgtgaaggtcgccctccagttccccgtcgggcgcatcgggggctacctcaagaagggccgctactcccagcgcgtcggctccggcgcccccgtctacctcgacgccgccatcgagtacctcgccgcagaggtcctggagctcggcggcgacgcagggaaggacaacaagaagacccgaatcatcccgcgccaccttcttctcgccgtccgcaatgaccagcagctcggcaggatgctcgccgccgtcaccataaccgacggcggagcgatccccagcatctactccgtgctgctccccaagaagtcccccgccgccgccgataacgcggtcaagtcgcccaagaagattaaggccgccaagtcccccaagaagaaagtcgtcgccaaggagcattcgccactatagcctattctgcgccgaggaaccgtggcccgttgcctaattagttggaacttgtatgtact

SEQ ID NO: 62395 - DNA, 480 bp, Triticum aestivum
  unsure (1)..(480): unsure at all n locations
  Clone ID: PAT_TA_62395
ngaaaagaaacatattcacaacacatatcaaccaaagcatccattagattgttgatcttgatggacaggcacaccaatcacacacgtgcaccagccatgctgctccctctactgtttctcgtgtgctttgctcttcatgcacaatgccggatcatcgagggcatggagaacgacaagatcaatttaccaactggactgtgcatctatagtaagggctgctcgggcaattgttgctacttgtgtctagtgctggaagattgctttgtatcaatggaggagtgcaagaaagcatgccaaaaagacacccctgccatctttaaccatacatccccatcaatttgagtttctcctttttaaagcggcaattaattgattggaacaagagtactttgttgtattcttttgaagccgatagttcttctcttataaaagttgtctcaatgtacgttggattcaactatgtaattgtttttcaataac

SEQ ID NO: 62396 - DNA, 637 bp, Triticum aestivum
  Clone ID: PAT_TA_62396
aaaaaaccagcacccagcctcctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcaaaaatgccgccgggaaaaccgggggtttgcactgcaccaacctgaaaggggggacccgggtgggggttggtcctggtggaacttggaaattgaacccgggccacaggaaggccggccccgccaaaaagggcacccccccggggttgtgtagggaaaaaaaaagaaattttttttttccccccccccccccccccccccggggtttgaacccccccaaacccccccccaaattggtctcccccccggcgcggaaaaaaaaaaaaaaaaaaaaaccccctcgtgggggttccctttataattttgttgtaacaaacaaaagggggccccccctccctgggggggccccccctttttaaaaaaaaaaaaataaggcgggcccccccccctctccc

SEQ ID NO: 62397 - DNA, 711 bp, Triticum aestivum
  Clone ID: PAT_TA_62397
tgacctgggactggtcctgggcgagcatgcacacgacgctgctgtttggcgagtggaggtgccacggggagtggcgctgcctttctgaggacagggcaacttcgacggcgagctggacgcgtgggcgtcgttcctgccaggtggcgtcctcctgcggcggcgccgcggtcaccgcgcagccggactagaaggcgaccggtgaaagctttgcacgacggagccgtcgcgactgacttggacgcctggcgccagcggcgacggcctcgaggctcttggagacgccaagccacgcctggccctttcctcgagcctcctatcgcgcccgagtggatctcccgaggcagcctcatccgccttcgggcgccgccggtaagcagagccgtcgtccgtgggctcccgctagctcagaccgctgcgaccagccagacgcgcggtggtgagccagtccagtaagagataacggccgcggccataaatttctaataaatgcagggggcttacgccaaattaaacattttctagggtgccccttaaacaggcattgcgggtttattcaaagaaacataggggtttttcggaaaaacgccgacgacgtacgaccagaagcagtatttgctttattagcaggcagacaaattagtgggaagagctggcatcatctccaactcttggaccgaaaagttttttccttttacaaagtggggggtgaag

SEQ ID NO: 62398 - DNA, 269 bp, Triticum aestivum
  unsure (1)..(269): unsure at all n locations
  Clone ID: PAT_TA_62398
acttccactcccgccttctcaatcccccatcgcgnccaaatctctccgcacctncaacccactagccgcaatggacgcctccgccgccggcgtcgtctccaaggcgaagaagtacgggntggggcgnaagctcggcggtggcnccaggaagaaggcggtgggcgcggtcccgtcgaggttcgggctgcagttccccgtctgactgcatcgggctgcagtgtgacggcttgggcgcccccgtctaactccgcctccgccacacagtacct

SEQ ID NO: 62399 - DNA, 770 bp, Triticum aestivum
  Clone ID: PAT_TA_62399
gcaattccccacctcccgcgaacacctctccctctcccacctccgaagcagcagcagccatggcccccaaggcagacaagaagccggcggcggagaacaaggtcgagaaggcggcggagaaggcccccgcgggcaagaagcccaaggccgagaagcggctgccggcgggcaagacggcggccaaggagggcgaggcgaagacgaggggccggaagaagggcagcaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctcgcgcgctacaacaagaagcccaccatcacgtccagggagatccagacctccgtccgcctcgtcctccccggcgagctcgccaagcacgccgtctccgagggcaccaaggccgtcaccaagttcacctcctcctagactgagtctgatgatgcgtcgcctgtatttggtttctgcatctgtatctgtactgttgactctgcgtagctatccatctgcaagtagtgctggtagtccgcgtgctgggtgatcgccaatgcttcgttggcaaattacttggttgcaagaactgaagttgttgcattttcgcagactgatatctacctagaactgaagttgtggcggcactatatctgcatcggccgaggcctgaccgatgtttgcttatctact

SEQ ID NO: 62400 - DNA, 824 bp, Triticum aestivum
  unsure (1)..(824): unsure at all n locations
  Clone ID: PAT_TA_62400
attttctttatatactttacacactttaaagctcagttcatgcttgctgtaaccatcgaattgtgagctgaacttataaagaaccatttcttcacctatactttctttgtcaactttaatcatttggacccttctttccccgtctcgccaaaacacagactccaccggccattaaagatttcccaatctcctgtgcaacgacagataaacaaacggctgtttagtttgcagagacatcttttcagtttcggtccttacttacaaccacccggtttctggacacttgctacgtattttgtacacctcgccatacagtcactgagtcagaaatcgatcccctcgacgccatgaccgatctcgccgagcaacctgtgcatgagctgcaagtcgataatgagaaatctgttctgccgaatgaggacactatagctttagacaaaaccgaagaccccgttcagggcaatgatgctgatgctagtgctgatgctgaaccagagccaaagccaaaaacagaggcagaaccagaaggagaatcaaaacaagatgatgctccaggacagctagactcagttgtagctgaaaacaccacggacgaggaagaaactcaacaaaatgtccctattgatttcgtcaccctgagcatgtttattatcgacgacatcgactttattcccccaactgagcctgtcaaagacatccttggtggagctggcacctactcggctctaggagctcgtcttctctcccctcccaccaaatctacctctgttggctggattgntgaccagggctccgacttttcctcttctctctcacactcatcg

SEQ ID NO: 62401 - DNA, 656 bp, Triticum aestivum
  Clone ID: PAT_TA_62401
attccgctgccttcaccttagtaaacagatagacagagaggcagagatgagcactgaagattccaggttaggtcacgcagcctccgtcgcctcctcctgatgagatggatagtctgtcattcggcggatggactccaccgcccgaccgcctgctccggtcgtccacgacgtaggatatgaggaggaagaacaggccttcctccgcaccctcaactgcctggctgacacagagaacaaccccctgccccgaccgatgagacgcagacatggggagccccgtgacccctccgacaactgtcccccttccctggtgacatcctccgaagttccagcgcaaatgattatggaacagaaagtagtactcacacagccatccaggagccgctgatgccagtagagcttatactgagctactacacctcctcgacgttaagtaaaatcgagggtcagcgggctgaccaccaaccggagccgccactgcaaacggactatgtgtaccatatcttccggaagatgaaacagacgactcgtgatacccaacggcgccgacatgctggacgggctctgcaagaacggattggtgccgtagggcatgaatctgtttggtctgatgcgcgagaagggcgccatcccccaagtggtcatctacgccgctg

SEQ ID NO: 62402 - DNA, 485 bp, Triticum aestivum
  Clone ID: PAT_TA_62402
agcaacagcgcggcacctgattcacttctcttcctctttttctctcccagtactaaccctatccgctgcccgacacccgccgatgtggccggatgtcccgtgagaagtgactgcgtgctgatttgccactgcggcgccgagacgctgcacatcatctgcgccctgacaaatgaagactggctgccacagcttcgaccctgctgggtgaagaacgtggccatgagcgctgtccataaggaaagaacagcgctgaccaacaacgacatgccggatgccatgttgatccatcccattccctggacccgaacggacggcaccttcgtgtactttgttgactatgcgtgcagacatagggaacccatcagcagagatcaacggtctctgccatcactgcgatcggatcggcaactagtgccatcactctgtgtctccgcatcgcaactgatgataattccatcgaccggatctgataatatgatgaaggc

SEQ ID NO: 62403 - DNA, 837 bp, Triticum aestivum
  Clone ID: PAT_TA_62403
attcgatccactgagctagatttcattcgatccgttgagccagccatgacgaacgggtacctcttccgggagtacatcggcgcgcagttcaccggcgtccagttctccgacgtgcccgtcaacaccggcgtcagcttccacttcatcctcgccttcgccatcgactacctggcgagccagcagtccaagcccacgccgaccaacggcgtcttcaagccgttctgggacacgggcaacctcacgcccgccgccatggccgccgccaaggcggcccaccctaacctgagcatcatggtcagcctcggcggcgacaccgtccagaacaccggcgtcaacgccacatacgcgccgacctccgtcgactcgtgggtggccaacgccgtctcctccctctccgccatgatcaaccagtacgggctggacggcgtggacgtggactacgagcacttcggcaccgacgtcgacgcgttcgtggagggcatcggccgcctgctcacccagctcaaggcccgcttccccaacatccgcacctccgtcgcgccctacgacctcccagtcaaccagaagtactaccaggctctgtggaggaagtactccggcgtcatcgattatgttaacttccagttctacggctacggcgccaacaccatcgtccagtactacgtgcagttctacgacgagcaggcgcgcaactaccccggctccggcggcaccaagttgctcgccagcttcaagaccggcagggcaagctgccggggatcttcatcttttcggctgatagctctaagatgagcccctacagttttaagtatgagacccaggcgcagcagatcgtcg

SEQ ID NO: 62404 - DNA, 714 bp, Triticum aestivum
  Clone ID: PAT_TA_62404
acatcccaccgaagcgaaaggtaatcccaatccttacagaaatccccatcccaagaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgccgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttccct

SEQ ID NO: 62405 - DNA, 504 bp, Triticum aestivum
  Clone ID: PAT_TA_62405
atctctcccgttgtcgtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgctgccaacccatcatcaccaatgctctcatcctgaaac

SEQ ID NO: 62406 - DNA, 104 bp, Triticum aestivum
  Clone ID: PAT_TA_62406
cactccaaaaagcgagccagtccataccccgttgcccacacaggacgacgagcgcgccgaataccttggcgagctgcctcacggcttttgtcgccggatctgcc

SEQ ID NO: 62407 - DNA, 671 bp, Triticum aestivum
  Clone ID: PAT_TA_62407
aatccaaagctatgtgtgctctgctcacagttccggccaagcagcagcagacacgcgaaagcaaactcacaaggagcgaagaagaaacccagctaggagcgtctggtgcattggagcaggagaccaatggcgggcctcgggttcgaggagacggagctccggctcggcctgccaggcggcggcaacgaggccgaggaggcggccgccgcggtgaggagctccggcaagaggggctacgccgagaccatcgacctcgtgctgaagctggagcctgcgtcggcggccgcgccgccgtctggggacgacgaggaagtggccgacggtgtcgcttagtgtttccgccgtctccggctgctgtcgacgggcagttgaagcggtcgccgagccagagcagcgtggtcaccaccgcgcagccggacgcggaccccgagaagccgcgcgcgcccaaggcgcaggcggtggggtggccgccggtgcggtcgttccggaggaacatgctggcggcggcgctggtgaaggtgaccatggacggcgcgccctacctgcccaagtgcacatggccacctaccacagctaccaggacctgcacaacatgttcagctccttcaccatcggcacactcccactcaggggatgagtgccatgaccgagagcaacctggtggacctgct

SEQ ID NO: 62408 - DNA, 613 bp, Triticum aestivum
  unsure (1)..(613): unsure at all n locations
  Clone ID: PAT_TA_62408
ctcccncctcnnctttttttttttttttttttcctccccttnnnacgtccccgccgccctaaggannnanaagggggttcacaacagggaccgcaccacntctttttcctctctcccacacacttctatctcagcacacgataatacatggaagggcgcgtagcgcagtgtgcgtaacaaaaaccgccttgtctgacatcaacactaactatataccgcagtccctcctacacacatagaaaaagagagacaccatgctcccccgctggcctgctgactttcgccgcccagggtcttgcccagggcgttgacttatacccctgcctcacccccaggcaactggaaggaggtccagaccgctgagaccctcgagatcacctggcacaccaagcccaagcactccggcgacaatatctccatctctccgatgagtggtggtagccagaacagccaggtcccgatcaataccatcgccacccggggtgaaaaagacgcctgcttccacactcctgcaagaccaaccacttgccccggcaacaacaacgtcatactgtctcctccctcaatttcccacaaccacccccgaggtttctccagcactcctttccccctt

SEQ ID NO: 62409 - DNA, 581 bp, Triticum aestivum
  Clone ID: PAT_TA_62409
agatccccaaaacaccagcctcctcactcctttagtcgcagcatcctctcagtcctcaccttcctcccctcgccaccacccaccaaggaaaggaggatgtcttgctgcggcggcaactgcggatgcggagccggctgcaagtgcggcaacggatgcgggggatgcaagatgttccccgacgttgaggccaccgccggcgccgccgccatggccatgcccaccgcctcccacaaggggagctccggcggattctagactgtcggcggagataccggcggctgcgactgcaccacctgcaagtgcggaacggcctgcggctgctcctgctgtttctgctactgagccggcgcccaggagggcggacgactaggcgagcacgaagatgaggaggacaactggacaagtaaccaccaccaccaccaccaccatcactagtcgctgcatgagcccgcccgcgcgtgcgctgaataaaataaaaccgccgtgcgtttcttaactcatgtacctgtacgcccgtgtaattccaccagcagtgtacttgctcatgcctccaactctaatacatggcgcctccctctgat

SEQ ID NO: 62410 - DNA, 791 bp, Triticum aestivum
  Clone ID: PAT_TA_62410
ttacccaaaccgccaaatggcactggtcttgtcacagccgcttcctctccaagcctgatgaggtcggcgtcgttgctgtcggtttctcaggcggtcagcccaaagctggtgtcgacatcggccccgctgctctcatccagtccggtcttctcactgagatccgtgatgagctcggttacaagctcttcggtgacgagaccgtccagcagtttgaggatctgatccctgagtcagaccctgacttccgcggtatgaagaagccccgccatgcatctgcggtgactcgcaagatcgcttcgcacacctatgagcactcccgcgagggacgcatgactcttacccttggcggcgatcacagcatcgccattggtactattgccggaactgccaaggctacccgggagcgtctgaaccgcgagatcgctgttatctgggttgatgcgcacgccgacatcaacactcctgagagcagtgacagtggtaacattcatggcatgcctgttgctttcttgaccggtctggccaaggaggagaaggaggagtgctttggctggctcgaggatgatatgcgcctgaacgttaagaagctggtgtacatcggtcttcgatccgttgacattggcgagaagaagatcctccgtgagcacggcatcaaggctttcagcatgcacgatgttgaccgtcacggtattggccgcgtcgtcgagatggcccttgctcacatcggtaacgacactcccatccacctgtcctttgatgtcgatgccctcgaccccatgtgggctcccagc

SEQ ID NO: 62411 - DNA, 736 bp, Triticum aestivum
  Clone ID: PAT_TA_62411
acttccccgaagccaaaggaaatccactccaatccaatccccacagaaatccccatctcaaaaccctagcccgtccgatcccggcgagatggccaacccgagggtgttcttcgacatgaccgtcggcggcgcgccggccgggagcatcgtgatggagctgtacaaggacgcggagccgcggacggtggagaacttccgcgcgctctgcaccggcgagaagggcgtcggcaagagcgggaagccactgcactacaagggcagctcgttccaccgcgtgatccccgacttcatgtgccagggcggcgacttcaccaagggcaacggcaccggcgttgttttcatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggccgtcgagggcatgcacgtcgtcaagaacatccagaaggtgggctcccgcagcggcacctgctccaagaagtcgtcctccgcgactgcggccagctctagatccgtccgcccgccggtcgcctgtcgtcgtcgcccccgtgtccgtgatgccaaactaaataatagagccgtgagtcgtggcctgcctcccccttgccgcccaagacatcttccgtggtttgtttaagagggt

SEQ ID NO: 62412 - DNA, 422 bp, Triticum aestivum
  Clone ID: PAT_TA_62412
cttacccctcttccgccccgtcccgcgctccctgccccctaactactcctagagagtcctcccccgccggagaaacgtcccgccggccgcagcggaacgaaggtcgccggacacgaagaaggcggtgacccgcctcggtgaaggccggcactccagttgccacaatctgccgcatctggtcgctacctcgagaagggccgctacggcactgcgtgtcggcctccgcggcccccggatacctcgccgccgtccaccagaacgtcactgcaaaggccctgtagatcgccgccctcgcgaggaaggacgaaaaaaagacccccatcatcccgcggcaactgctgtttgtcgtccagcaccaccagtagttcagagagctgctcaccggcgtcaccatcaccaccggagacgtgatgaccaacctc

SEQ ID NO: 62413 - DNA, 560 bp, Triticum aestivum
  Clone ID: PAT_TA_62413
aatcacacaccagcctcctcactcctcacagtcatcctctcagtccttagcttccttccctcgccagcacccacagccaaggagcgatgtcttgctgcggcggcaactgcgggtgcggcgccggctgcaagtgcggaaacggctgcggcgggtgcaagatgttccccgacgtggaggccaccgccggcgcggccgccatggtcatgcccaccgcctcccacaaggggagctccggcggcttcgagatggccggcggtgagaccggcggctgcgactgcaccacctgcaagtgcggcaccgcgtgcgactgctcctgctgcagctgcaactgattcgttgcacaggaggccggccggcagaggcgagcaccacgatgaggaggagaagcaagcaatcatcatcaccaccaccaccacccagcgtatcagtaccactagccgccgcatgcgcctcgcgcgcgcgctaaataaaataaaaccgtcatgcgttccttagttctgcaagaccagagtccctcctcatgcctccacttctaatgaatacatggcgcctcacccttg

SEQ ID NO: 62414 - DNA, 692 bp, Triticum aestivum
  unsure (1)..(692): unsure at all n locations
  Clone ID: PAT_TA_62414
gcccgctcgagggccggccgggcccggaaaataaaaaaaaaaaacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctagatcgatcatcgaccatatgcatgcaccgtgccgtgcgtgcatcatcgatcatatcgatctactactaccataccatgtaaccgcaacctgatcgagggcctttatctatgcacctgacctgcatcagcagtcaggtgccatgccatgattgtaaacaggcccccctaaataaaatttcccctgattccntgaaanaagagctaccatcgagtcttaccgaagcattagaaaaaccctctactgctgataatgcataccaatcaatacatgagttctcaaagcccttgatcaacatgatgaaacctgcaggttgggatcttgatgctgctgctaacgcgattgaacctgatgta

SEQ ID NO: 62415 - DNA, 515 bp, Triticum aestivum
  Clone ID: PAT_TA_62415
ttgttccccgaccatcatcatccacgactattcatctcgcggcacccccctcatccatgataccctcgaccggcaggtatcaccctttcgtcggtcttcaccacctgataggatccccatattaggaagagaatcttgtagccgaatctaatccattcccatccccttgtgtcactgatgctggtccggggggatcctgggacgatcccgttgagaatttcggtcatgtgatgatacctcaagattttcgacgcgacgcatgaattgatcggttcggtgagaggggaagctcgcgcaaccagccctgatcccagaaatggatcccagggtgatgttgaatgagacaatgtggttttggcgttccaggttctgggggtttatggcacattggtatcacgggctaatctaatcaccaaacacaccgtgctttttctagctagcttcggaagtcattatgttactttttgggtcaggctttccagtagcgtagtaatcaataagatcaaagtactacg

SEQ ID NO: 62416 - DNA, 633 bp, Triticum aestivum
  Clone ID: PAT_TA_62416
ctaagcagagtggggaaaggcgtcttcgtactcgcctctctccgcgcaaccgagccttccgcccacctcctccccatttcgccagcggcgcacccaccaaccacccccacccgccgccatgagggagtgcatctcgatccacatcgaccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggcgcaactggctctggccttggttctcttctgctggagcgcctctctgttgactatggaaagaactccacgcttggcttcaccgtgta

SEQ ID NO: 62417 - DNA, 833 bp, Triticum aestivum
  Clone ID: PAT_TA_62417
tcgaggggccggccgggccggggaccaaaccaaaccaatccaatcccctctccgcgatctcaccgggaaattcctcgaccgattgaaagcaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcaggcttcgtggaggcatgcagattttcgtcaagaccctcaccggcaagaccatcaccttggaggtggagtcctcggacaccatcgacaacgtgaaggcaatgatccaggacaaggagggcatccctccggaccagcagcgcctcatcttcgctggcaagcagcttgaggatggccgcaccctggctgactacaacatccagaaggagtccaccctccacctggtgctcaggcttcgtggaggcatgcagatttttgtcaagacgctcaccggcaagaccatcaccctggaggtggagtcctcggacaccatcgacaatgtgaaggccaagatccaggataaggagggcattcccccggaccagcagcgtctcatcttcgctggcaagcagctggaggatggccgcaccctggcagactacaacatccagaaggagtctacccttcacctggtgctccgcctgcgtggtggccagtaagtgcgtgatagccgcttctgtctcagggt

SEQ ID NO: 62418 - DNA, 781 bp, Triticum aestivum
  Clone ID: PAT_TA_62418
acgcataaaggaagtcaagtttcctttcataacacattttgttagagttttgttcgccaagctcgtactttcgcctctccttctccgcccccgttggacccttttcggtcggcctgaaacatcaccactctctctttctctttctctctctcctgtcttcctttcgtctgagacaagcgacatcattctcaattaaacgactaaatcagaaacttccatatgcagcctccccccgacctcgaaattataccagtcgctgtcgatgatgcctctttgttaacatctgcttcttcaactgtcattatcgaaatggcttcctcagttattgctacggctacctccatgaccacctctacaaccgcgtcggctacatttgtctcgtctgcgccaccaacaccttatagcgaaaatggctccggcggagagtgctcattactgggctcctttgctcttgtcgtacaaggcgcactcggcgctctggcgttgctctctctcgtgtacaaacgatggagagaacgtcctcagcgacctctaaagatctggtttttcgatgtctccaagcaggtctttggttctgtgcttgtgcacatcgccaatatcttcatgtccatgttgacaagcggtcgcttttcggttcaggtcgacccgtcagcagcagccgttactgcgcgttctgatgacgactacgctcccaacccatgctctttctacctcctcaatctcgccatcgatactaccctcggtattcccatccttatcattcttctcaaggttctgactg

SEQ ID NO: 62419 - DNA, 695 bp, Triticum aestivum
  Clone ID: PAT_TA_62419
agatagctttcgacgcaatgaataacagaagacagcaacatcccgagcctatgactttatctcagagacttctccaagccggtccttccattatcctctcaatcgtctttgttgtcaacctgctcgaatacttcgctcaagatgaagctaagaactggacaactattaactttaacattcttgctgcatggcacctgttctggtttcgttatgcgggatactgaggaggtatctatatactaccccgacgcaacctttcagtacgagcttgaagatttcgaagtagcgaatggcacggacagctcgctgcaagaacgaactaatgtcaggatttgcgaatacgtgagtgtgcaacatctggcaaactgcgttactatcgttgccgggctacaagctattggtatcgcgcttggtaatgctgccaagtctttgagtaacagcaatagctgtgcaactgtcagcggcactgccggtaacggcaaagtcaagtacagatactacgctactggtcgtcactgcgataccacagcagaggcaagcaccattgctggtgcaattgagcaccatctcaagaatgtcagtgggggtaagctgtgccgaacagagtgtttggatctcacgcatggtggtacttggaacggttatcttctcgtcggtcccgccagcaagtttgaaagcgacatgtattgtggccc

SEQ ID NO: 62420 - DNA, 445 bp, Triticum aestivum
  Clone ID: PAT_TA_62420
gcagtcattaaatcgcggtggagtaagcaactctcctttacaccacacctgacctgaggatgatcgtcggcaattggatcttgataaagtcaaaacgtcagcaaatgtcctgcttcgaggaacgctcaaagaacaagactgagttgctggcgtttctggtggttgaagcaaaggagaaacacaagttttggtaagcaagaaataatgcgacggggatattgcttgcgcaaatacgagaagatctgttctggtctggtcccgtctggcttggctcggccttgatcaagtacgttttggagaagagagggggttaaccggtaggctgatggcggagatgagagaacgggtttcttccgtttgaacacaggatgcaaatacctaggctttgagaagacaaagataagaccgtcagctgttgcgttttctgtataacaattatattatg

SEQ ID NO: 62421 - DNA, 231 bp, Triticum aestivum
  Clone ID: PAT_TA_62421
atccaccctcctgctgctgctgctgtgttgccttgccaccccgaccgccgcctccaccatgtgctcctcaatcaagtctacacgcctcccgttctagcccgccgccgcaccatctcctccccggcaccaccgcactactccctccccgcgccgtgtcatcaacccctccccgtgttgccgcaccatcttctcccctgcaataacacaccaacatcactccccgtgccagtg

SEQ ID NO: 62422 - DNA, 834 bp, Triticum aestivum
  Clone ID: PAT_TA_62422
aacacagtggggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcctctcttgtttgaccccccccccgcactggcgcttaccgccagctcttccaccctgagcagcttatcagtggaaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgcgttcacagtgtacccatcaccccaggttctccacctctgttgttgagccatacaacagtgtcctgtccacccccctcctccttgagcacactgatgtgtctatccttcttgacaatgaggccatctatgacatctgccgccgctcccttgaaatggagcgcccacatacaccaacctcaacaggctttgattctcaggccatttcatcgctgac

SEQ ID NO: 62423 - DNA, 585 bp, Triticum aestivum
  Clone ID: PAT_TA_62423
acttcagcaacgagcctcctcactcctcactttcccagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgtttttgagccggcgcccaggaggccggccggcgaggcgagcacgaggatgaggaggacaactggacaagcaaccaccaccaccaccaccaccatcactagccgctgcatgcgcccgcccgcgcgcgcgctgaataaaataaaaccgtcgtgtgttccttaactctgtacctgtacgcccgtgttttccaccagcagtgtccttgctcatgcctccaactctaatacatggcggcctcctcctacgttgatgac

SEQ ID NO: 62424 - DNA, 712 bp, Triticum aestivum
  unsure (1)..(712): unsure at all n locations
  Clone ID: PAT_TA_62424
ctcgggggtccttctnttnttctttnttattaatatccggccggctcgnagccggccgggccgggtgacagttttgaagtaatagcagccaagccattccccaccaccctctccctcctcttcctgtcgcactgcactgcactgcacataatagtctccaaagacataacagatcgaggaggagccggagccatgccggagtcggacaacgactccggcgggccgagcaacaccggcggggagggggagctgtcgtcgccgcgggagcaggaccgcttcctgcccatcgccaacgtcagccgcatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagacccatcaacggcgacgacctcctctgggccatgaccaccctcggcttcgaggactacgtcgaccccctcaagcactacctccacaagttccgcgagatcgagggcgagagggccgccgccacgtccacatcaaccacgccgcacctacccgacaataatgccaccggttacgccgactacggcggcgccgatgtccccgcccccggccccgggaggcatgaagatgatgggccaccccatctaccgctccacgcctccgcagcaccctccaac

SEQ ID NO: 62425 - DNA, 734 bp, Triticum aestivum
  Clone ID: PAT_TA_62425
tagttccaagttgataagtacgtaccatgttgaagctaaggctagctacgtacaaaataaataggaaaaaccgtatattaaaaagttatattcatctgcagtggctacattacttgaggtctgcagcgactgaggcagaatggcaacggaatcaatatgtgccaacagttgaggaatacatgatagaagcggttaactcattcgcagaggggcccattatgctaacatcactatattttgtccaacaaaactcgaggagtacataatcaaagacccggagtacgatgagttgcttagaataaaggggaactgtggccgtctcctgaatgatactcggggcttcaaggtattttccgttcctgttctaacaaaatattcatagcaatgagttatcactgtcaggcagattaatcttgacactgggtagtttctaatatgataaatgatctacatgttgcagagggagtcaagtgagggaaaactgaacatcatctcactgcttgttcttcagagtggaggttccatgtccatagaaggtgctcaagagactgtacaggagtctatagcctcatgtcggagagacctgctaaggatggttgttagagaagaccgtgtagttcctagggcatgcaaggaggtgttctggaggttttgcaggacagttcacttgttctactgtcacaccgacggattttcctcgcccaaagaatgctctgcacgatgaatgcaatatt

SEQ ID NO: 62426 - DNA, 750 bp, Triticum aestivum
  unsure (1)..(750): unsure at all n locations
  Clone ID: PAT_TA_62426
aagagtacaaactacgtnttctattcggacacttgtctctaatcctagtaacgtgagtcttggcttttaagatgcagcgctctggctcgtttgagcgacgcagctctgttaaccagagaccatcgccaagcccatcaccaatccccatgccatcctccagaacccgaacaccctcaccttctcgaggccgacctcaatcgttccgaggaagtaacaagccctcttcttcttcaagaccaatctcacgctcgagatctcgaggaaggtcttcctcacgatcaagttcaccttcgccttctcgtcgcaagaagcgcagtgacgaccatgactacttcggtcntttcaaaaccactgctggtctcttggcggggattggcgttgcgaccgtcatagcccacaaggtctggccaaagggcgttctgcatggcgatcacgaagattgggagcatcccccacccaagcatagccgtaaacaacatcggcatcgctcgcctggcaatagtgagcgtgtgtacgagcgcactaccagacggcatggcgacgttgtgcatcacgaagagatcagtcgtagacggccccagaactacgagaggatgccgcaggaacacgtgagggtgcggcatcatgttgaacggctgccacatactcctgatgattactatgcccaggaacaggcttttctatcctactgagcgtacaagaactgtcgttcaacccgctccttatcctcctgagtggggacatacccca

SEQ ID NO: 62427 - DNA, 816 bp, Triticum aestivum
  unsure (1)..(816): unsure at all n locations
  Clone ID: PAT_TA_62427
aacgcacctaatcccccattctatagaataccatgcccgcacccacgcctacaataccaagcgcagcacgagcaatttgtcctgtggcacgcgcagctgccaccccagtgcttgaccttgtgttgaaccatggtgtagtggctgcgttgttctctgcttgatcaactggtgtaggtgctggcgtgtttgtcacagggcaatccgaggtacaagggatggccgaatggaagacgtcgtcaaccccagcagacttgaagacaggcttctgagcccacagagtagggttgggcacagcgtcagcatcctttggattgttgacattcgaaataatgtgcagtatgccattagatatgaggatgtcggttgttatgatcttggccgagttgatgaacttctcgttaccaacctgacggatctccttgggagacaaagaatttagtgcgtttccgacgctctccatggcctggtctctcggagcaaagacagtgatgtctttgcgatcagcgagatcgggcatcaggccggctttaaagagcccgccaaggaacgactcaactttgcttgccataaggacttggagcataccagacggtgggaccaggagactgtccacaatctgaatgaggccgccttgaaactcgatgtcgtagttgatgactgtagcgcggtttccatatctcgtgctaaaaacgacatcgtcnggctgcttgttgatgagaatgttctggccagcagtaacattgctccatttagggtccataaggagtgtgggcttgacgtaagcagggcctgccttgagcctcattgcacttatcg

SEQ ID NO: 62428 - DNA, 380 bp, Triticum aestivum
  Clone ID: PAT_TA_62428
tattcaccaagtacgccaaggtcaagccgaacgccctgaacgaggacgagctggatgcgatgcgcactgccaacaggaaggagggtgacttcaaaggatgggcggcgtcgaaggcggagtggggcatgctctacagcctcgccaaggacaaggacggcttccttcagaaggacaccgtgcgcaccgtctacgacggtagcctcttcgctaagctggcgaagaaggctggaaattaaccgagcgtgatttgcattcgtacttcttttcgagatgaaatttgtaccccgtgttattggagtcttgtttgttgagcatgagctgtccctgtacaattaaaattgaaatctgttagtgcaaatataatttactgttccatttgg

SEQ ID NO: 62429 - DNA, 702 bp, Triticum aestivum
  Clone ID: PAT_TA_62429
agctaatttgtttccgatacctttctcctcaacgagagtcacgcctctttgtccatctcctagcgcttgccatcgacggtggcggcggtccagatctggcgcaaacctccgggactacgtccactgcaggggctacctgcctcctccaggtcgaccggctccaccacccaggcgtccccggcgtcgtgctccacatcgtcgagtgggatccggccgtcgccaccgccacggtctccacctctccaggggcagcgggcgcccctccccactcccccgacgggtccgtgaccgggctgaacacccacggcacgcgcgtgaagacgcagcccgacggccgcacgccaaagctcttcttcgtcgtctcggtcggtagattgaaccgatgaaccttatatagagtccatggaggtcctggtctctcccaacacatgaagctagatgagcaagaaggataacgactgccaaaggctagagcttttctatcatgtaccatcaagatgcttgttggctatcagtccttaatactaagtcttgcggacatgtactaaagatgatcctctcatgttataaggatgcatcatttgatacctgtgttcctcatgtgttctgttccgtctgggatggcttaattttctcatgtactcaagtacttccagtttgacatgtgtgtagttctgcttgaagagatgttttaatttccgc

SEQ ID NO: 62430 - DNA, 587 bp, Triticum aestivum
  Clone ID: PAT_TA_62430
cggccgctcgagccggcgggcgggttcattcattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactccc

SEQ ID NO: 62431 - DNA, 595 bp, Triticum aestivum
  Clone ID: PAT_TA_62431
ctcaccaagaagacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaac

SEQ ID NO: 62432 - DNA, 586 bp, Triticum aestivum
  Clone ID: PAT_TA_62432
cggccgctcgaggcggcaggccgggttcattcattgtgctcatcatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcccctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacc

SEQ ID NO: 62433 - DNA, 774 bp, Triticum aestivum
  Clone ID: PAT_TA_62433
gggcgcaagtgaaataccactacttttaacagagtcttccgtccgtcgcctccaacaaatcccatcccaaaacctcctcctcgccctccaatggcggccgcgacctcctccttcgccacgctcgccatcgcccgcccggcggcggcggggtcggcggcgcagagggcgctcctcgcctcgaaggccccctcgtcggcgctctccctccgcggcggccgcgtcgcgtccccggccctctccgcctcccggcagagccgcgcgcgcttcgtcgcctccgccagcgccgaaccctatgcacctgagcttcagtccaaagttacaaacaaggtctactttgacataagcattggcaaccctgtcgggaagaacgttgggaggattgtcatcgggctgtatggggatgacgttccccaaaccgttaagaacttccgtgctctctgcactggggagaaagggttcggatacaagggatcaagtttccaccgtgtcattaaggacttcatgattcagggaggagactttgacaagggcaacggtactggagggaaaagcatatacggccgcacctttaaggatgagaacttccaattggttcatactggacctggagtgctcagcatggctaatgctggaccgaacaccaacgggagccaattcttcatctgcacggtcaagacaccgtggctggacgggggacacgttgtctttggccaggttcttgaaggcatggatatcgtaaagatgatagagtcgtctgagactgacagaggtgac

SEQ ID NO: 62434 - DNA, 269 bp, Triticum aestivum
  Clone ID: PAT_TA_62434
acgctccgatggcagccacggcggtgaccctgcccaactccgcgccgtcgcccttccccgtcgccgccccctccgctcggcgctgcctccagctccgccgctcgccggccccccgccgcgccgaccgcgtcgccgcctccgccgcgcggaccgaggtgccgacaaagccgacgccggtcaccccctccggcatcatcctcgctcgaccccgccgtagaccataaggagcacctcctcgggaccggctatgacaccaaggtcatccccgt

SEQ ID NO: 62435 - DNA, 673 bp, Triticum aestivum
  Clone ID: PAT_TA_62435
gcctcccactgcttgcctcagctcacccgaagcaaagccagctagcacgcagcgcgcgatggcggccgcgaccatggcgctctcctccccggcgatggccggcaccccggtgagggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccttctacccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggttaccgcgtcgccggcggcccgctgggcgagatcgtggacccgctctaccccggcggcagcttcgacctcctgagcctcgccgaaggaccccgaggcc

SEQ ID NO: 62436 - DNA, 258 bp, Triticum aestivum
  Clone ID: PAT_TA_62436
aagggggcgcaccgaggcgactttacgccagggggccggggcgcacctgttgtacgcgctgcccggcggggcaggacctctcgcggatcgccggggggcgcttcgaggccgccaccactgcgccgtctacgccgctaacgccttcctcggcccggagctcgacgccttcgccgagtgactcgcgtacttcctccccgcccccggcgccgccgcgagggacctcgccatgtccgacgtccacaaccccatgctaacacc

SEQ ID NO: 62437 - DNA, 849 bp, Triticum aestivum
  Clone ID: PAT_TA_62437
gtgtaaccttctccctcattcatctatctgcacctgcatttgcatttgcattcgtgaaccttcaactacgtgcactgtcactaatcacaagacgcgtaaaggcgtctgttgaccctggcaccagggccctgctctcttttatctggattgcagttcatctcgcgagtacctaattacagtttataagacacgcctacatacatcaactctctacataaacaacaaggcataatggcgagtgctacgggtgttccggagcggttcccttccatcgaggatagagagacagagccccttcttggccggcccggcgatgccgcgcaagaagatggtgtacctatgatcaaaaacctggttcttggaaccggcatagtcgcccagctgggtattgtactactcacgatcttggtctgggccagcgtcctatccaagccgttgatccttttctcagcgcatccgctacttcagtcactggctgtactcaccttggcgcagtctgttctaagtttacaacctacgcatacagctgagcagaagcgcgtcggtcagcgtgtgcatgccatcctcaacctcgtggccttcttgatcctcgtagctggcgtgactatcatcgaatacaacaagtttgccaataacggtgctcacttccactctgtccacggatatctcggcgtcatcacctccatcgtgcttcttcttcagtatggcgttggcttcaccatgtgggctactcccagtttgtacggaggcgtcgacaacgccaaggctgtgtggaagtaccacgctggagcggataacagtctttgtcctcctcctggctacagtcactagcgccgttgagaccgacta

SEQ ID NO: 62438 - DNA, 282 bp, Triticum aestivum
  unsure (1)..(282): unsure at all n locations
  Clone ID: PAT_TA_62438
naaacacaaccagagacagagacgacgacctcgcatcatacgtcgcctcgatcatctcaacattccaacccttattagggtcatcttctcaagtgcgtaccactactactcgaatcgatagccattcatccatcggccgtctgctaccaagagctctgcgcttgttgacgcggctgatccgcgaatgtgagctgtgtccgccaacgacgatcaaccgccactctacacacatcgaccgcacacggctcgggtcaatcgggaccgtccaggacaaacgtacac

SEQ ID NO: 62439 - DNA, 848 bp, Triticum aestivum
  unsure (1)..(848): unsure at all n locations
  Clone ID: PAT_TA_62439
tggatttctaaaaaaagagccggagcaacccagcgcgcgctgcggcgagatggcggcgtcgcaggagtacatggacaaggcgctgctccggcggagctaccgcaacgtctggcagaccgacctcacctgcgccatccaggcggatttcccatactgctgtctgtcgctgtggtgcggcccatgcgtctcttacatgctccgcaggcgtgctctctacaacgacatgtcgagatacgtgtgctgcgccgggtacatgccatgcagcggcaggtgcggcgagagcaaatgcccagaactatgcctcgcaacagaggcgttcctctgcttcggcagctcggttgcttcgaccaggttcctgctgcaggacgagttcaacatccagacgacccagtgcgacaactgcatcatcagcttcatgttctgcctccagcagctggcctgcatctgctccctggtcgcctgcatcgtcggcaaccaggaactctccgaggcttcgcaggcgatctcctgcgtctccgacgcggtctactggacggtttgctcctgtatgcagacgcagcacaaggtggagatggacaagagggatggcaagctgggcggggctgcgatgacggtccctccgacgcagcagatgtcacgcatcgatcagccgatgccgcctcaggtcgggtatgcgccgcagccagcgtcctacaggtagttctgtggggtcttgggctgccgttgcgagtgggaaatggatggagatcaagtagctgatattatgttcctccctgtttagtangcgaattttgaggcttggggtcagcttagaactgtcatattttttgcatcccaatatccagcaa

SEQ ID NO: 62440 - DNA, 432 bp, Triticum aestivum
  Clone ID: PAT_TA_62440
atcgaaaagtgaatgaactactttcccctcgtctcgtctctcgctctcacctaaccctctcgttcttcctcatcccgatccccttctcctctcttcccaaatcctctagatcggggcgtgacagggtcaaaccccatcggcgtatggccacgggcgcgaggagcaccgcggtgggcgcatccggcggcgcagcggccgcgtccagaggcatggtgacctccacgcgcgcccctcccagcgccatggtggccgcgtccatccttgcggatgacgatgaggcgaaggaaaaagaagacgaggctcatctcaccggcggggagacctcctttccttctcactttctctgttctcttttcttctcctggtagaacaattgatgtgtgcatgtataaaatcggaaagagaacaccattttttcttgcggcataactc

SEQ ID NO: 62441 - DNA, 216 bp, Triticum aestivum
  unsure (1)..(216): unsure at all n locations
  Clone ID: PAT_TA_62441
ccttctccctctcatcccatgccttcntgtgcggcgaaccggcgatgagatcgtcaccaatgtagtaaggagtggcgagtatgctggtcaacgctcctaccagcgcatccgccatgcattccggcattgccgccccttcgagttccacagggcatccctgcgcaggatgagtgccgcccacatcgttcgtgctcaccaatacacctacggctacac

SEQ ID NO: 62442 - DNA, 206 bp, Triticum aestivum
  Clone ID: PAT_TA_62442
acgggagccaagcaagacccgagcaaggcacactctccagcaacagcaggccggcggcaagtagcgtaagcacaacaaccaaatggacaacatcagcgccgccgcggcgcacaccgtcgtcgcccgcgccgccatcgccaggccgcagcgccccacgtctgcaccagctgatgactaggagcgagaggctgaggcgcatctactcc

SEQ ID NO: 62443 - DNA, 727 bp, Triticum aestivum
  Clone ID: PAT_TA_62443
acagcaccaacgaccaccagcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagatcgtggacccgctctaccccggcggcagcttcgaccccctgggcctcgccgaggaccccgaggccttcgcggagctcaaggtgaaggagatcaagaac

SEQ ID NO: 62444 - DNA, 679 bp, Triticum aestivum
  Clone ID: PAT_TA_62444
aaataactcctccactcgaagatatcgtgacgtgccgtctccatggaggcggctaccctgacgataagctcccggcgcctggcctccgccgccgcgcctgctgggagtggcgcccgccgtggcgcagcggcagcaaccgcgcagcgtccaggagcaatgcttccgcggcgtgcgcggcggctccgtgcgctgccgccggagctgagcgagatcctcgcgcccaagctggtgcccggctcgcccgccgacaccggcgacgtctcctcgctcatcccgatcagtgccgtcatgctgctcttctacttcgtgtccaactgggtgttcccggcggtggtcatgagggggatgcagcccaccgccgaggacgaagccgccgctgcagaagcagaatccatggcgtcgtcgtcgcagccgcagcggggggatgccgtggacggtaagatccggcgcaaggtcaagaggaagaagagcagaaaagccgccacggaagcgtaactcgaatatgcatgtcgttagaaaggccttgcccagaaattccacaatagactcctcttgttgctctgatggcataatatcaaaaagatcaggacagcagagtttttttgacctcctagagaagaacagactgataatcaccgaattactctgcgatcagaaatatcggcgcttatttttttgc

SEQ ID NO: 62445 - DNA, 537 bp, Triticum aestivum
  unsure (1)..(537): unsure at all n locations
  Clone ID: PAT_TA_62445
cccctcccnnnccggccccccctcctccctcccggccgctcgtggtcggtcgggcctgggaggtacgctggaaccttcaggaaaacactagcgaaccttcaggcacatcgtcgcgtcaacccgagagaggcagagatgaggggtagcgggcgggcgcggcagaacgcgatccggtcgggcatcgtggtgctgggcgccgcggccttcgcctacctctcctaccgcgtcggattcaagccctacctcgaccgcgcccaggaggccatggactaccaaatccacagctccgaccacgccgcagccgcagccgccgccgcctcctgggaggaccagcccggtcacccggagggcgacggcggcctcgcgccgtccagggacccggccaccgtgctccgcgactgactcgccccgccgtcagggggcttccgcggcagcttggctcgttgtggcatttcgccgaacgctttgtaagcggataataaaggcactggaactgaactgttttggcactggaataaaaaaaacaaacaaaaaggt

SEQ ID NO: 62446 - DNA, 418 bp, Triticum aestivum
  Clone ID: PAT_TA_62446
ggccgggccgggactacgcgaacaagtactctctctccctatcgacggcgggccgcgtgctccttccctcctcgccgccggtcgtttagcttagcagcgcaccacggcgtgcagtggagcaaggagtttggaccatggcgccgtcgacgaaccacggcaacgcggggaggcgcaggtcctccgtgtgggacggcttccaccgcgtcagcgtctcgggcgccgccggaccgtgcgccatggcgacgtgcaacaggtgcggcaccaccctccatgccagcacaaagaagcacgggacctcgcacctacgccggcacgccaacagcagctgctgcgcgaagcgggccgttcgttcgagacgccaagtggttggatgaccttctgatcgagcttgaattccacctctccggtcgcctcatca

SEQ ID NO: 62447 - DNA, 361 bp, Triticum aestivum
  Clone ID: PAT_TA_62447
aatcttcttcttcgagtaagcttgtagccagccacgccagccatggcggagggggaacggagtgatgttgagcaaagctgcggcgctcgcgctgctgcactgccatgatagcgaagacactgacgcgcaagaccatcacccttgaggtggagtcatctgacaccatcgacaatgtcacggccaagatccaggacaaggagggcattccccctgaccaggagcgtctcatctttgctggcaagcaactggaggatgagcgaaccctcgctgactacaacatccagaaggcagccaccctacaccttgtcccgcgtatgcgaggagacatgtttatttttttgaacaccctcaccgggaagac

SEQ ID NO: 62448 - DNA, 589 bp, Triticum aestivum
  Clone ID: PAT_TA_62448
atcccacaacctccgccttcaccccaccctgacccaaaaaaaaaaaaaaaaaaaaaaaaaaagaaaaaaaaaaaaaaaaaaaaaaaaaaaaaaaaaaaaaaagccccctttgggaccttcaaaaacccccccattttccacaaggcccctcccccgggccactaaaaacagcagccctgggttccgaaaagggaaacaaccccctgggggagctgaaaattcaaaaactcggtttgaaaatttcccgcggaaaggctgggggaaaaccccccccgggggctaagggttcggaaaaactttccggaaaaaacccccgctaaaggaagggttgttttctcggccgaacttttgggattccaaggaaagaaaaaattgggggccccctcccccgccgagggcccaagggtgggggaatttcccaggggggcccccagggcaagggataacaacccccgaaggggcactttccccaaaatgggaacttccgcttcgggatccgcgggcccctcgattccgggattaagaaccacccccccattgggatccacgggcagggattccaacggtggatggccccacctgggggagg

SEQ ID NO: 62449 - DNA, 823 bp, Triticum aestivum
  Clone ID: PAT_TA_62449
atttcctcgctctggcctgtttggctttgccgaactaagcctttctccctacttcccatcagtagagtactggcatgggattcgcgatgccctcactgcgcaaggcgctaccgttctgactcccgccgtccctccgtcatcttcaattgccgatcgcgccgctgccctccgttccgcccttgaagcgcacgctccggcgcctgaggctgtaaccatcgttgcacacagcatgggcggtcttgacgcccgatacatgctgtcgcatcttgagcctctccccgtccgcgtcgcagcactcgtcaccgttgccaccccgcaccgaggcagcgcctttgcggactatcttcttgacgaggaggtctcgccggtacaccattacttgccccagctgtacaagacgcttgagagagcgggtttgggcacagcggccttttcgcaattgacgagacggtacatggcggaggagttcaatccgagcacgccggaccaacccgacgtacggtacttttcctacggagcggcagtggagcgaccggcgctgttgagtccattccggcaccacacgccgtcatgacgcaagcggagggacccaacgacgggcttgtgagcgtggagagtagttcctggggtacatacaaaggcacactgctcggtgtgagccacttggatcttatcaactggtccaatcgtgtagggtggacggttcgggagtgaatggggatcaaaaagaattttcacgcgatcgcattttacctggacatagcagacatgttagccaaggagggtttttgatatgcgcctgcctgcgaatggggttaattat

SEQ ID NO: 62450 - DNA, 614 bp, Triticum aestivum
  Clone ID: PAT_TA_62450
gttcctccatcctcctgcccgccgccacctacctgccttctatctctcgggatccatcccgccgccacctggtctgcccttggttccaatgccgaccaatccccaccggattccttcgatccaaccatgcaccgatccatccaaccaccacagcaagcttcttccccgagttccccgctcccatgtgtgtccagcaccaaggagaggagctcctccagcccccgatccaacgcgcaggcgctcgagcgcctcctcatctcgtccccgcgccgctcgtcgccagaagccagcaggtcgccacacctctcctctgtctactccttcctctcgatctctctcttacccgactcccctccctctctgttttcttataggaggagccccgcctccgctcgagggcctcgcacgaccttgcacacctccaccggccggcgacctcacctgaacctcgtcggcgagcagcccgccaggatagtccagtccgctcgtcctagcctcctctatgccccacccgcgcccgagcttccccagccgtgcgcctcctccctcttccagcggagtcccttcctccccgtgtaagcaaaatttctttaagtgcggaagatttgcaatac

SEQ ID NO: 62451 - DNA, 563 bp, Triticum aestivum
  Clone ID: PAT_TA_62451
atattcaggatcgacgacgcagagaaagcagcacgaagcaactagaagatcataagcattttaagtctcttcatgtccaaaactccaacgcgatcgaagatgccttgatacaagaggaaactgcagggtagctgcaccgacggcaagcgggggaacggcctgccgatgctgaaacgtgcacccatacgacgacgacttcgtcgtcatcctcctcgtctccgtcatcgtcatccactagggaatctgcggatggatggaaaaggaagcggagaacaggcgtatgcaactgaaccgagagacgagagacaacaccgagctgcctttgctgctgctgcatctgttagatccatcatccatctatatgcatgacccgtgccaagggggcatattagatgatataccatcgaatactatcataacatgtgatcgtgagcggactcatagtattcaacgatggacctgagctgtaacgatagcataggtgccatagcttgattgaaaacacgacgccccgaaataatagttctcactcgtgatatttattcaaaagaagaaaagaggtg

SEQ ID NO: 62452 - DNA, 816 bp, Triticum aestivum
  Clone ID: PAT_TA_62452
atttcccaagtcaccaacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggcggcagcttcgaccccctgggcctcgccgaggaccccgaggcgttcgcggagctcaaggtgaaggagatcaagaacggccgcctcgccatgttctccatgttcggcttcttcgtgcaggccatcgtcaccgggcaggggccgctcgagaaactctgccgacacctcgccgaccccgtc

SEQ ID NO: 62453 - DNA, 670 bp, Triticum aestivum
  Clone ID: PAT_TA_62453
ctttccaacacttgcagcaatagttgcaagtctagccaccatatctgctacgtactcgattataaagcaggctcttgcgctgggctgttttccccgtgtcagtgttgtgcacacctcaaaaaaattccttgggcagatttacatccctgacatcaattgggtacttatgattctttgcattgctgtgactgctggatttaagaaccaaatccagatcggaaatgcatacggcacagcagttgtgatagttatgctggtaacgacgttcctcatggtcccaataatgctgctagtatggaagagccactggatccttgttgtcacctttctcgtgctctcgttgatggtggagttcccatacttcatagcctgcatcaataaggtggatgaaggtggttgggtgccacttgctgttgcaatcaccttctttatcatcatgtacgtgtggcatttctgcaccgtgaagcggtacgagtttgagatgcacagcaaggtttccatggcctggattctagggcttgggccgagcctcggtcttgttagggttcctgggatcggctttgtgtacaccgagttggcaagtggtgttccacatatcttctcccatttcatcaccaacctccctgccatccacttcgtggttgactttgagtgtgaaaagtaaccttcc

SEQ ID NO: 62454 - DNA, 596 bp, Triticum aestivum
  Clone ID: PAT_TA_62454
ggtccaagagaagagaaagagagctccacactcgcgacgtgagtggaacgtgccacgcccacgcggtcgtcggctggagacgccccactgattacgcgagccccgacccaccccaccagcacagcgccctcgccgcccgccgctcacctgccccgcgcccctccggccgtataaatacaaggcgcccgtggcggagatgggtaccgctttttcctcctcctcttccaccccagagtccagagctatggcgctcgccaaggccaaggagatcgtcgcctccgcttccgtcgtcgtcttcagcaagtcttactgccctttctgtgttcaagtgaagaagttgctcacgcagcttggagcaagtttcaaggccgttgagatggacactgaaagcgatggaactgagattcagtcagctcttgctgaatggactgggcagaggactgttcccaatgtcttcatcaatggaaaacacatcggtggctgtgacgatactattgcactgaacaagggagggaagatggttgctctgctgacagaggatgaagcgatctccggatcttcttctaagaccaacgaaactgattaaatatgattgc

SEQ ID NO: 62455 - DNA, 551 bp, Triticum aestivum
  unsure (1)..(551): unsure at all n locations
  Clone ID: PAT_TA_62455
accttcggtttcatcggtttcttcatcaagctcttccgcccgagcgaggccaacttcctctttgacggcgcatctctcatcctctaccttatcggcttcggtgtctacgttgccaacattgtcaaggctcttcgaagcgtcagcgccgagatctggaccaacgatggcttcgacggcaagacccacgagggtgagagcggcgagcttattcttggtcgcgaggacagcttgaaggttctttccgccagcaacactattctcgctcttgttcttgtcggcattcttgttctccaagctggcgagtggtacgctgagaagaaggaggccgacgatgttcgtgctatggaggccaaggaggctgctgaaaagaaggagggttccccttccaaggcttccaacaagaagaagcagtaaatgcttctccnaagttgcgatgcaaagccagattgggtagtatggagccgggtcggcgcttagacgacttccttatacttggcatgcataagtccctgtatacctagcagcttataggttattaatcgatatcctgc

SEQ ID NO: 62456 - DNA, 627 bp, Triticum aestivum
  Clone ID: PAT_TA_62456
gggccgggattcaagagaggctgctcgcgcctcctcctgaccctcactcgctcgctcactccccgccgcacgtccagctcgagccagccgaggacctctcgccgcggcaacaatgacgtccctctcctcgtccgcggccgcggcgcgcgccaccttcctcccttcctcctgccgcgcgcggccggcgggcggcaggaggtcgcagctcctcgtgacccgcgcggcagcgtccagccccaagctccccggcgggcggaagctgcgggcggcggacgtgggagggggccccgcgggcggcgcggccgcggaggcgctggccaagggcggcgtcgagacttttctcatcgagcgcacgatggacaactgcaagccgtgcggcggggccatcccgctctgcatggtgtccgagttcgacctgccgctggacctcgtcgacaggagggtcaccaagatgaagatgatttcgacctccaacgtcgccgtcgacatcgggcgcacgctcgcgccgcacgagtacattggcatggtcaggcgcgaggtgctcgacgacttcctccgtaaccgagcgcagaatgccggcgccgaggacctccatggcctctatctaaggcatgaagcgcccaagga

SEQ ID NO: 62457 - DNA, 811 bp, Triticum aestivum
  Clone ID: PAT_TA_62457
aatcccccccaatctcgtctccgatcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtggcatgcagatcttcgtgaagaccctcaccggcaagaccatcactctggaggttgatagctccgacaccattgacaacgtcaaggctaagatccaggacaaggagggcattcccccggaccagcagcgccttatcttcgcaggcaagcagctggaggatggtcgcacccttgccgactacaacatccagaaggagtccacccttcacctggtgctccgcctccgtggtggtatgcagattttcgtgaagaccctcaccggcaagactatcacccttgaggttgagagctctgacaccatcgacaacgtcaaggccaagatccaggacaaggagggcattcccccggaccagagcgcctcatcttcgccggcaagcagctggaggatggccgcacccttgcggactacaacatccagaaggaggccaccctccacctggtgctccgccttcgcggtggtcaacaattgccctggggttggacctgctggtttatccttggacgcccgaaccctgccgtca

SEQ ID NO: 62458 - DNA, 791 bp, Triticum aestivum
  Clone ID: PAT_TA_62458
acatcaaactggaaccttctctcatcattttaaatcatcgcgtcgttgactcttgtgcatgatggcggagaccgaggcagcgtctgcggccgcggcggcggaggcgggtccggcggaggaggggacgaccaacaagacggtggtgctggtcggcgtggacgacagcgaccacagctaccgcgcgctcgagtgggccgtgcgttacgtggcggagacggccggcgccggggcgccggtggagctcgtcgtcgtccacgccaagccggccgtgtcctccgtcgtcaccctcggcggccccgccgctgcagggacgtggtcaggtacgtggacgcggacctgcgcaggagggccgaggaggtcgtcgacagggctcgccgcctctgcgccgccaactcggtgcagggtgtggtagaggtgatcgacggggagcccaggttcgtgctctgcaacgccgtggagaagcaccacgccgacctgctcgtcgtcggcagccatggctacggcgccatcaagagggcgtttcttgggagcgtgagcgactactgcgcccaccacgcgcactgctcggtgatgatagtcaagcagcccaaacccaaggaatgatcgatcgccatttccagctccagtgttgacattgtgccatttgcgcccaggcgccgcactgtatccctgtctaattactgtactctatttgttggatcctccgaatgtttgtacatcggtgcctgacatgatgctttgggttcatcttctgctgtcatcgccgattgctgaacttgattacaacaatt

SEQ ID NO: 62459 - DNA, 539 bp, Triticum aestivum
  Clone ID: PAT_TA_62459
tgtatccacaaatcccaaatcaccaaccaaatcccctcccctcctctcccgcggcacgacgagcaccagccaccggacatggacgcctcagccaccggagccggagcgaaggcgaagaagggcgcggccgggcgcaaggccggcggccccaggaagaagtcggtgacgaggtccgtcaaggccgggctccagttccctgtcggccgcatcgggcgctacctcaagaagggccggtacgccaagcgcgtcggcacgggcgcccccgtctacctcgccgccgtcctcgagtacctcgccgcggagctgctggagctcgccgggaacgccgccaaggacaacaagaagtcccgcatcgtgcccaggaacctgctgctcgccgtgaggaatgaccaggagctcgggaggctgctggccggcgtgaccatcgcgcacggcggcgtgctgcccaacatcaacccggtgccgctgcccaagaggacggcggagaaggagccccaggagggctagtccccccaacaagaccgccaagtcccccaaga

SEQ ID NO: 62460 - DNA, 147 bp, Triticum aestivum
  unsure (1)..(147): unsure at all n locations
  Clone ID: PAT_TA_62460
aagggacctcaagntggncatagtgagagaacttagctattaacaattcaccgtgcatcaggggtttcggcagagataaaggctattctggtatggatttattatcggcttctagagtgtcgggtgctccaatataatcatgtgaat

SEQ ID NO: 62461 - DNA, 177 bp, Triticum aestivum
  Clone ID: PAT_TA_62461
gtttctccgttctagacccctccttctcccctccccaaaccagaccaagcaagagcaaccatgggctccgaattggcgtgggtcagcaccctaccccgacggccaagctcgcgtggcttcgacgcacaacgcaccacgatgcagtcaggtactccattccactccgttcgcgccgcc

SEQ ID NO: 62462 - DNA, 574 bp, Triticum aestivum
  Clone ID: PAT_TA_62462
ggagctcgcagttctcacctctgaatctgcgcgtcgtcgtcgtcttcacagcacagctcgaagcggagttggggctcgcggggaagcaaggatgccgaaggccgcgggggacgccaagctcctggtccagtccctcaccaaggcctacgccgccacgcccacgaatctcaagatcattgacctgtacgtggttttcgccgtggccactgccctggttcaggtcgtttacatgggaatagttgggtcattccccttcaactctttcctgtctggtgtcctgtcgtgcatcggaactgcagtgcttggtgtttgcctccgtattcaagtcaacaaggacaacaaggaattcaaggatcttcccccggaaagggcctttgctgatttcgtcctgtgcaatctggtgctccacctggtgatcatgaacttcctcggatgagcaattgtcatacaagctgtcgagattttgtagtgtccttatgactgagactgtcagcatgttagatattcatgtggcatcatacacacctatgtaatccgagagtttctctatgaactataagaattcagtggattt

SEQ ID NO: 62463 - DNA, 533 bp, Triticum aestivum
  Clone ID: PAT_TA_62463
ttctccacctccccgactggctcgtccctggggccaccccggcaacatggccgtggtgctgttcgcaatgggtgggtacgggacatacctggggttcaggatcaagctgtccgacgaccctgaggagaaggccaaggccaaggacctgcaccccaagctcctcggcggcatgttcttcttcttcgccctgggcgccaccggcggggtcaccgccctcctcacctccggcaaacccatcttcgaaagccctcacgcggtcaccggtgtcatcggccttgcgctcctcaccgtgcagtctctcctgccaacattgtttgaggggaaccctgggctgagaggcgcgcacggcctgctcggcagcagcatcatgacgctcttccttttccacgccgcgtttgggctgcagctcggcctcagcttctaattagctcgtgcgtgtgtgcgtggctggtgttaattcgcttgggttttcgttctgtgtgtgtgcttgcttataagaagcacattcatctcccaaaaaaaaaaaaaaaaca

SEQ ID NO: 62464 - DNA, 580 bp, Triticum aestivum
  Clone ID: PAT_TA_62464
cggccgctcaggcggcgggcgggttcattcattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaacc

SEQ ID NO: 62465 - DNA, 779 bp, Triticum aestivum
  unsure (1)..(779): unsure at all n locations
  Clone ID: PAT_TA_62465
tatcctttagtccctccctccctcgctggtagctaatcccatcaccatatcatacactcatcactcatacacatacatgggctgagtacatgatcagtcgacttcgactcgatcgaccagtttgctagcgggtgatcgatatggggaaggtggtcgtcgcggaggccacggcgcggcaggtggcgtccttcgtcctcggcgccgccgcggcgctcaccgtcgtcatgctcgtccagtaccgggcgccggccgccgggctcagccgcgccaggacgccgggccacttctccggcttgaggttatcatccgacgaacagcaccaccgccgtaacgggacggcagcagcgcgcgccgttgtgcatcatcgggcgccaccggtcgccggcagtgctgcccgagacgacgatcgtcgccgtccggcgaacgccacaacagtcacaaagcccaattgtacctccacaagtcatcttcccagcacgcatcgccatgaagaaaagggagggaaggaggagtcggcggagttccgggggctggcggcggcggtggcacgcgcggcgatggacgaccggacggtgatcatcacgtgcgtgaaccaggcgtgggcggcgccgggctccctgctggacctgttcctggagagcttccgcatcggcgacggcacggcgcggctcctccacacgtgctcgtcgtggncatggaccccggcgcccacgcgcggtgcctcgccgtgcaccggnactgctaccactacatcatcccggngctcaacatcgacttcg

SEQ ID NO: 62466 - DNA, 479 bp, Triticum aestivum
  Clone ID: PAT_TA_62466
acaggtactaatatttcgcgggcgcacacgcttcctcctctcaaccaacacctttttcttcttttcttcccagaacaggcggttacttctccttctttcctatagaggcatcccgatcgcatcatcatcaacaactctatcttttgatcaccatgtctgctcaagattattacggcggcggtggcggcggcggctacccccaacaaccacaaccttcctacggccctccccaaggtcaatacggacctcctcaaggccagtacgggcctccccagggacagtacggccccccgcaaggacaatactatggccctcctcaaggccaagttcctatgcagtatcaacaagctcctcctcaacagagtggtggaaagggcggcggcggcggttgcctagcaggttgtctggctgctctttgctgctgctgcgttgctgaacaaggatgtgaatgatgcatggaatgctgctcagagtctctg

SEQ ID NO: 62467 - DNA, 377 bp, Triticum aestivum
  Clone ID: PAT_TA_62467
actccacagtggacgtgcgcttcgcacggaggcgccgcgcgtgcttgcagtgcaccggctgaccggcggccatgaagcgttagcttgcggcgagcccgacaggacggtcgtgcttccggcggccggcgccaccaacagcgacgccactccgtcacgcaagccggcgcaggcgacccaattcaaacatctttttttccttttagagagagagagagagagtaggggaggtaggaatcggctcagctgcctcgagttaacggcgccatcgccgggggctcgctggtgcgggcaggcgggccccgcgccaacgacccgttcgctagtgggccgccacctcgggcgcgacgcttcgcggaaaccgcgcgggtcacccacgt

SEQ ID NO: 62468 - DNA, 664 bp, Triticum aestivum
  Clone ID: PAT_TA_62468
cccctcagctatactaacggaccaacatggcgtctcgtcgcgccctcttctcctcagctttgcgcgcctcagctgccgtccttcccgcacggcctatcttcacaattgctgcctgcacagcaagaccctcgctagcaccgcgagcatttgcgccctttgctaggtcgttgcgaagctatagtagcgaaaagaaagaccctgaaaaagaaatcaagaaatgggagtttgacgaattaaaaaagctcgtggaagatggctctcatgacaatatagttattgttgatgtccgagagccatacgagctcttcgagacgggcaagatccccggcgcgatcaatattcccatcacaacggcagtgcagagtttccatattcccgaggaggactttgaggagatgtacggcttcgagcgacctccaaaggataaggagctgctgttttactgcaaagctggcgttcgcgcaaaatcggccgcgcacttagctcagcatgctggctggacgaaggtgagcgattatcccgggagctggttggactgggcggcgcagaacgggccagttgagggtgtcaagcgcccttagggatcaattgcaagtcatgaaaagggagggagacaagagggaggtaaaatagcgatcagataaaagcgcctttctaccttatt

SEQ ID NO: 62469 - DNA, 306 bp, Triticum aestivum
  Clone ID: PAT_TA_62469
cgctcgtagtcggccgggacgggcaccactatggcggaaacctactgcgcctaccccgccgcctccgccgccgccgccgcataccctaccagacgccgcctgcaaaccctaaccgcgccgggcgacctacctgctgctcggaaacccagccgccaacccccctccttcctctctttccggcgccacaaagcagagatgacgacgctccccgtagctggagctgacccgcaagttgaaaatggcaaagattaccctcctatgaatgacctatttccactacacaagaaagacatccaacatggaacc

SEQ ID NO: 62470 - DNA, 424 bp, Triticum aestivum
  Clone ID: PAT_TA_62470
ggtcaccccaccttgtccgccgccgccgccacccacctcttctcccaaacgctcaaccctacttctccgaccatggccaagaagcgcggcgagaagaggtcggcaccaccaccgccaccgccgccggctgcctcctctgaggagacgcactcgggcgcagacgagtccgaggacgaagagaccatcgccgtgtctcgtacccctgcccccaagaacccgcccccgcagccgcagaagggcgaggagtccgagacctctgacgaggaggaggaggaggagccatcccccgcggccccgaacactgcccccaagaagcagcctccgccggcgcgacagagcgaggactccgacagttccgacgacgaggaggatgggggttccgaatctgacaaagatgcgccgccgccgaagccatctccgaagc

SEQ ID NO: 62471 - DNA, 834 bp, Triticum aestivum
  Clone ID: PAT_TA_62471
ggtttcccaaacccaaacccaaccgacgccgcattcgtcctcgttcctctccctcccaccccatcggcgccgccgacctctaccgcagacctcgccgccgccgccgccgctgacctctccccgtctcccgcggacctcgctgccgccgccgaacccactaccacctcttccctcccctcccatcccctcgtcagaggagaagggaagataagaggaatgtgagatcgagcgggtgagtaggccaggaggcagccatggcgttcagatccgccggcgccatcttcaactgattcttcgacctgcgtgtggcgtgcctctgctcggccgtgcgacgagacgggctccctgctccgtgcccatgcattccgatggtgaggtgcacgcacgcgtctagaggcggagcacaaccttgctgcagcggctcgccggaggcccctttgctctctctttttttgaaagaaaaggcataccaaaatctgccttatcctgcaggcactttgttctcatcccatccgatctggttgtgtcaacaaaggtgtccgtcgggaagctgctctcacacgggttcaagggcatgccgtgccgggaaaggagggctgctccgaccctgacagcatggaaggtcgcccatgtcttctcaacacttggagcagtgcatccgcaaggccgaggaggatcctcaacgcgccatggtctgggccatcctcagcgccatagtgtcgacttccatgatgaaggcgaccataggcagcatgtcattgagtagtcaccgaacgggcacaatgttcctcttcggcttgggtgacacaccactgggacggtgatgactgtcgt

SEQ ID NO: 62472 - DNA, 541 bp, Triticum aestivum
  Clone ID: PAT_TA_62472
cccctccccttcttcccaaaacgcacactgcaccacagcacacagatctaaccgaaacccatccccacccccaccggcggcgagcggcgcgccgccggcgacgagccagccatccaagatgcagtacaacaacctgggccggtcggggctgcgggtgagccagctctcctacggggcctgggtgaccttcggcaaccagctggacgtgaaggaggccaagtccctcctccaggcctgccgggacgccggggtcaacttcttcgacaacgccgaggtgtacgccaacggccgggccgaggagatcatggggcaggcgatccgggacctgggctggcgccgcgccgacgtcgtcatctccaccaagctcttctggggcggccagggccccaacgacaagggcctctctcgcaagcacatcgtcgagggcctcaaggcctcgctcaagcggctcgacatggagtacgtcgacgtggtgtactgccaccggcccgacgcgacgacgtcgatcgaggagacggtgagggcgatgaacctgggtgat

SEQ ID NO: 62473 - DNA, 399 bp, Triticum aestivum
  Clone ID: PAT_TA_62473
caccggccaggcatcctgtggcaagtgcctccaggtgacgaacacggcgaccggcgcacagattacagcgaggatcgtcgaccagtgcagcaacggcggcctggacctggaccacgacacggtgtttagcaagatcgacaccaacgggctgggtatgcagcagggccacctcaccgtcaactaccagttcgtcgactgtggcgacaactaagcaagaattggcgctccaacgcaacgctatggaaaatacagtaataagaagcttctgcaaatcgtaataaagtggaataaattggactgcgatagatggaaccaaggttttaaccccataatcacaatccttatgtatggatggactaggacaccattatagatgagtaacaacgatgtcgtctgttg

SEQ ID NO: 62474 - DNA, 813 bp, Triticum aestivum
  unsure (1)..(813): unsure at all n locations
  Clone ID: PAT_TA_62474
aaccaccgctcccagcaacggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggggtccaccctccaccttgtcctgcgtctgcgtggtggcatgcagatcttcgtgaagaccctcaccggcaagaccatcactctggaggttgagagcagcgataccatcgacaatgtcaaggccaagatccaggacaaggaggggatcccgccggaccagcagcggctgatcttcgccggcaagcagttggaggacggccgcacccttgccgactacaacatccagaaggagtcgaccctccatctcgtcctcaggctccgcggaggcatcatcgagccatccctgcaggctcttgcccgcaagtacaaccaggagaagatgatctgccgcaaatgctacgcgcgcctgcacccaagggctgtcaactgccgcaagaagaagtgtgccacagcaaccagctgaggcccaagaagaagatcaagaactagagtgctactagtcagtttcatggaccggttgaatccattgctgtgttagcgtttatgctattgtcgtctcgttgtcgntgaaccttattttactttgct

SEQ ID NO: 62475 - DNA, 580 bp, Triticum aestivum
  Clone ID: PAT_TA_62475
attcaattcaattgtgctcatcatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactccta

SEQ ID NO: 62476 - DNA, 755 bp, Triticum aestivum
  Clone ID: PAT_TA_62476
gctacgacttctcaacttggagaagtcttcggtgataaagcagtcagacaggcaattggagtaggtgacattgaattcgtctcatgcagcacttcgatttatcaagcaatgctcacagactggatgaggaacttggaagtcggcatcccagctctacttgaggatgggatcaatgtgctcatatatgctggggaatatgaccttatatgcaattggctcggaaactcaaggtgggtccactccatggaatggtctggtcagaaagactttgccaaaactgctgaatcatcgtttttagtagacgatgctcaagctggagtattgaagagccatggggcactcagcttcctcaaggttcacaatgctggccacatggttccgatggaccaaccgaaggccgcccttgaaatgctgaggagattcacccaggggaaactcaaggaggcggttcctgaagaagagtcatctacgaccacgttttacgccgcgatgtgatcgtcaacaccgaccaaaaagggaaaagaaactggctaggtagcctgcacgcgtcgcccttacggtctgaaggagtgtctgctgtagcttcctgttttccatgtatcttttttctccgctgtttcaactggatatgtagtccctaataacaagaaaagaaagttggccccaaaatgtaactgcaggatgtatggtttatgacgttgatgaaggatggaatacaccatgggggggcgatgtttgagagccgctcatgtttt

SEQ ID NO: 62477 - DNA, 852 bp, Triticum aestivum
  unsure (1)..(852): unsure at all n locations
  Clone ID: PAT_TA_62477
attctcacatggcgacggaagacgagcgctatcggcaatcgagccagtttcggctctggtccttttcaaaggccaacctacaagaattacgcgcaaagacaaactcgctcgctcgagaacagatcgctccccgactcgcgacaaatcctcctccagacttcctcacccccgatgaagaaatccgccttgtcaagttctttaccgtcgagcttatccgcgcggctcagttctgtgaactgcctaccgaagttcgagcgaccgctgccatttttctccgacgattctacgtgaccaactcggtcatgacctaccctgcgaccgacctcctcaagacatcgcttttctttggctgcaaggctgagggtttcttctacaaactcaatgctttttcggagaagttcccaaacacaacaggtgaacagatccttgcaggagagtttctgctctgtcaggggatccgcttcgcatttgacgtgcgacatcctttcagagcgcttgagggtgccattctggaattcaggcgaagactgcctgatgaagaaacaaggatcaacaaggcacacgctcaagcgcgtgaaattctcaaattcagtcctttggtgacggatgcgtattttcactatgcgccaagtcaaatcatgatggcggcgctttccatggttgaccacggattactcgaaattttgatcccttctccgggccaaggcggcaacgctagccaggatgcagtgtttgcaaaatgcgggacagatcctagaagctgccgccagntgtcgcaagatgctcgaggaggaaccacagagaggatgacggattactggggagcgcccgaaaatcgtcagcgatgaaacc

SEQ ID NO: 62478 - DNA, 450 bp, Triticum aestivum
  Clone ID: PAT_TA_62478
gtatcgtcagacagacagcgcccaaatttgcagatctctcggcggctccgcaacgagcaaccggcgctagctgctccccttccctcccgcgtgccgacggaagctgtaggcaccatgtcgatgttcccagggatggatcttactaaaatggatgctccaactcttaccctccttggagcagcttgttgtgtaatgttatctatgcatttcacagtgcagctggtatcacaacatcttttctactggaaaaatgccaaagagcagaaggccatactcattattgtgctaatgcctccactgtatgccataacttcctttgttggtcttctggatattaagggaagcaaagcgttttttacatgcttggagtctgttaaagaatgctatgaggcactggttattgctaagtttctggcattgatgtacagctacttaaatatatctattagg

SEQ ID NO: 62479 - DNA, 607 bp, Triticum aestivum
  Clone ID: PAT_TA_62479
aatccgtatctcggtttcctcttcggtttctctccttggttcagatcgtcttttcagatcagggggagaaaaggagagaagtgggggagagatgaaggaggcgacggcgtcggggggcggcgcggcggcggggccgaacgacccgaggcagccggggacggcgaggccgtacgcgccgccgaagctgtcgtcgcaggacctgcccgtcgactacgcgggcttcctcgccgtcgtcttcggcgtcgtcggcgtcatgctccactacaaggtttgctcgtggatcgccatcatcttctgcgcgcagtcgctggcgaacatgaagaacttcgagaatgacctcaagcagctctccatggctttcatgtttgctgtcatgggtttggtgacgaactattttgggcctcgtccaggcgcggcaaagcgctagctaatccgcacaccatgggctgtatggatttttcttgttatatttctgaatctttgagtcgtgcacgcatcaaatgtaccaccacctcatcggttagggaccgagacattgtattatgatgcttagtaatttacttgctcttccagtttggttatgaagatagtcgaagggcctttgccg

SEQ ID NO: 62480 - DNA, 788 bp, Triticum aestivum
  Clone ID: PAT_TA_62480
atctcaacttgcaaacactaggcacacgcttcagcagactcagttttccgttgaagtagctcaagaatatggcagttgcggtgaaggtgggttcatggggtccactgagcggagaagctcaggacatcgccggagaaaggcggcctcaacgcctggagagcatcaccatctatatctccgaggctcccaggctccgcgtctgtggcttctccttcgtctacgtcgaccagaatggcgagcacgtcgttgtcggcccctggggcatgcccaacgataatccgcaaatcataccctttgtcatgaacccaggcgagtatgttaacagcatgagtggcactttcgacgacgagggcatcacctcgctcaagttcaccactaaccaggaccgcgactacggcccgaacggaagcgaaatggggattgcctttagcgtgccactgccggcaaactgtacggaaaacacggacaccgccgacggtgccgtggttgccttcttcggccgctccgacgacactggcctcaaggcgctcggcatctacgtgccggtgatgcaaggctcacgggtcatgattggtccatggggcggctgcgggaaaatagtggacatcgacggcacgccagtcgagctgaggagcgtcagcgtctacagcaccaagtatcttgggggccgcatctatggcttctccttcacctacatcgaccagaccggcaacttggtcgatgtccagacctggggcaacgcctacggaccgccggatgtccttttgctgcaagaaggcgagtatgtg

SEQ ID NO: 62481 - DNA, 282 bp, Triticum aestivum
  unsure (1)..(282): unsure at all n locations
  Clone ID: PAT_TA_62481
tttatggagaaaaaaacggccgctcgagccggncgggncggcnatccgcaggcgagcaaagctcccaatccacttctcccgacgcgcgccgctgccgacgaaacaggtcataattctccggcgaccggcgcaacgagggcaagatgcagatcttcgtgaagacgctgacggggaagacgatcacgctggaggtggagtcgtcggacacgatcgacaacgtcaaggccaagatccaggacaaggaggggatcccgccggaccagcagcggctccatcctctcc

SEQ ID NO: 62482 - DNA, 774 bp, Triticum aestivum
  Clone ID: PAT_TA_62482
aatacaaaaacgggctcaaggatcgatacattcccgccttacaagttataatctcctctgctagctctctttacagttccaaccgcaatggctgccaggagaaccattcttctcgccgtggctgcgatggccgtcctgagcaccgcgtcagcggcaatctacaacgtgggcgagccgggcggcgcatgggacctcagcaccaactacggcacttgggcgtcctctaggaacttccaaaccagcgatcagatcgtcttcaagtactcccctcaggcacacgatgtccttgaagtcagcaaggcagactacgactcttgcagcacggccaaccccatcaccaccttcaactctgggaatgatgttgtcaccctcacagccaccggcacccggtacttcgtctgtggtttccctggtcattgcgcgggtggcatgaaggttaagatcgatgtcatgccaggctcctcctctacgtcacccgcaccgggcagcggcccaagtgcaagcaatgctcccccgccgacacctgtctcttctgccaccaatgtggaggccacggggtttggccttgccgttttgcttgccattgccggcctcatggcttgagtgcatctctgtagtcacaggcacatgtgtattttatgtatattcaagtaattaatactagcaactatctgtgtgtatgatcaagtagttatgtttatgttgggtgtattcaggctttgtgtattgctgattcattttggaggatttattaataaagattcttttgggctc

SEQ ID NO: 62483 - DNA, 654 bp, Triticum aestivum
  unsure (1)..(654): unsure at all n locations
  Clone ID: PAT_TA_62483
attcanaaaaggggnnnnnnnnngtnncttgcacacaatcatatctgttgcccatcatgcttacttctcttgttgttcttgttcttgcgagcgtctccattgcttctcccacgcttgagaagcgagctatcacctgtcttcgagttggacagacagccacagcctcatggactaacagtgctggcaagagatgcaccttcactggcgttgttggtagcaactatggtgccaacccttccggatctggagattactcttgcaacggacgatgtggcgctggatgcagtggaactgccgtaggcaacgtctatacccaggactgtttttcccacgatatctgctcttacttcaacagtgccggtggcggcgccagtgacccaaactgtggagcagctttcaacgcggcagttgatgatactgcgttaggttttgcaaacggttgttcccagaccaacccaagtaatggagttaccaagcccaacggtgcgccagtctgtgtatagagtagttcatagtatgagcgcaatagttatttaccgcgtcacaatacatcaagttcaacataaaagttctggcatgaatcttatcacaagggaacggaacaggattgatttgatttcaccaagtcaatattaagttggtatattcattagc

SEQ ID NO: 62484 - DNA, 357 bp, Triticum aestivum
  Clone ID: PAT_TA_62484
cggccgctcaagccggccgccaacctggcttacgtagggtctgatcctatacaatgactaaaactgtcctgcttgtaccctctgatcctctctccagaccagaagcgctggagaagcagagatcatttacattgtactattattaaaactgtactgttggaacttcatataagtttgggaagtgtttttgtcaatataccataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggcccccaagggccataagggcgccc

SEQ ID NO: 62485 - DNA, 618 bp, Triticum aestivum
  unsure (1)..(618): unsure at all n locations
  Clone ID: PAT_TA_62485
cctcgnttgcgcttcctcacgacaccggagccagctacgggcgcgtgagactagcagcatggaggggggcggcgaggggaagggccgggcggcgccggcggcggcggcggcggggggagggttcggcgggtacgagtcggccggggaccgcaagtggtggccctggctcgtgcccaccgtcatcgtcgcctgtgtcgccgtcttcgtcgtcgagatgtgggtcaacgactgccccaggcacggcagcgcgctcggcggcggctgcgtcgcgggattcctccgacgcttctccttccagccgctccgcgagaacccgctcctcgggccctcctccaccactttggggaaaatgggagctcatgactggaacaaagtcgtccatcagcaccaggggtggcgtctcattagctgcatctggctccatgctggtctgatccatttggttgtgaacatgctaagcctgctgttcattggaatttcgtcttgagcagcaatttgggtttgttcgcattggcgctatctacctactgtctggtttcggtggcagcgtgatgtctgcacttttcctcccaaataactacatctctgttggtgcatcccggagctttatttgggctg

SEQ ID NO: 62486 - DNA, 553 bp, Triticum aestivum
  Clone ID: PAT_TA_62486
aactgcgccactagactaggaagaaaatgggggggaagggcgtcctggggctcgactacggcgacgggcaggcaccgctcggccccgacatctccggcccggagctcgcccccgccgtcgccaacgctggcgccataggcctcctccgccttcctgactggtcggcgccggaccacgtgagggagctgatacggaggaccaggagcctgaccgagaagccattcggggcggccatcgtgctggccttcccacacgaggagaatctgagggtcgtgctggaggagaagctcgccgtgctgcaggtgtactggggcgagttccccaaggagcgggtcgacgaggcccaccgcgccggcgtcaaggtcttggatcaggtgagaactttagctgaaggacatttcaccggaatggataaacccggctgcggtttgcgcttacttaacgggtgaatagctcccatgcgacgtcgttggggtgaattgtgtctctcatgcgacgaagttggttgtaatcgctctcatgcgacatcttccttggaaaaaataactcccat

SEQ ID NO: 62487 - DNA, 604 bp, Triticum aestivum
  Clone ID: PAT_TA_62487
atgcaaactaccgcaacacaatactcccacttccccaaataccccccaaaccactacaatgcatctgatgtacaccctcgacgcccaaggcaaccgcctttacaccttgaagaaggtcgctcagggccaggtcaccaagtctgctcaccctgcccgtttctctcccgacgacaagtggtcgcgccagcgcgttactctcaagcgcagattcgagcttctcttgactcagcagaaggaggaataaattgctcgaaatgaatcgcagatcgactctaagctatagacacggtcaactcgacgagcgacagattctgcagacgacccacccgaattcagactttttacacattcaagactcggatcgcttgggtcaatcatgttgttcgaatctccaatatcaatggtggctttcgaatccctggtaccaattgtgcctgtcgaatcgctaggatcaatggctcgatagtttagatcagactcgtggaaacaaaaatggcgacagatcgcagactacaatctcggatcagtcgcatggcgttacggtattaggtcatgggcgtttagacacagtagtgtgtttcaaatcaagtctttttctctctct

SEQ ID NO: 62488 - DNA, 197 bp, Triticum aestivum
  unsure (1)..(197): unsure at all n locations
  Clone ID: PAT_TA_62488
atgcttacgctcgggtcagttttcagccttctactccgccgctacaaaatccagactcactgctagctagacatacggatatcacacacgctcagggcttgaggcagatcagtacagtttccagttttcccaggcaagaagaagggaggatcatggtaggcccggcngaagngncccnnaaancccccccccccccc

SEQ ID NO: 62489 - DNA, 131 bp, Triticum aestivum
  unsure (1)..(131): unsure at all n locations
  Clone ID: PAT_TA_62489
ngtcctatgtggggctgagaaaatttgttttcccaaagacagtcattgatctattgtcgatactcttgtaattggattttgtgtttcttcgaggaattcacatgcccgaaatgaatggaaaatgtgaatgt

SEQ ID NO: 62490 - DNA, 494 bp, Triticum aestivum
  Clone ID: PAT_TA_62490
cctcctcctccttgacaaaaaacggcatcacgtagccgagtcgacgtcgacgacgcgcgcgcccacccacaaccgcgtcggcctctcgcgctcgcgccggcgccatgctgcaggcgggctcggagcgggcggcgccgctcccgggcgcggcgaggctgtgggtgccggggatgagccccgtggtgccggacgctggggcgggcgcgtcggccagggcgcgggagatcgcgcggaggcgggaggagatgctcggcatgctgcgcgacctccccgaggccgagtacgagctctccctcaccgacctcgtcgacaagaccgccgcggccggggccaacaacggctgtgcggcgccgctgccgaccgagaggaaggaggcgagcccgagccccagccccagccccttgggtctggccgagcggcccgcgtccggcgggcaggccgagcagcagcaggcggcgaggacgacggagaggaagggctccccctccccgagg

SEQ ID NO: 62491 - DNA, 744 bp, Triticum aestivum
  unsure (1)..(744): unsure at all n locations
  Clone ID: PAT_TA_62491
nttacccacaagggntggggnnnnnnnnnnnttacccaaaaaaaaaaccccgaggactcaccagctccacgagcagaggagccgacacccaacccagcccggccaggagagagacaacatgcgttcatctcgggacctccggttcgccgggctcctcctcctcttctcggcgtccgtcctcctcccggtagccagagcccagcaggaaaccgaggaggaggaggagttcagctactcgctggacgcggagaatgggcctgcgcactggggcgacatcaaggaggagtggtccgcatgcggcaagggcaacatgcagtcgcccatcgacctcgccagcccgcgcgtctccctcgggcgcggcctcggttacctcaaccactcctaccaccctgccaacgccaccatcgtcaaccgcggccacgacatcatgctcaagttcgagggcgacgccgggagcgtctccatcgggggcacgccctacttcctccggcagctgcactggcactcccccaccgagcacagcgtcaacggccgccggtacgacatggagctccacatgttccacgagagcgctcagggcaaggccgccgtgatcggcgtcttctatgagattggtgcccatgacgccttcctgcacaagctggagccatacctggagatgatagcggatcgcaaggacagagaggagaaaatgggcatgatggatcccaggggcgccagaggaaaggccagcgggtactatcg

SEQ ID NO: 62492 - DNA, 476 bp, Triticum aestivum
  Clone ID: PAT_TA_62492
aatcctgatagagtgtgcatcccaatcctatttccccaacattcttcatgcgtaatttcccggagagctccaaccactgctggctcgaggacagacacatcctccaccgcaagagagcccgcggcgaaggagactatggcgagacaacacttgagcttgactactaaatcggtaccgagaatgggtctttctcatggggaggagagagcttctctgagtctgcttacaacctcaacctacgatctccaaggcgatcgataacgttgcccgctctcctcggcgagtcctcccccgtggagggcgttcccgactcaggtcatctgccacctcttccgagagcatcgccgaacgagctggccaactctgtatcttcctcagcttaaactgcatagacaactgcccatgtgatgagaacacaggcagcctcgaactctacccgagggctcgcctttcacgccgactccgagggcaccaag

SEQ ID NO: 62493 - DNA, 663 bp, Triticum aestivum
  Clone ID: PAT_TA_62493
ggcccgcttcgagccggccgggccgggactcaaaaacagaaagcccaacgccaatttccttcaacgctcctctcgacccttcttcctggctttcggagcaagaaggcgcctgcagcagcggcggcccgcaatggagcggcagggcgactcgaggcggcctctgccgaggcgcgggcaggtgaaggcgagcatattcgcgtgcctcttcccgtgcctcgcccgcaaccgcaaggcggccggcggcgagcggaaggagggcaaggccagggccaaggaaggcggcagcggcggccgccgcgtcgcgcccggtggttgatccggtccggcccgtgcccggggaaggagggatggatctgatgatctctgaagaaaagaaagaatcaagaattgctgctgcaggtccggttcttgttcttgagccggaagccgttctgttgggacgcgggatgagggtggacgatttggtggtcgggttcgctggtacgatagggggtgttggaggggaataacattttcctttttgctggctgcatggaattccgttgtgattccgcagcagcttttggccaacatgtggagtccgtagtctcgcagtgatttggatcgtttgttgtgggtgtatgtatgtgttgtatatgctactgtacgtaattgccattgagc

SEQ ID NO: 62494 - DNA, 632 bp, Triticum aestivum
  unsure (1)..(632): unsure at all n locations
  Clone ID: PAT_TA_62494
aatacaagatacgcctgtatgtgtgcggcggttgccaaccatgtcgagccaagggaggcggggcagcggcgcctccgcccggcctcctcctcctccagcgacccactcccgcccagcctcctcctcctcaagcactcctccctgttcttcctttcttctgtttcccatagagtttgaggtggagcgcggccacatgagttcgagtgtcaacttattattcattcaaagttacaagaaaatgaagattctataactcaagctgacaagacgaagtgccatcccgccagcgctgccgtcatcacccattcacctatccaagctgatgttgacttttcccccaaaggagacatgatggcttttcaccttactctgtttatatcattctaattagttttctttaccctgtactttgattatctaatggacatagccctctatattaggttcatgtcatgtctcgagatgcagggatatctccactggattgtttctgaccagcttacagttgttatctcgcttcactgtagacactcttctatatcttatactatacagaagttggaggtggaacacatggattcgtaatgatatctatctccatgaacaannnnnnnnnnnnnannnnannaaaa

SEQ ID NO: 62495 - DNA, 168 bp, Triticum aestivum
  unsure (1)..(168): unsure at all n locations
  Clone ID: PAT_TA_62495
aatacgtcaccgaacaaagccaccaatgggtttccaaagatcatcgcagcgactcttctccccngctttcctcgccctccatctacacgccccagcagcaatggccaccngcggcaggcaagctccaacnntccaacctcttcccgcgactaacatcgggcggccctc

SEQ ID NO: 62496 - DNA, 678 bp, Triticum aestivum
  Clone ID: PAT_TA_62496
attcaaaaaggggcgcaaacagacctcactaccacatctctcgtctcatctcgtctcgccgtgcgttcagtggactcgaggcaaaacccagcagaagctcacgagcgaagcagcaggccgagcaaatcaatggcaatggcaccctcagcatccgtggtttccttctccgcccgcccgtccgccgcgctccggccgcgcgccgcctccgtcacggcgggagctggtgggcgggtccgcgctggggcgcccaagggaggcaagtggtgggcgccactggtcgggtggtctggacgggcggactatatggaggccgcggcgccgacgccggtggtcgaagtggaggagaagacgttcgtcggcctgacggaggagaaagcgaggcagctgcgggctcggatgtcggggatggagagcttccacgacgccatgtaccactccgccatcgcgtcccgcctcgcccgctccacctaggaggaccagccaccaaccaacgaacccgccgacaccaccacacaaactggtgttcagtgcgtttgtacatagtcatgtttctcgccgtgctgtaatcatggaggagacggcgagacgctagatgtgaatacgggaggggtctggttttaggattggtccctccccgatcttctcttttactcttttgtaattacacaccatgtgcaa

SEQ ID NO: 62497 - DNA, 667 bp, Triticum aestivum
  Clone ID: PAT_TA_62497
attcttgatgaccactctattgtatcaattcgttgatgatcattggcttctggtcttcctctcctcctctactctgaacttttaactttgcaaactcaatgagttcttcggcctctgaagtcgccaaaggaggagatctaaagtatcctgctcgagctccggaagatgcagtccacctagcagtagaacgccaaccacggatgagaggccacccaaaacacagtgcaagactctagggagcaatgccaaagatgaatctattcgatgctattccataaacccagatttccctactggagatttctcgcgccatctgcaccatatgggtattgccgattcaagccctacatattcacactcatctagcagctgtaatgtcctttggataatgagcggcttctagtgctcactttgcacagagtcaaaacagcccaagactgattgcccttggtacctcggtgaccgactgcaagatgacgcgcatgaatatttactaaatatgggacgtgatgtccgacgctttcgtcaacatgaagactatggtagatgctatgaagtttcgtgatcggagatataccatgataaggagctcttagctaaactacggatacatgctgtgctattgagtaagattgatcgatgaaagacatttttgaatgtgacaaat

SEQ ID NO: 62498 - DNA, 592 bp, Triticum aestivum
  Clone ID: PAT_TA_62498
gttcctgattttctgtaaatatcatcattttcttcttcttttttgtgctgaaataaaatgcattcttccataccaaaaaaaaaaaaaaaaaaaaaaaaaaaaagtcgacacagggaatcaatcagcagcaatggcgaagtcaaagaacagctcccagcacaaccagtcgcgcaaggcgcaccggaacggaatcaagaagcccaagacttcccgttacccttctcttaagggtaccgaccccaagttccgacgaaaccatcgacatgctcttcacggcaacatgaaggccctgaaggaggctaaggagggcaagcgcgaggtcgtctaagcacccggcaaaggaatattgaggcgtcaatttggagcattcgcattgctcggttacggcatacacacgatagaacctgcgcaaatgaacgatggaaaataccatacgattagcccgaccaaaaaaggtggtggatgccgatacgtacgtctcggcgaatgatgctgtgacagtcccgagtaaagcatgttgcttggtttccaggaacatgaggtagaatactgaacactactgcctgaactccaagctgcaagtcccagttcc

SEQ ID NO: 62499 - DNA, 738 bp, Triticum aestivum
  unsure (1)..(738): unsure at all n locations
  Clone ID: PAT_TA_62499
attccggagaatactctaccaacgcggttctgccaacggaaagcgtgtccaagctaacctcggcgcaaagaaccatgcgcttctgagcttggacgcaaacaaagagcacgcactcgactcaatcgccggcgccgcatttggcgctgctggacaacgatgcatggctttgagtgttttgatcaccctgggcgatgcgaagcaatgggtggatgatctcgtgaaaaaggcaaagaaccatgttgctggtagtggatttgactccaagtctgactttgggccgctcattacaccgcaagctcgtgatcgctgtgaggctcttattaccagcgctgagaaggagggtgccaagatcctcctcgatggcagagggtggaagcccgagggtttccccgacggtaactgggtcggcccaacagtcatcgcaggtgtcacgccagagatggaatgctaccgcgaagagatctttggtcccgtgcttctgtgcatggaagccgatactctccaatcaggaatcaacatcattaactccaacgcttggggtaacggtacggtcatctttaccaacaacggcgccaaggcctctttgttccagcaggagatcgacgctggacaagtcggcatcaacgtgccgattcccgttcctctccccatgttctccttcacaggcaataagagaagtgtggncggtactggcttaaccaatttttacggccaggatggattgagattttaccccca

SEQ ID NO: 62500 - DNA, 551 bp, Triticum aestivum
  Clone ID: PAT_TA_62500
atttccaaaaagcgagctcatgagagcagtctgtcaaggtggcaatggagggaccaagagcggtggcgatggtggcggtgatcgtcctggtggcgtgttgtggtgctcagctggctgtcgccggaggtgaccagggccagccggcggcgggagggccggaggcgagtctgctgtgcatcagcgagtgcgggacgtgccccacggtgtgcacgtcgccgccgccagctcctccctcgccgtcatcatcatcatctacaccgtcgcctccctcgccgtcatcgtcatcatcaacaccgtcgcctccctcgccatcgacgtcgatcctcccgctgcccacgcccccgtcgccgtatctgactctgctgctcccgccgcccccgtcgtcatcgtctacggagctgcccccgtccacgccgtcgccgactccaccgaagagcaccggcgggtcatcatcgtcttcatcttcctcaactccgtcctcacacttatcgtcgccgacgattcccgtcgacgtcctcgtgtgaatccgtactactactttctacctctcc

SEQ ID NO: 62501 - DNA, 615 bp, Triticum aestivum
  Clone ID: PAT_TA_62501
cggccgctcgaggcggcgggctggattcaagaagctttcgagatttctttttatccctcatttatgcatgcatatagccatcaggaccgtgcattttatactaatgcttggatcgtagcaagtgaaggagacaacataggatgacttcgtttggtggtctcgagctccggagtgaaaaccctaggtatgaccctttggttatacctggcaatggcggcattctctgcgtcgtaaccttgatgaaggaattgctcggaatttcgtcggatttgatcttcaaggtgcaaacccacaatctgaccttcgatggtaggatcgggcaggttgttctcttcttgaaggcgtcgcttttgaagaaccttcttcgtagtccttgtgctgccaagacatgattggtgccaatggtcactgtcgtatgtcgtcaatcattgttttcatcgctttcgttttctttttcattttccccttcgactaggcatagctttggtcttgaatgactttgctatttgccgacgtgatactttgcgggcgcgcgcgcgcgcgcgtgtgtgtgtactcactataattgtatcgctcgatgcttgattttgagtcaataaaaaacaccttttgtcg

SEQ ID NO: 62502 - DNA, 630 bp, Triticum aestivum
  Clone ID: PAT_TA_62502
actgcgccgaggagttatcaggattcatggagcccgaggcctccaaggaggcggagaagcagccgatggatgcggaggccggagatccggcagatccccgcgacctagtgtccagcgacgatgagatagactactccgtggagcctgagttctacgaccccgccgtagacgatgtcgatgagtgctgggcgcacaagcagaggaaaggacggacctctgacgccgtgctcagctgccccgcgtgtttcactaccttgtgcctggattcccagaggtcaagattaatcagattctacgggaggggaaaggaaaaaggaagaatcggaaagtaacggctgttgattctactacaccagaagttgaaaacaaggggccagtttatcaccctgtttgttgtgagatctgctcaactgaggttggagtgtttgatgaagatgaagtttaccacttctttaatgtcattcctagtaactcatgaaccttctgatgttgtgagaatagttctcgtagtgccgcttttgtcgatccatagttgatgtgctagtatgcgagttattgttttcttttcatgatatcaagtctaccctggcctccttcatgaaaattatattctggcaccatggagaattt

SEQ ID NO: 62503 - DNA, 807 bp, Triticum aestivum
  Clone ID: PAT_TA_62503
attcaaaacactttcttgatagcctacacttcactgttattcttccaaacttaaagttttcaagtcaagtcttcggagcacatcacttacaccaagccgactgcccggaacaaaccgccatcatgagaattccctacgtacctaaccctcctgagaccaagactgaggagcatgcagccattgtgaagcgcatagaggagcgtcgtgctcctcgacccctccaatctttggatttggccctccttcactcgcctcatgttgctgatggttggaactcattcctcggcgcagtccgcaccaaaacctcgctaagcgatgacttgcgggagcttgccatttcccgagttgccgtgtgcaacaaggcatggtacgaatggaagcaccatgctccactagctgtcaagggtggtgtttctgaggccggacttgaggctattaagcaagataccctcggcgagcgacccgctgagctgtcggagaagcaatgggctgtaattctcttcacggacgagatgacgaggaatgttcaagtcgaggatgagacgtttgaccgtctgcgagagttcttcaatgagcaggaaattgtagaaatcacggcgacagtcgcatgttacaactgtgtaagccgtttcttggtggcactcgatgttggagagaggaatggaaccgaccctgaagctgtgactggtcattaatcaaggactgcagcatccatacttgtcgatacccactgtaactcatcagaacctgtggattatgatccagaatggtaaaagattcaaatatagatataaaagtaaattaact

SEQ ID NO: 62504 - DNA, 496 bp, Triticum aestivum
  Clone ID: PAT_TA_62504
atcccagaccactgccggtaccagtgcaccgactggggcgtcggcgtggagatcgacggcagcgtccggcgcgacgccatcgcggaccttatcgcggaggtcatggagggtgggaaggggaaggtgatgaagaagaaggcgcaggagtggagggagaaagcggtcaaggcgaccgagcccggcggctcttctcgccgtaacttcgacgagttgatccgcgacgtgctagccccatgtttccacggcagttaatcctagccagtggtgtaccttgataaaaacaaagaatagtgtacctgctccatgatgtagatctcttggtctacaaatcgttttataccgcaacaaaaacataatccatttctgtagtgatgaatggattgcattacaacaaatgaaaagatgcaaaagttgtacggtgaagggcacatgaaacacctgaaacagcagggctgtccgagaatgcaaggttatagagaaaatgcaactgtttatc

SEQ ID NO: 62505 - DNA, 777 bp, Triticum aestivum
  Clone ID: PAT_TA_62505
aattcaaattctccttcccccacacagacttccaagctagctggaagtctacgaaggacaagaagtcggaggatcatcaaactccatgggagctgggatgaagcgctcgagggacgaggaggtattgtcgctggcgctggcactgaccacggactcatcgacgtcgtctacgacttcagcggactcagccgggtcaccggccaagaaagcacggcgacgcacgaggggcgccgtggtggcgacgtcgggtgagggggagttcgtgtgcaagacgtgtggccgtgcctttgcctccttccaggcgctaggcgggcaccggacgagccaccttcggggccgccacgagctggagctcggtgtcggcgtcgccaaggcaatcagagaacggagaagacgggagaacaagcatgacgagtgcaacatctgcggcatggggctcgagacgggccaggcgctcgggggacacatgaggcgtcaccgcgaggagatggcactgcgcggcgaccacgatggcgtagcgctactgccggatcacggggagaacggacaccaggtcactaccaagcgaccgcccgtcgtgctcaagatgttcgactaagtagatacgcctatttctccgggaaataattccgaaaagagggcgtatatactacgaaccagtacagattgtgaacgtttccgaacattgggttcttggcttagcatcactcttcattccacaacttgaaccaaaaatggagccccccaatcaaaaaataaaaaaaaaaagcccctaag

SEQ ID NO: 62506 - DNA, 608 bp, Triticum aestivum
  Clone ID: PAT_TA_62506
tctcatagaccttgaccagaatcctcagttatacgccatgtatcttgacgctgagcatgaagacagctactaccgcgaccagggtgtctttggtgatggaattagtattgaagatacgatgaatgtgcttgtcaagtaccgcaacggtgctagtctctcatactctcttacagcttacgcaccatgggaaggtttccgggtcagcttcaacggaactggtggacgacttgaagttgagatcgtcgaaaatagctatgtcaactctggaggggaccaagctgccgagggttctatcgagagtcgaaagatcctactgagacctctgtttgagaagccacgagagatccaagtcgaagaaggtgttggcgctcatggaggcggggatactgtattgctgaacgacctgtttgggacaccagtgtctgatgagtatatgagggcggcgagtcacattgatggggcggcgtcgatactcacgggcattgcggcgaacaggtccattgttactgggcaggccattaatgtggacgatatcttgatggtcccagattcttgaccatctcaaatacaataagtagagcttatataaaatggataatgtctcttcg

SEQ ID NO: 62507 - DNA, 431 bp, Triticum aestivum
  unsure (1)..(431): unsure at all n locations
  Clone ID: PAT_TA_62507
ttttttttttnccctcttttttncnnccgggccgcttcgagccggncgggccgggcatttcctgtcatcgatactcaggtgatgatggggatatggtcaggaggcaccgtccgatggcagagagaacagtgaggtttaccggtccgagtcaaggtcagccctggtcttccattctctctgccttggtgaacggaatcggacaagtggaaacccaataatcctggagttggtacagctctctggtcaaatattacgggccagagaacagcaccatacgacatgtattggtcggtggtattacccatggttggcgagtcaaaacattccactgtaggcggaggtattttgtgttcgcctaaaatcgccatccatccattcactcgttttgcaccacatagatagtttataaattgcgtctgcgttttatttgg

SEQ ID NO: 62508 - DNA, 642 bp, Triticum aestivum
  Clone ID: PAT_TA_62508
cgaccttctgctttcaaggcatcctacaaatcaagttaccagctcccaatcagctagctagatcagcagcaacatttagagaaaaggaagcaagatcgacgaatagtcgtcactcgatcatggtggtgccgtcggtgttcgccgccttcgacgaggacggcgacggcaaggtttccgtgtccgagctacggcgctgcatggaggcgacgctgggtgaggacgtgtccgaggaggaggcggcggcggtcctcgcggcggcggacgccgacggtgatgggttgctaaaccaagaagagttctcgaggctgacagccctcggtgcccaggaagaggacgatgtcgacgtgaagcgaaggtgcctgagggaggcgttcgggatgtacgcgtcgtcgtccacggaagacacgattacgccggcgagcctgaggcggacgctgagcaggctggggtcgcacgagctgggcgtggaggagtgccgggcaatgatctgcaggttcgacctcgacggcgatggcaaactctccttcgatgagttcgggatcatgatgatggcctgatcgtcgatctctcttcttctagatacatataatattcacttatttcattgatcgatcacatgtgtgtacagtcatgtgttcgttc

SEQ ID NO: 62509 - DNA, 661 bp, Triticum aestivum
  Clone ID: PAT_TA_62509
atcattcgctttcagggcatacacatacaaatcaacttaccagctcccaatcagctagtcagcggcaacatctatatagcgaaaaggaagcaagatcgatgaatagtcactcgatcatggcggtgccgtcgttgttcgccgccttcgacaaggacggagacggcaaggtgtccacgtccgagctgcggcgctgcatggaggcgacgctgggcgagtacgtgtctgaggaggaggcggtggcggccctcgcggtggtggacaccgacggtgacgggctgctaaaccaagaagagttctcgaggctggccgccggcgcccatgaagaggacgatgccgacgtgaagcgaaggtgcctgagggaggcgttcgggatctacgcatcgtcgtccgtggaggacacggcgacgacgacgatgattacaccggcgagcctgaggcggacgctgagcagactagggtcgcacgagctgggcgtggaggagtgcagggcaatgatctgcaggttcgatctcgacggcgacggcaagctctcgtttgacgagttccaggtcatgatgatgggctgatcgtcgatttctcttcttcgcattcttctagagaaatattttgttcactcctttttttgcggaggctaataatattcaccttattcatttaaccc

SEQ ID NO: 62510 - DNA, 481 bp, Triticum aestivum
  Clone ID: PAT_TA_62510
gaatctccccaggaaaccctacactcgtctaagcagatggttgctgtcttctcggacaaggaccctcaggtgatggacacgattgagtgtttcatgcatggctacgtcacgtggcacttgtgcgacgctcgataccgcctccatgagatttatgaaaaggtcaaggatcaggatacagaggacgccaagaagttctgcaagttctttgagcaggcggccaatgtcggcgccgttgcaccctcggagtgggcttatccacaagttgcacaactggcaaacgttcgggccaaggacgatgtgaaggaggctcagaagcccatcctaagttcaattgagctagtggagtaaccgaaggcgagtttggaagtatgttttgcgggtacggatactcgtttggagaatggtggtctgttataatgattacaaatagttcggtcgtgttttgttagaatgaacagttgaacaaggataattacttcgg

SEQ ID NO: 62511 - DNA, 418 bp, Triticum aestivum
  Clone ID: PAT_TA_62511
ttctactacagctcccttcgccgcaaccccgaaaagcccgatccctttcccgctcgcccctccgacagagcatctcttttgcttattgcattagctacacactaggcaccagagataaccaagatcctgtctccaacccctcctcggacgcctcgctttgacttccccggaaacaatctatcctatcacgactatgggactgacgacctctctcgacccagagcggcatccataggctctatttctctgccactcggtacttcaagccgtcaactactctttactagtcgcttaccactttggctcttccttttcttccctttattttctcttacccttcatcatctcgactcttttcatctcgtgcttctgacttggcttccaaccatctactggaaccactaatttcatcatccac

SEQ ID NO: 62512 - DNA, 432 bp, Triticum aestivum
  Clone ID: PAT_TA_62512
atgaccccgctccttacaagcccctggccgcttccgccgcatgctcggtctctgatcaaccaaaaacaaaaacaaacaaaaaaagatgcatagcatagcaaagccaagttttcctttctttactttcaacacttggaacagggatttttagacaaattttgggaatgggttttccccctcttttcatatcgagggtatagcaaagtcatcgtcgtcctccagcctttacttcatgccctggtttgacaccggcggagatgggggtttggatgaaatagactttttgctgaggaatgagaaatttgagaatttggagttgaacattgaattgtctcttttgttttatgtgcacatgagattttttaacctacgggttgtgtaacacgatgtatgtaccgcatttcaattagagaatacagaacgccctacacc

SEQ ID NO: 62513 - DNA, 207 bp, Triticum aestivum
  Clone ID: PAT_TA_62513
aacgtcgcagtcggtgtaaccacccatgactttacagttcgatcagtctatggactaccatttctccttgtatttgacagaactgcttctcctttatccagggtttgagggttcgaaaaaaaaaaaaaaaaaaaaaaaaaaaaaaaaaaaaaaaaaaaaaaaaaaaaaaaagaaagtaattcaactcaaaaacccacccaacacttt

SEQ ID NO: 62514 - DNA, 643 bp, Triticum aestivum
  Clone ID: PAT_TA_62514
agctccttcttagctctcgtcatccttgtgtcttgccatgaagttctcctccatcatcgcagcagcctttgctggctcgccggcacttgccgtcccagctggttttgtcaccaccgacggcacgaaattctctcttgacggaaaggatttcttctttgctggaagcaatgcctactatctccccttcaacatttggggaaccgaccactacaaggatgtcaaactcggcttggaagctgccaaggatgctggtctcaaggttatccgtacctgggctttccatgacaacaacaggacattctcgtcgggtggcctgccccagtacaacactggtgtcgaggacactgttttccagtggttcgaggctgatggaactgtcaagattgatctgagcaagcttgatgtcgttgttgaggctgctgaagcgaccaacatgaagcttattttggctctgaccaacaactgggctgattacggtggtatggacgtttacactgtcaatcttggcggtcgctaccacgatgatttctaccgcctacccgctatcaagaaagccttcaaaaactatatcaaaggctgtcgtcgaccgctacaaagattctcccgccgtcatggcctgggaaatcgccaacgagccccgctg

SEQ ID NO: 62515 - DNA, 365 bp, Triticum aestivum
  Clone ID: PAT_TA_62515
cggccgctcaagccggcgggccgggatatctacagtacctatactactcttatctcactcatctaccataaataaaatcatggctgtggctcaagactcccagctagtcaatcaaggctacggcgcttgcaaatcatgcggttgcaacgtattcggcaactccaacggtggcactgataaaaatgtggcgtgtgtttgtacgcacaaatatggcaatcatctttagttgacatgtccaatcaaccacatctcattttgtccttttaaaaaaaaaaaaaaaaaaaaaaaaaaaaaaaaaaaaaaaaaaaaaaacaataaaaaaaatataaacccaacacaaaaacacgaaacctcttttttttttg

SEQ ID NO: 62516 - DNA, 518 bp, Triticum aestivum
  Clone ID: PAT_TA_62516
ccctgaattatttcctccctctccgcgccgccgcctccgtctgttgtagcagaagcagtttgcgccgccgcctccgtcgtctcagaagcagccggagaaagcatggatacgcaggtgaagctcgcggtggtggtcaaggtgatgggccgcaccgggtcgaggggtcaggtgacccaggtcagagtcaagttcctggatgaccagaaccgtctcatcatgaggaatgtcaaggggcccgtccgggagggcgacatcctcaccctgctcgagtctgagcgggaggccaggaggctgcgctaagaaatttcttccttggtacctgtctgtcttcggattatttatgatgtactgttgccttcttagtctactgctttcgttctttgcctagctatctggaggtgtaatgagttttgttctgttgcctaaattaaagtgcacttgatgttgagagacttgatcatttttgcgcacctcttgccaatgttaatcgtgaatcgtctatattgcatcctatatgc

SEQ ID NO: 62517 - DNA, 517 bp, Triticum aestivum
  Clone ID: PAT_TA_62517
actgtatctttacgataactgtttttgtcatcacaaggatgtctattacttactgaagaatacccacgccgcgatatggttcgcattattttctttgtacaagaactacctctctccttccagtccttttgcctcatggcaaatacagagacgacatgttagctcgacaagttgttctgcgacgggcagctctctccccgtacagaccctcgactcaacgaatactcgcttgccaacttcgacctctcgaccgacggatatcatttctaccatggcggaaaaagaagcccgatcctcaaagctacccggtctactttgcaaacccgaattttttcttttatggccaccccactcctgctgaggccgcagctgaaaaaaagctcctaccaagactcaaatggagcatccgccctggtcgctttcggcgctgggcttctacgactattatactttacatttgctggcaaatcttctgcactgcggtcgacgaccctctattcgaatggcctgacgccga

SEQ ID NO: 62518 - DNA, 534 bp, Triticum aestivum
  Clone ID: PAT_TA_62518
agagtacgccaactctgtagcaagagaggatctaggaagcacaagcaggatcgaccaaacacaaacagcgtctagttcaccggttagtcagcccgaccgatcgaccgatcatccggcaagaatggttgcgacaaagtcgggcgagctgagggcgctattcgcgtcgctggaccagaacggcgacggccgggtctcggcggcggagctgcggggatgcatgcgggcaactctgggcgaggacgtgccggcggaggaggctgaggcgctggtggcgtcggcggacgcgaacggggacggcctgctgtgcgaggctgagttcctcgagctggttttgcaggcggcctgggcgggccacgcgggggaggaggacgatgagctgaggatccgggcactgagggaggcgttcgggatgtatgagatggaggggcaggggtgcatcacgccggccagcctcgggcggatgctcggcaggctcggcgctgagcagggtgccgtcgagtgccgccgcatgatttgccggctcgacctcgacgg

SEQ ID NO: 62519 - DNA, 750 bp, Triticum aestivum
  unsure (1)..(750): unsure at all n locations
  Clone ID: PAT_TA_62519
accttcagttcgtcgcattcatacaagctgttgttcatgaaacgcagtccctttancacctttgaacatactactgggaacatataatagcttaacacagtcatcaattggaacagaaccacctctgaacccatcaaaatgcacgaaatctttctcacagccctcatcgaggacaaagacttcgccggcgcatgctccgtcctaggcggcctcaccaacatggatccctgggagtccatccaacgagtcctctacttccaaggacccccgcggcccatgggtatcttcaaccagagctccatcaagaaacccataagccctcccaacacgggcttcctgtggaaagagcttcaccagaacttgacgcggcagtccttcatcctacagacacgctacgatgtgctcaaggatcgcgacatggggaccaatgcgcctgcgatggaccttgatgcgacccagggagtgttgaagtggacggactttcccgatccgccgaggggtcagcctttgcttacgcagaggaaaaaggttgagctttgggagcagaagatgttgccttcgcttatgcgcgacaacaaccacacgttcaagacgggaacaatcgaggaaatgtaccgcttttatagggatgagatcgagttctgtctagtacggtactattttccacaccccatagagaactatgttccccatggagacaaaacagcagcaatccatgccactgggcaggctaccatcattcgactccct

SEQ ID NO: 62520 - DNA, 423 bp, Triticum aestivum
  Clone ID: PAT_TA_62520
attttctctatcagctaaccaccctaacttgatcctatccacttacaattgaagaggaagagtatattaatttagctgctaattaaggttataagcgtttagttcttctttataatggttgctcttaattcactatggatgcttggttcttaagagggggttttgtttcgcttgccggttttccccccttattgaaacctagtattctagtatagcttagtttagccattgaacaattttgccttatcctattagataaatggtgtctctcctattacatcttaaatgcagcgccttagactacttggtcatcttgacaactgtggtgcgtgctgtagagttattattttttacaccaagtctcctatacatatcggctagtaagaaataaagggtaagtaagaataaaaagtaatgcgaagg

SEQ ID NO: 62521 - DNA, 702 bp, Triticum aestivum
  unsure (1)..(702): unsure at all n locations
  Clone ID: PAT_TA_62521
cctttctaacgtccacattatcttggccttcgtggctttcgttgccacatgggctcactgtgcctcctccacgcttcctggaggcttgccccagctcccatggatcatggctatcatggctatctggttctgcgaccgactctcccgcatgttccaccttttgtccgtcaactggtcaacaaagggctggactgaggcagtgtgcgaggccatgcctggcaacgtcacccgagtcaccctccacctgccacggtacaaggacattgaacctggcacccacgcttacctccgcatctggggtgtctctgcgtgggaaagccatcctttctcgatctgctggaccaaccatgttcgtgacagcagcctacccattgctgagaaggaaagttcaaacacagttgacaagtcaaccatgactacgagtgtttctttcctgatagcagcccagacaggcttcactaagaagctctacgaccgtgcttcccattatcctagtggtcttcgcgccaaggccgccatggagggcccttacgccggacaccacagtctcgactcatatggccacgcagtcctctttgctgggtcaactgggataactcatcaagtctcgtacatccgtcaccttctccgaggacataatcaagggacgactgccactcgncgtataaccctggtttgaatcatccgcgaatacgagtctct

SEQ ID NO: 62522 - DNA, 818 bp, Triticum aestivum
  Clone ID: PAT_TA_62522
gcatgtcacaagaataactatatcaagtctttgcccatcttgttctgcgaaacattcagattctttgaacttgaacaatccgactcgagcgacatggcttctcaatccacaaccactgtgtgtgagcctagctcctcacgcctcaagccaggctccatcagaacctcgaccctaagagccaatccgaaagactctatgaaatccacctggcgtcttgccgatcgaaaaaattggacaacatcgcactggttcttcgaatacttgggcattcaccccgtctccttggataagaaggtgcctgttcatcagaaaggagacaaagtgccctacacgccagagtggcagttgcatcgctgggttcttgtacattcgctcgttccgatcgccatacatcacctgattgtgaaacttactggtcacaatctcacgccaatgcaagccttcttgttctatagccttgctttcaaggtggccgccgttcaccaactccatgctttgcgccgagtcggacatataacgggatttttggacggcgatgtacatgctagggatggagtacccgatgtcggagttacaaaagtcatgaagagtctcatcgctacctcaagcttccgcccagtctttacggtattccttagctaccgtacctatcaatcgccttcgagtatgaattggctgtggctaccattggagattggtctctatggtatcgtgctagacttttggttctactggtaccacagacttatgcatgaggttggcagtctgtggaaaattcaccgcacccatcacttgaccagcacccgaacccactcctg

SEQ ID NO: 62523 - DNA, 678 bp, Triticum aestivum
  Clone ID: PAT_TA_62523
tacgtcaaggagcttcgcgcctactatgaggaccttgtggagtttactgaaggcaaagatgcggatcttgacctcgaagagcttgacaaggctattgagaccttcaagaaggctgccgatgaagtcaaggctttggaggagcgagccagagagtcagatgacgaggacctcaagaaggtcgtcaaccacaagtaccgtgacttccagcgtggcttcatctcacaagatggtctgccaaatcgtgacttttacaagcacgttgtcaacgcaccgggtctcgacactggttacgccgccgttaccttccctggtattacggagggagttctgtatgctgataagggtaactttactcttgctcaggagtgggttggaaagactgctcgtggcattgtccttgcagcaaagattctcaagacatagagaggtttagactttaacgggagtgacgagcacttctccccttctgctttttcatgacaatcttttatacgcattacgaactcatggatatggtaatgatagtttttatttatttaatattctttggggattattgggctggtgtcggcttggggttttatacatgcgaggagttggataggcacagcaaacgaagagcaactctcatttgtcagagaattggaagttgtagaaatagtttatttcgaattagcc

SEQ ID NO: 62524 - DNA, 656 bp, Triticum aestivum
  Clone ID: PAT_TA_62524
agacctctggaacgctttaatctccgtacatctttgcctgagacagagatagtgattcagtattcttcccaccgacgacctcgccgctttacactgggctgtctgcagtcaccctgtgccccaactcgagtcacgacagatttctgtgctgtacgccgcgatgaaaacctctgtctaaaagtacttgggcacggcggtgacagtccggaatgatgctggagagacgaacgttctcaacaccaaaggtgaatttcggaaccatcactcccgagaacgatattaaaagaaaggttatccagcctacctcggagggcagataaaatgcctctcgtccgatcacctgccaacacgagctacgcagagagggacggagtttcgatgccacactttaatctgacacatccagattccctcttgtgtgcttaatgcgaactggaacaatcaaactctacagcacgtgatgaaggaccacatccataggctgctatgagaccatacaagggaaagtgcacccgctgatatgtgggatatgaagttctcaatgagaactgaacttacggagacattgacctctagcgtggcatcctagagacattcattgccattgatttccgcatgactgtggctgctcaccctaccatcaagatctactacaa

SEQ ID NO: 62525 - DNA, 255 bp, Triticum aestivum
  Clone ID: PAT_TA_62525
atccttctttcatcacatttgttctctaacgcagtgcgcctttgtcttaaaaggcagtattccaagtatccagctatggcagcaagaagcaagaccaagttccttggtgaactactcattctatcccgatttcacaaatacaaccctgtattcaccaccttcgctggagcatggtctgcgttgctggctggggctgccgaactttctgatcaagatcggaccatctcaactgccttttgtcttttcacaaacggc

SEQ ID NO: 62526 - DNA, 672 bp, Triticum aestivum
  Clone ID: PAT_TA_62526
agaacatccgatccgatccatccaatccagcccccctacgatctccccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagcccaccctccacttggtgctccagctccgtggtggcatgcacatatttgtgaagaccctcaccgggaagaccatcaccctggaggtggagtcatctgacaccatcgaaaacgtgaaagcgaagatccaggacaaagagggcaattcccccgg

SEQ ID NO: 62527 - DNA, 694 bp, Triticum aestivum
  Clone ID: PAT_TA_62527
agctacacagagacatttccttgacatttccatcatctggttaagtgttctgttctgtcctgttcacaactttttcctataattgctactccctagtcgacactcattcatctcttcgtatcctagaacgaaacaagtcaaccaggataacatagcgcaatacgcctccttccattcccgaaagcaaaccggcacccgtttgatcttagttgccgttcgcatcgctgtaaattgcttagctgaacggttcaggacacctacctgtatctgttacctgggcaggtatctgaatattgagctcaggtttgttgttcaatctgagcttggaagaacgaggcggcgtttgcctaccaaaatcgctaaataactaacgcaaggtacgttacattacgttacgtcggatcttaatctggaatccaaagccttttggccttgacgggaaaagaaaaagaattggagctcaagcactgttcgccccaggtcctggtctgtcctggcacaagtttggtggagctgcgaggtcatttattgggccgacaagcaagcctgggcctcctgctcctttcacctcccgcggccgctaagacctcctccatttgagttcctgcccgttacgttaggggcaatttcaaactgttgccttttccgtctttgacgcggctctggcgaatactatcggttcctttttcatttt

SEQ ID NO: 62528 - DNA, 698 bp, Triticum aestivum
  Clone ID: PAT_TA_62528
aatctcgtcctatactctagaaaaacacatattcttcaaagcttcatctatagaaagatcaatcatcatgtcaggtcccggtgttggttttgagtacccgcccgtcgaggtcaagtggctacagcgcgacgtcctactattcgccaacaccatcggcgctactgttgatgagttacacttcctttacgagtttgaccccaagtttgccgtcttccctacctaccccgttatccttccttttaagaaggactcccaagaagtagttgactactacaaggccagcaaagccgttcagatccctggtatccccaagctcgactacacgcgtgttgtcgatggtcagcgaaagattgaattcctcaaggccctcccaaccacctcggccggccgcaaattcgaaatccgtcaaaaggtcattggtgtctacgacaagggccgtcccggaactgtcctcgagaccgagaccaacctagtcgacgtagagagtggcgaggtgtatacgcgcgtcatcagcagcggcttcttcatcggtcagggtaactggggcggtcccaagggtcctgccactaagaactaccccccgccagaaggcaaggctcctgacgctacgattgaggttcagactacgcctgggtcagcgcttctctataggttaaacggcgactaccacccgctacatgctgaccctgcgcctgggc

SEQ ID NO: 62529 - DNA, 220 bp, Triticum aestivum
  Clone ID: PAT_TA_62529
tttttctcggaaggaggggaggatagattttcatggcgcccgttgacttctgtacatattctgcatctaggtgacctggatctggctttttaccacaccgtttaacccagtatccccccgtttattctataacggtcatcctacctacctttttattaccagttccgggacctcgcactcatacaaaaaagggggctttgcaaatagacacaatttcctg

SEQ ID NO: 62530 - DNA, 515 bp, Triticum aestivum
  Clone ID: PAT_TA_62530
ctaccggtctgtgtcacatatgccagccgctgctgttcccgaaccacaccgacgaactagcaccatgtctggagcgcttggtcactgggatgaacccaagacaaagtcaactatcaacatcgtcaccactggtgatgggtcagacgatgatgacgaggagggatgggaggcgatgaaggcaaagcgcgataagaagcgcagcatgtggaagtcaaagaaaggactaggaagcgaatttggaacaaggatataatcaaaaggtcaatattgttgagaaattactacaaaagagaaggaggtcaagattggtttatatgcttttattttttgcatctggatatccacaggttggaatagctcaaccttcgtttggagagcctcatacaattgtatattctagaaagtgtgcttttcacgagggcgtcttcggggaaagatatgacaggcaccggctccctggcgcatgatagataaatcttttatgccggtaattgactaattgggaggtcaccttt

SEQ ID NO: 62531 - DNA, 486 bp, Triticum aestivum
  Clone ID: PAT_TA_62531
gtcttctctctcagatcatttttcatcagtgacgcgctcacatcttcgctcagtggaatttcatcgcgaagcaactcacgactcgttttgaatcggcctccgctactttgcctatagctcaacaatcctttaccaacacgttcgcgctcgccgccctgctcgcgctcctcgccgcctggtgcgcgctctacctcctccgcgccgccgacgcacccccgctggaggcctttgggaagaccttctccgagagggagacgctgggcgggctcttggcggcgtcggcgttcgtcgtgttcgtgacctccgtcgggtccatcgtcttctccgccctcgcggccggcgccgcgctcgcctgcgcgcatggcgcgttccgggtgcccgaggaacagctcttcctcgacgacgacatacagcctggcgctggaggaagagtgggctcctccgtcgacctgctctccttcttcaccaacgccgccggaggaggag

SEQ ID NO: 62532 - DNA, 178 bp, Triticum aestivum
  unsure (1)..(178): unsure at all n locations
  Clone ID: PAT_TA_62532
ntcatagtccatcctcgacctcaccaccaaaaaggacatcactagcctttcatcaccgtatcctcaaccctgaaaagatctgaaccccttcgtactttgaataaacaaacctagtttaatcccaataaacccgaccaccatgaccacaaaacagccctatcccgaccacccagccaac

SEQ ID NO: 62533 - DNA, 656 bp, Triticum aestivum
  Clone ID: PAT_TA_62533
acagcttcaatcatctaactaattacagtatagtccctactaaagttattagaaagttgagtcacttattttgaaatgaaggaagtacaacccagtcacattacgatggcgtccttggccagagctggccgtttcatggtgctcctgcagatcgcgctgttcgtcgtgtccgcggtgatcatgagcggctccgtctgccacgaagtcgggatcggtcccgatgctctcgaccctagccgccgccctatatgcggaggcagaccatgcggacagcgtggcctaccgtacggcggccggccctggagcccctccgccgtacgatggagggattgggcgaccatgatcatagcagcacaagttgctacaacaaccttactgaaccagccgggagtgtgatatccggtcgtatgaataaactcccgtttattactgcaaataaaactgcgagtcttgcccccatatacgaatgggtgtgtgaacgtgaaagtttggttccgaattatactactgataaagatggatagtgtagtaagtgcaattgtttatgtatttgcagtctggactcgggctacaaggctgcctcgtgctattttactctaggcaccaaggtgggcacatacatgcctgcaactgtatgcgtccccatccccatcgat

SEQ ID NO: 62534 - DNA, 201 bp, Triticum aestivum
  Clone ID: PAT_TA_62534
actttctcttcctcacgcctgggcctcatccttctccctccctgccgccttggagctccggcgccccgcactccgtcttgccggccggcggcggctctggcaggcggagcaaagccaccaaattcatggccaagaacagagcccgtaaggacgccgcgaaactccggccatcggtcacctcgccgccgccgcagaactccc

SEQ ID NO: 62535 - DNA, 200 bp, Triticum aestivum
  Clone ID: PAT_TA_62535
atcgatactctgccattcatttccgtacatctctcaatcacaccaacgactcaaaatggaactgatcttcctccttaccgcaggttctcgttgctgctcctgtcctgggcgcctccagcactacaagatggactgacaccgccaaggcgaccaccaccagagcaccctacccgacctccaagccgctgttgctcctacta

SEQ ID NO: 62536 - DNA, 783 bp, Triticum aestivum
  unsure (1)..(783): unsure at all n locations
  Clone ID: PAT_TA_62536
acttgctcatgggaatagcttcggcttctcattgtctatcgttggttccgtgcatgggatggccgcggtgtttgatgccttttgacactcgaacactcgtcatactctgtctacccttaaccctcaatcgcatctgtaccccaccacagctgtttcgtcaaaactaactccagttctccttctagagcagaccggtcgcatcaacttcaaccttttcgacgatgtggtccccaagaccgctgagaacttccgcgctctctgcactggcgagaagggtttcggttacgagggctcttctttccaccgaatcatccctgacttcatgcttcagggtggtgacttcacccgtggcaacggcactggtggcaagtccatctacggtgagaagttcgctgacgagaacttcaccttgaagcacgacaagcctggtctgctctccatggccaacgccggccccaacaccaacggctcccagttcttcgtcaccaccgtcgtcacctcttggctcaacggccgccacgttgtcttcggtgaggtcgctgatgaagagtcccttaacgtcgtcaaggctcttgaagctactggctccggcagcggtgccatcaagtacacccagaagcccaagatcgagaagtccggtgagctgtaaacagctgaaactggacgacgtggtgagcgggaatttgngattgcacaacaaaacctcacttgagggctggcgacatggagctagttagtcacaggctagtagaagcatctagctattgaacaatgtggaccaat

SEQ ID NO: 62537 - DNA, 673 bp, Triticum aestivum
  Clone ID: PAT_TA_62537
aacaccatcccagcccccacctcccctgcctccagcaaactcacagcccccaccaccgaagctcccaaccccacccgaagcggcagccatggcccccaaggcagacaagaagccggccgcggagaacaaggtcgagaaggcgacggagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccctgacatcggtatctcttccaaggccatgtccatcatgaactccttcatcaacgacatcttcgagaagctcgccggggagtccgccaagctggcccgctacaacaagaagcccaccatcacctcccgggagatccagacctccgtccgcctcgtcctccccggggagctcgccaagcacgccgtctccgagggcaccaaggccgtcaccaagttcacctcctcctagactgacgatgcgtcgcttgttgcgacagatgtggctgtctgatgtatctgctagtacaaatagcagctcgtgcgctagaatattgccaacgctttgttggcttcttggctgcgagaactgaac

SEQ ID NO: 62538 - DNA, 686 bp, Triticum aestivum
  Clone ID: PAT_TA_62538
aaaaaaaaaatccacactcagcatcagacactccgcttcactatccatcttcaccctcacaactatcgaacgatacctgctatacaacatccgaatacacgaggcatcacaatagctgttgctagtttcctgtttccgaaatctcctagattaaacccgcccttgcttcgccgtgcggccccgcgtcatggggttggcttacaacacctacctcagcagcagcaagatctacggctgtaagacatgtaaagcgcatcttgctaatcatgaggatatcatcagtcgaaacttccgcggacagcacgggaaagcctatctcttccacagcgtcgtcaatatcgagacgggccctccaaacgaacgtaatatgacaactggccgacacgttgtccgcgatatcacatgccgccagtgtaaagaaactgttgggtggaaatacgacaaggcatatgaatcatcagaaaagtacaaggagggcaaattcatccttgaagcagagttgctttgcacggttacctgatgaggaagggcgacgatggcactgttggaggctactctctggaacttggcgtttttggatatgtgtaagggcgttggattaattcggtatgctgtggcattggtgttaacttcgtgattggacaaggcacgcattttctgttgtcttttaaacgtttcaatataac

SEQ ID NO: 62539 - DNA, 599 bp, Triticum aestivum
  Clone ID: PAT_TA_62539
actgccaattccatcaacctagctagctagtcatgaagatggatccaccacccaaaatgcttgcctctctcgcaatcaccatattgatgatgacgatggccatctctgtcgcgcttgcgtcggatgcagcggtgctcgaaggacaagcaagagccttcctcatctggaaagatagcctcgacaaccaaagccagcagaccctgcgctcctggggaaacacgtcagagccctgcaattggcgtggcatcacctgcggtaccggtgtgcaccggcaccagccagtgatcgacggcatctttctgcgggggatgcggctgagaggggtgctggaatccctcaactcctcggccttgaagaccttgacgcgcctcgacctctcgtacaacaacctcactgggaacatccctcctagcattggggtcctcggggagctccaagctctgcttatgcaaggcaaccagataagaggctcaattccaccaggtctagcaaacctcacaaaattgtgttttttgatgcttcacgataatgaagtctctggtgaaataccaaggcaaataggcaatatgagtagtcttgtgaccctcaacttgtcaagc

SEQ ID NO: 62540 - DNA, 597 bp, Triticum aestivum
  Clone ID: PAT_TA_62540
agagtgcgtgcgtggtgcttacgtctctgttggttaaaaaacggctgtaaaattctagtctggtgtggcgttgtgtgtccagtttgagataatagaaaagggctgcgttgcggccggaaaaatactgctgtgcttcttctatttttatccttcatccggtgtgtgagagagcggcaacaacagtcccctccttccacgtatcagaaggtgagcttcgtcaccgggaaaccgccgccgtcggctgcggcgagcgcattattggcgtcgcgcacaatcgcagggcgcctcaaatagctgtctaggtggtcgtaggtgtgagagagagctgcaacaacatgcagtaggggatcatgcacctcccgtagtctagccactcgagccggaactcctctgcctcggagaggtccttcactatgcacacatcctcatcgaggctcgcagactcctcctcctcctgctcctcctccaacttctcgtcgtcgtcttccgggctgcacgcggcctgcaaggtgtcgtcgtcgcgcgtggtgaaaccggtgccatagctcacgactaaggtaaacttgttgggcagggacggagacaaggggggacgag

SEQ ID NO: 62541 - DNA, 491 bp, Triticum aestivum
  unsure (1)..(491): unsure at all n locations
  Clone ID: PAT_TA_62541
naattcacacaaaggcaacgctacaccaagatcattatggtttcggccatgaagctgtcggtcaccatcgtcctcctcctctcagggctcgtggtgttcggggagaccgcggacgccaaggcgaaggcgccgtgcgccgtggtgtgcttccagggaggccacatcacctgcgacaactaccccggccaggagctcgacgggtgcgactgcgagtgcgcgccggccgacggcaagggctgcgtgctccacctcgacgacggcgtgacccacaccaactgccgcacgcccaatatgtagctgaattgttggttcgagtttgagttcaataatgttcggtcgagtttgttgtccaataacgaaagtgttcgcgtgtgtgtagtttggcagtgtaattcaacttacatgcttcgaataaaattaagtaaattgcacgctataccgagacgcaatatttataaataaacctaaaaaaaatacccgttccaatttgt

SEQ ID NO: 62542 - DNA, 778 bp, Triticum aestivum
  Clone ID: PAT_TA_62542
acgcaaatcgttctattattttgccaggttctccaaaatgtccagccaggataactcaccatgtcggattcttgtcatggcctcaggctttggctctaatttccaagccatcatagatgcgatttcctctggatctctcccaaacagtcgtatcatttctctcatcgtgaaccgcaaaagtgcgcatgcgactgttcgggcagacaaagcaggcattccatgggaatacttcaacttgattagcggcgggttcctgaagaagggagagtcagatgagcagaaaattgtcgagggtcgtcaaaagtacgacgccgcattggcagagaagatcctatcttttttaggtgaagcctgaacttattgttcttgctggctggatgcacgttttctcgactgctttccttgatcccataaagaaggcgggcatcaacattattaacctccaccctgcgcttcctggagagtttgacggagctagtgccattgagcgagcctacgatgaattcaaggccggacgactaacacgctcgggtatcatggcccactacgtaattgctgaggtagacaggggtactcctatcctagtcaaagagattgagtggaagggtgagagtcttgaagagtataaggacaaggtacactctcatgagcatgagctgattgtgaacgcaacaaccaaggttgcgcaggagacagttcaaaagagggcatcatagcgatgaggtggcgcctttgaagcataaagataagtgaaacaaaaagaaaacatcatattccc

SEQ ID NO: 62543 - DNA, 437 bp, Triticum aestivum
  Clone ID: PAT_TA_62543
accttcggatataaagctacacaagttccttgttgagagtttgatttcgaactgaattcaagtgttcttttgctctcattctttttattttatcttctgtctctttccttttttcttttattttcttttcttttctttttcatctactaagcatcggaggaggcgttctcatgaaaacactgcggtttctgctatgttcaatgctccaatctcgcaaacgttgatgagtagagacactgcattcatcttttgttttctttttcctaaagtacgatgcattggaaatacaacagtcatggtttagccatagacttccactctggtacgacttgacacttgaaatgggttttaaataagaaagacatatataggtattcagagatgcattttagaaggacacactacaaacatacaatacagaaaggacataactacat

SEQ ID NO: 62544 - DNA, 690 bp, Triticum aestivum
  Clone ID: PAT_TA_62544
taggtgcactataacgactgggtagtccagcaagatggctccgaccctgttcctcttcgatcacgtacctggcatacgattccaatttcacgtttgaacatctggaagagtcaatcatagatactgccttgtggggagccgatgatcctcgctggacaccgccatcatcggttatatgcctttccggtatcaatgtttgcgacttatgcagcgaagtacaatccaacgaaagcgcggtcaacgcctgtaaatgtttccctaatctctttggcgtgccgaggttaccaatcgcagtccaagtcttctgcacatccaacggtcgcaacaacggcctgcaagccctggtagcgttcgaaaggggcactgcgattggagagtttgtcggcttgatcaccaaagatatcgaagaacaagacgttatggatagtcaagtgggcggaacaagatatcagatctggcagggcaagcagggtaactttacccggtttgcaaaccacagttgcaaaccgaatgcacagtttaagaagttcgtctggctcgggacgcagcacatcgtaatggtgagtaaaggcatcgaggcggggacggaaataacagtggattataccgagagttattggcgggggttggacaagaagtgcctttgtggtgaaccttgttgcagggtacacaagggttgataatgggcgg

SEQ ID NO: 62545 - DNA, 521 bp, Triticum aestivum
  Clone ID: PAT_TA_62545
atattccccctaatccccacctaaaacccaaaacaccaaaacgaaaaaaaaaaatcgaagctattaaatacatccatctctcccaactcaacaaaccaaacaaacaacctctttctccctttcacaaccaccacaaataatccaaaatgtctctgcactaccttcctcccgtcaagccctccgccatcgctctgggcactgctttcaaccacggtgttgagctcgccgtcctcgcccccatcttcggccagacctaccagcgcgccaagtcctcaaacaccaaggaggagttcatccgctccaaggaggcttctggcgctgctctcgcctgggttttttccctgaccggctctgccctccaggcctacggtgtcggtgctctcatcaacgccactggaactctcacctacaagggcgctgcttacctcggagctctcatcttcttcgctacctctgatcccggctacgtctctcaaatcttcgttgagaaccgacctctcaacaccgtcggcgtaagcctg

SEQ ID NO: 62546 - DNA, 621 bp, Triticum aestivum
  Clone ID: PAT_TA_62546
gttttctcccaagctcctagctgcttctcttcctagctaatttagtggcagcgagaacagagagagagacacgtactcagagtctcagagataaccggactggaatcatgaccgccgtgattgcaaagctcgttctgccggtgatcgtgatgttcatggtgttctcggcggtgctcgtcgcggcgcggccgctggcaggagagaatggggcgccggagaagtcacagccggagactccgtcgtcggattcatccggcaggtgtatctccagcggctgcaaggggcgccaggggcaaatcactcgtgctcgacctggagcccaaataataaagggtgcccctgatagtctgcacaaaccggcgagaggctaaatttcatattttgagcctttttcgatatctattcaagatctaatcttagtttgaatttttttcgagatctgacccttttgttaccgtcaagatccatggtggtagagtataactgtctactgccaagatccctggcggtagggttgcatgcttgtcgcaaaattttgctaagtattgaacacaatgcgtgttcgtgcctaccgtcgagcacattggctgtagggttgtacatactaccgccgttctgttt

SEQ ID NO: 62547 - DNA, 360 bp, Triticum aestivum
  Clone ID: PAT_TA_62547
atactcgcgcgatccagtggggtgtagagtatatcgatgtagagctgtggctccctgaagaatacgcaagaagctgtatgaccaacgaggcaactcccgcattatgtcggcattccatgacttctcaggatccttccgatggccattggcgtacgctcaggaggtgtttgagaggtctacaccttatgctgatatcatcaaaatgattgccatcatcaatgaacacaatgagaatttcgaacttgagtatttccgctccaaaaaaaaaaaaacaaaataaaaaaaaaaaaaaaaaaaataacacacagaaaaaacaaaaaaaaaaaggcccctatgttccctcattggccgccaccaccc

SEQ ID NO: 62548 - DNA, 642 bp, Triticum aestivum
  Clone ID: PAT_TA_62548
atatcagaactgtaaaatgttgctcaaagagactcacgtcgatgtccctatgactgccaatggcaaggatggtactattgcgcatctttcgtctttaaccctacaattcctggataccccaatgcacgattaccacgcgtgagtctcttcagtgagatttaccaagtctccggtcctgtgtgtcgctttgaccgccagatcgctggtcaggggtacatcgttgccgctccttcatcataccacgacttacacaggtcccgaggatctcaagtacgacgacgaggacacatgatcgtggcaacaaatacaagatacgaaaagagcctcgagccttactactctgattcgtatgccactgtctactatctcctctcacttcgcagttgcacaggacacattggttccacaggcatgtgcctcggtgatcatcttgccgtccgtgctgctcttgatcctcgcattgctgcttgcgccagtaacttcgctactgatattcactctcgcactctgggtcccttcgatgcccccaacaattcctctaccgtccctgccaacagcaaccacactcaggaccttttccacaagttcaagggcgaggctgaccatgatctttgtagtgaacgatacccacgtccctgacgt

SEQ ID NO: 62549 - DNA, 688 bp, Triticum aestivum
  Clone ID: PAT_TA_62549
atacaactggcttggaactcctcgcgcttctctaaccagcagacacaatccgccggacaagatgaatgtcctcgaggccgccgcgagtcgccatcatcacccgcggcatagacgccgtaaaaaaggccgtcatcatccagtccgatgacaacggcaacaagcctcaccctttctgccacctgctgtctgccggtattgagcgatgacccctccgaatgatgatccgccgcatgtgcaagaccctgcactagaacccaaactagagcagggccttcatcaaggtcgtcaactacaaccacttgatgtccactcactacactctcgagacgcaagggactcaaatgagacggctccaacgacaccttcaagagtaggtttactcgcacgcgacgatgccgacaaactgattagaatgcgctcgaggagtgatacaccgtcgatgaaaagcgatgtctcgtcacccctctcaagtcatagagaaggaatcgtttctccatcaagcttaggcagctcgttgacatgtaaagaatatcaatggtatcaaggaactccgagcgttatgggatctatatgaactttcttaaaacaagatcagatctctacttagccccgcgattgtagcgtctatatacaacgtggatctaacggacgtgttggcccgaccgaagcataccaccggtggagctca

SEQ ID NO: 62550 - DNA, 374 bp, Triticum aestivum
  Clone ID: PAT_TA_62550
aattccccaccaacagtaaaaaaaaagaacgcaattcctcctcctacttgtccgtcttcggcacagcccttccaccaaactccgcgcccccttcgcctcgcagtaaagctcgtagcgcgcggccatgccggcggcaggtgccctggtcgtgtacagggcggtgttcgccgcgctcggctgcctcatggtgggcaccctggtgtacacctgcatcaccgacggctcgccgttccgcgccgagctgctgacaccgtggatgatgacaacactggttgatttttatgtaaatataccacgcgatttcgacttgggccgcctacaaggaaggaaattgtattatttctatcctctggccagaactgcgggattgtttc

SEQ ID NO: 62551 - DNA, 579 bp, Triticum aestivum
  Clone ID: PAT_TA_62551
tttggcatcagtcaagcttgttctgaagaagacgttcgacgatctccgtctctactttacccatcccgtcttctttccttctttcgcagtggctcttctttactgcacagtcctatcatttggcggagtcatggttacttacctactatcaagcggatacaactcgattcaaattgctgcaatgaggacaatttctgtagctttcgaggttctagctacttggattggcccatggctaatgaagaaaattggtccggttcgcgcaggactttggttcctgagctggcaattgggatgcttatcaataggcatatcgatattctggagatatgctgataacgtcctcgtatcaactctggcactcgtgggaagctccatgttcagtcgtgtcggactttggggcgtcgatctctcagcacaggtcatcatccaagaggaagtcgaggcgcaaaatcgaggagccttttctgctgtggaagctagttggcaacatgtgtttgagatgtatgcatacacgtcgaccataatattctcgtcgcctagtgagtttcacaacccgactgcactgagcgtcgcggc

SEQ ID NO: 62552 - DNA, 432 bp, Triticum aestivum
  Clone ID: PAT_TA_62552
cgaccctgatgccttcagtctgctgaagtcaccaatgacgttcccggtgttggcttcggaggactctcactcgccaccaacaccgatttccctctcactgtcaagatgccccagggtatgacctgtgagggaactgtaggaggagccaacaatgtctgcattgttcgtgtccgaaacagcgctgctgctggaccctttggtggctctggtgcctttactcagtccgcatctgctcgcaagcgcgctattgctttccgcctcaagaagcgcatgcagattgttcgcaactagaggactgcaagtcattggatgacaggtcggccgggaattagttagactgtctatacgaatgaatgtgttactcattcgatctggagtagagatatgagcttagcagtagtctatacgaatacatgaatcaccgcttccttg

SEQ ID NO: 62553 - DNA, 337 bp, Triticum aestivum
  Clone ID: PAT_TA_62553
tgttcctaagaaggagttatgataatgtcaaaatacgccttatagtttgatacaatgggagtaccatatagaagatgggttcatggtttacaagaaaaaaaaaaaaaaaaaaaaaaaaaaaaaaaaaaaaaaaaaaaaaagaaaaagaaaaaaaaaaaaagaagaaaaaaaaaaaaaaaaaaaaaaaaaaaaaaagaacaagaacgcaaagaaaaagaaaaagaaaaaagggccccggggggcctgagaggggcggacagagggaagcgcgcaaccccaacaaaaggttgggggggaccgggggcgaagaaagccaaatcgggagccagaaaggagg

SEQ ID NO: 62554 - DNA, 730 bp, Triticum aestivum
  unsure (1)..(730): unsure at all n locations
  Clone ID: PAT_TA_62554
ngattcccaatcaaccaacaactttaaattacctttacagcaggatctcggtattgtggcttctgtgtttgacaccctataacatctttgcaacttcgagagacagtcaaatactatccgtcaaaatcatggatcacgtcgacagtcacttggctcaccaagccagccaagaaaacgtatccttcttcacacctctcaatctcgtccttatctgcgccgtcctctacacaacttatgccctcatgcgctcctcgccaccgccttcgcttccccgcgacactccatcaaccgtgttccgaacatacaacccccacacactcctccccttcaacggcgaggagggacgccctgtctatctcgctgttcgcggtcgtgttttcgacgtctcacctggccgcaacttctacggccctggtggtccgtacagcaactttgccggcagggatgcgagtcgaggtcttgcatgcggcagcttcgatgaggatatgctgaccaaggatcttaatgctccgctcgataaacttgagggattggacgaggagcagatggatgcgctgcggggctgngaggagagattcttggagaagtacaatgttgttggaaagctagtttctatgcaagactacgaggcgcagaaggcttaagtcatgtanggacgtcatcgcgacgagactaggtttccagacatacagacatacagaacgcatagaaacgataccatgtcacagtg

SEQ ID NO: 62555 - DNA, 702 bp, Triticum aestivum
  Clone ID: PAT_TA_62555
aatccttcctccatcctcaacccatcccatcttcaccttcaaaatgctgtccaccctccgagtcgccagccgccgggctgcccgccctgcccagtacaacctggctgccattcgcgctgcctccaactgggccaacgtccctcaaggtcctcctgatgccattcttggtatcactgaagccttcaaggccgacaagttcgacaagaagatcaacctgggtgttggtgcctaccgtgacgatgctggcaagccctacgtgctcccttccgttcgtgaggccgagatgaaggtcgtcgagtccaagttgaacaaggagtacgccggcatcactggtgttcctgagttccctcccgccgccgccaagctggcctacggcgccaacagccccgccctggatcgcatcaccatcacccagaccatctctggtaccggtgctctccgtgtcggtgccgctttcctcgccatcccgcactcgcatcttctgtcgcgctggagacaacatctgcgacggtggcatcattgttacccccgcgcacagccagtaccagcaagatgctcctgctgctgctgagtggattgctgcccgtgtttaagttattaatgtatggattgactctgtactatcggaatctgctgtctgctacatgtgtatacatgactttgtggatcaccctaaatcgatacaatattataacatgatta

SEQ ID NO: 62556 - DNA, 598 bp, Triticum aestivum
  unsure (1)..(598): unsure at all n locations
  Clone ID: PAT_TA_62556
ggtgcagcggaggcgctgttcttcggcggtgtatccctcgggctgctcgacctcgcgctcgggtgctatcttccctggttcgaagcgataggccgcctcgctggcacgccgccgttcctagacgcggcgaggacaccaaagttggccgcgtgggcggggcgtttcagggccgccgagccggtcattgcgctgctgactgcggtggacaaggtgtaggagtacatcactaaggtgctttatccaaagtggaacgttgcactaactgcaccgccaacgaattttcggacggagggagttggtgttttcacgagttgttgtgctcgttgattgattantctccgcccctcccgtctcgtcgtcatcgatggtgcgcacgcgtgcactgtattatttgatctgagctgttgtttcatgaataaaccgtagcttcttgcttcttgcatctctttggcaaggtctcaaggatgacactagttgtactctttttactctgcatggtttgtcttttttgattggatagtcaccttattctgctcttancccacccccccccacctaaactttcctatccctccacgggataaatatcatcaaacaa

SEQ ID NO: 62557 - DNA, 769 bp, Triticum aestivum
  Clone ID: PAT_TA_62557
gactagctttggtatagaattgtacaactgacgatgagccacacccctgtcgaggggatcctgattctccagacgccctgcaacatgctaatcctctcacacgctaacgcgtgcatccaagatatgctgcgacgactggacgaacttctccacctctacgaggtgagacaacagatcgactcagcgcagcccacagatcgccaaactgccgagtctcggatactagacccagcaagcacatccccgcgcgccgatagcatggaggagacgacgcacgccctgacctccttgtatagttaccccccactcacgcgcagaaattcaaaagcctcctccaactgatgccctcgtggatcaccagcataatcatggcgtctgtcttctctgaaatgaacaccacccccacgacaaatggtggtttcatggaaatgaccatcctgatcttgtcgtcgtccgacgaagacgctggtcttgttccaggagaactgcgtcgtgacatgggagctcctctacgacaaggcgatcgagcctgtgtttatgagcttctccacgagcgatgacggcgagcctgtcagggaattcagcccctggatccctcaaacgcacgcgatctggtcgtaacgaataacacgaacgcactcgagacacagtaagcgagaacacaggtttttggcgacgcgcactaagagcgtcctatctgtttctttccctagtctcctaggaacacgtacaacagatcgtagcctattccattgctagaattcacccc

SEQ ID NO: 62558 - DNA, 622 bp, Triticum aestivum
  Clone ID: PAT_TA_62558
cggcgggcgggattccacatcggcccgacctcccagatttaccgaccccatggtcttctcgcgccttctcccctcccgccgcctcctctccgccttcctccacaccccgacgccgatacccgccgcgcgggccagcgggcccgccgccgcaaccacctccccgatcgcacaaagcctccaggccgggcgcttcttctccgcgacgaggcgggacgaagccgggcgacccgcgacagcgcgcggagcacatcggggcgcgggcgcgacagctgcagagacggcgcctcgaggagctacgcgctcaccgttcggatgcgagggcgagatcaggccaagcgtgtcctccattttccccccccccctcgcgatctacctcacccgcaccgacggggtcgagcgcttcgccaccgacccctccaagacccgctgccgccgcggggatgtcgtccgcaagggatccggcggccacccctcctcctcctcctccgaaatagagggcgccgtcaacgacctcgaaaacgacgacctagctccgctacgagggagccctccccgacctcttccgagagggtcactccgtcgccctagaggggtccctcaagccactcacggacgagctccg

SEQ ID NO: 62559 - DNA, 608 bp, Triticum aestivum
  Clone ID: PAT_TA_62559
atttcactcacgccacaaacagaaataggaattccagagaacagaagagccaaagacactaaaacgaaatggcatcctcctcttcctttctcctccttgctgcacttcttgcgttagtctcatggcaggccactgcttctgatcctagcccactccaggacttttgtgtcgccgacatgaattcaccaggtactatccgttttgtcatcatgttttcaccaaatacatatgttgaaatctatttctggtaattatatgcgagtcgaaacaatgtaaaatctgagattacatgtacatctcttttgcccccagtccgtgtcaatgggtttgtttgtaagaacccgatggaggtcaatgcagatgacttcttcaaggcggccaacctcgacaagcctagggtgcccaacaaggttggatccaacgtcactttgatcaacgtcatgcagattgctggactgaacaccctcggcatatcaattgcgcgcatcgactatgctcccttgggccaaaacccaccacatacgcaccctcgcgccactgagatcctcacggtgctcgagggaacactgtacgttggctttgtgacatccaaccagcccgcccccaac

SEQ ID NO: 62560 - DNA, 551 bp, Triticum aestivum
  Clone ID: PAT_TA_62560
tatccccatcccccacattcaaggcgaagattctcctcgatctccatcactggaaccagccacttgagctctgaatctttgaggctcagtcagctcgatcgcgaccaccgagagcctcaagtttcgccatgtcgagagccggccataagcagcactaacaatatcaggagaagaattcggcggcggggtaggacgccacagatcaacaacgacttctcccgcttccacacggcacgcgagcggcggatttcgccttccgagctggttgccgagtctcgagccatcccgccgccggccacctagtccgcacagtgccgcgaggtggcgctgatgttgaacgagttcgagaccgaccgggagggctacctgcatatcagaagagctcgacggcttccacgtccgcggccgctcaggattgctgagatcgacgccgagctgcgcgacgtcttctacgtctacgacagcaacggcgacggccgtgtctccatcggcaagctcatgaacgtcctgaggcgcatcgacaaggcatgcagcaccgctaatacgagaga

SEQ ID NO: 62561 - DNA, 824 bp, Triticum aestivum
  Clone ID: PAT_TA_62561
atgtcgcttcataaaactgccgtccttctcttctcttgccatgctttccccgccgtctcaagtctcccacctctacgatctataacgtcatctagaggggtacgaactagctatgctccagcaacgacttgctcgacagaacgacataggcgatatgccacagtaaatagcgaccagcgaggaagcttcagccataatgaggtccctcaatggcccaagcatagttatccttctccctacgagatcttctccatgaagagtgacgccccatataccaagcatcgattctaccagcttgtcaaagtctaccatcccgacagacatatccatacttctgatattgataacatcccccatgctattcgcctagaacgctatcgtctcatcgttgctgccaacgacctcctcagcgacccctcgaagcgccagctttatgatgtccacggtctaggttggactggtggtaagccccagacactcaacgaaactgtccgtagcgccgatcgtgcctggcgccacaaggctggatccgctgcgaataacgctacgtgggaagactgggagcgttggtacgatgctcgcgacggcagggtcagggacactgggcacatgtccaatggtttgttcgccacaatcgttgttgtcatgtgtatgataggcgccttcgctcagatgagcagagcagagcagtatggcgccgaccttatggaatgaaggcacagtccgatcttgccattggacagcaggttgcacgtcgaaacacgattgctgccggtaggtcaaaagacgagagggtcgatatggtcttgaaggacagagagaac

SEQ ID NO: 62562 - DNA, 793 bp, Triticum aestivum
  unsure (1)..(793): unsure at all n locations
  Clone ID: PAT_TA_62562
agttctaactacctcttaataatcttcgtctagtagatcctagagctcaatatggttcaccccaaagctgaaaaggcactgcaggaggccaaaaggctcgtagctcaactagaatcgtacgacgacgaccccataactcaccaaaatgtcctcaagcagacagaggccgttcgcttagcgattcagtctcccatggaccgcatgacacatctaatggagcaagtcagtttttgtggtgccttccatacgataattggggttcgagcctaccatgccacgccggcagatggcagctcaattaccgcagaagaactgggacggattaccaatgtggttacgacggtgatcgaacgagtgtatcgggtcgccatcagccatggtgttttcattgagacagcacccgacacttacgctcacaacgacttgtcacgaattctgaacccgaggggtctggggtcgttcttcctcattgttgtcgagtttggtcgtgggttcatccatctagccgactactgcaaatcgcaccagccagaagatatctttgatttgaccaagtcacctgctgtgtactcagtcggaaaagaacatctcgggaaatcttactatgagcttctggatatagaccctgaccctgagcgtcgcgagctttggaatgccaacatggtcgctgttgacgagttgatgccagttgntggcatgttcccattcgcctctctaaagagggaggtgagcaggatccaggtcgaccattcttgggtgatatcgntgctggtcgtggacaatcatgcattgc

SEQ ID NO: 62563 - DNA, 824 bp, Triticum aestivum
  Clone ID: PAT_TA_62563
gttgcacgcccacccaacgccgacgcgagctctcctcagcccagcacagcccacacaccaccgccaccagcgagcgcagatgtttctcaccgacaagtaccacgccctgcttcctcctcactccgcccccggcagcatcgatgatcaggaaggtatcgagcgcagcactcaggctgtgctggatgactccaagatcgaggaggagctcgggtcggacaagtacgacgccgttctagtagcgtgcttcagcgtccactgtttggtccccaagctgactaggtaccgtcatcttgctgtcaccggtatctttgaagcaagtattctcacatctttttctctcacggccgcacaggagaatggcgctaaatggggcattgtcacaactggaaagttctgggaggaccacttgtctgatggtgtcaagaagtttttcggtcaagaaaagggcggagtcaacagcaagttcgctggcgtcttctcgtcgagcctcacagctggtgattttcacactgttccaccagagaaggtcagagaaaagctcaaagaagcaactcaaaagcttctcgatcagggtcaggtcaactgtgttgtcatgggctgcggtggtatggctggtctggaaggcatcatccgctcgacggcggtcgagcaatacggtaaggctgatggcgaccttgtctacatcgttgatggagtcaaggctggcgtcatgcagttggagcaaatgatccgaagcaagcgagcctttaggtaaatgtgccagagcttgttctatctgtgaagccatgtctgcaaatacctagaaatgtctactacatgaatac

SEQ ID NO: 62564 - DNA, 798 bp, Triticum aestivum
  unsure (1)..(798): unsure at all n locations
  Clone ID: PAT_TA_62564
ngataccgtatatctgtttgtatatgatgaacttttgctcttatgacctttgattaaatatattaattgcattgatttgtactttgtgtctcttgttccatctgaatagatccatctatacccaatcgatatgagaccttcaacgcgccttggaagcttgatgcttcgtcgaggctttgccagttcagcacgacgactggataattacggcttcatcggtctgggacagatgggatatcaaatggcaaagaatcttcagtcaaaattgaaaccctcagataaggtgtccatctttgacattaatcctgaatccatgaaaggcctggaaacagaaatgaaggcagcttcgtcaggagctcaggttgaactggcagccagcgcattcgacgcttccaaagatgctgataccatcattactgttcttccagaaccccagcacgtcaaaggcgtatacaaatccatcatcacctcttctctacccaaaaaggatcaagtttttatcgactgctcaaccattgacccgtctacatcccgccaggtcgccaagactgtgtcttcagctagacaaggcatgtttgtcgatgcgcccatgtctggaggtgtcgtaggcgctactgctggaacactcacctttatgctgggcgcctcaccatctctcgtcccccgtctcgagcctgtcctaatgctcatgggcaaganagtgctacactgcggtgaacaaggcgccggtctatccgcgaagctggccaacaactatctcctggcgctcacaatatcgcgacggcagaggccatgaac

SEQ ID NO: 62565 - DNA, 499 bp, Triticum aestivum
  Clone ID: PAT_TA_62565
aattcccaagaagccacaagaagctcatagtcaaccaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcttgtaccgcgcgcgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaacg

SEQ ID NO: 62566 - DNA, 824 bp, Triticum aestivum
  unsure (1)..(824): unsure at all n locations
  Clone ID: PAT_TA_62566
ngacatccgacgtctatcttgaattcgcgtgacgtcttttctcattcacccggcaattgagcgcacaatggcttcacgagtggtgttctcaaggcgctctctggcgcctttggcgactatggcccttggtggcctggcactgactccggccactgttttcgctgaaggacctagcgacctcaagcgaaaacccatttacgatgacttcgagatcccagcttcaaagcccgcacccgtgacgccaccacccgctgccacgacgcccgtcgctgagcccgttgaagaggaggagaggcaatattcgcctacccctacggaccgattggctgtctatgtcggaagggggcgcctgtctctgtacaagtacgctgtcgctgccgagaacaagatcaacgagaccatggattcggctttcaacctcgagcagtcctttaccagcaccatcgcttcgctggctccctctcgcgaaagcggcgagcagctcatgcccggcgctatctacgtcttggttgctgccatggccggtagcatcatcacccgcaatcgcagcatcatcctccgtgcctcgctccctctcgccatgggtatcggtgctggctggaccgttatccccgtcaccatgcgcaacgtgtccgaccttacttggaagtatgagcaaagattccccgtcgttgcccagtctcacatccgactgcgggagagcattctcaacagcgccagctttgccaaggcgcattcacaagttggtgtcanatatgtcgatgagaaggtaacagacgcgagagaggctgttgagggctgggttcagaagggcaaataaaggg

SEQ ID NO: 62567 - DNA, 412 bp, Triticum aestivum
  Clone ID: PAT_TA_62567
gtttcctcaatctatcgtgaacttctctacttttctatgtgcatctctatcacaaacaacactattgctatattgcaaagcacattatttcgacgatgcgacccaagtttgtttctgcggtgatcttgatggccgtgacggtgttgatcctcctcgtggcgagctcggcgcgagtgttgggcagagaggcattgtctggcgagtccatcgtccagctgtgccggtatttgtacaggcggctgttaaacatgtaacctgcggtggtgtataaaccgcatgatagattttatataggctgttgagattgagtcttggagatcaatccacgctcttgtttttcctctttgcaacaaccaagcttcggccctatatattaacacgcaatgcgtccttattaggtatacgcttaact

SEQ ID NO: 62568 - DNA, 844 bp, Triticum aestivum
  Clone ID: PAT_TA_62568
tgtcctcagtcacaaaatcaccgacacttccaaaatgtcaccatcactcgacgctcccacagacgcctcatctccccgcctctccgtcatcgtaaccggaggtgcaagtggcattggtctagccatcacccgtcacttcgcctcccaaggtcacatggtagctgttctagatgtgaactcaaagacaggcccagacgtggttgcacaagtagcaaaggaataccccaaagctacggtcagcttcaaatggtgcgatgtgtcttcgtgggaaggccagtacgcagtctttgatcaggcataccgtgagcatggtgatcgaatcgatattgtgattgtttacgcgggaatctctgatccagttgttggagctctggattgtgttccgactgagtttcctaggaagccacagttgagaatgcaggatattaatttgaatggggtgatatacagtgtcagccttgccgttcattatatgctcaagaacgagataggcagtcgactcccagactccagaggctccattgtttgcacatcatcatcagctgccttttacccatttcccgtttctccactctactcaacctccaaagccggtatcgtgggccttgttcgatcaatggcagtcagactccaagaaccgaagatccaaatcaacgcccttgcacctggagctttagaaacaaacattgctcccgacaaggaactattcaggttcatggtaatcacgccaatgtcgaccttgatcagagccgttgagcaatttgtcacggatccatctaggagtggccagacagctgaaactaatgaggaagagatcacgctgagacctcatgtggagtatgct

SEQ ID NO: 62569 - DNA, 768 bp, Triticum aestivum
  Clone ID: PAT_TA_62569
acctctcttcgttatcctctcccacacagttctctttaccatctcctctctttcttcatcccgaagattcaagatgaagttctccctcgctgtcctcctccccgtcgctggtgttctggctgcgcctacgccgcctggtatccctagcgattctactgccagatcgcttttgagcggcctcactgtctctgctcccaccaacaccgacacctacaacagagatcttttccctcactggcagacatacgagggcacttgcaacactcgggaattcgtcttgaaaagagatggtacaaatgttgtgaccaactctgcatgtgccgccacgttgggtacatggaaatccccgcacgatggcgctacctggacacaggccagtgacattgacattgaccatatggttcctctgaagaatgcctggatttctggtgctgcttcttggactactgcaaagcgaactcagttcgctaacgatgtaacaaggcctcagctgtgggcagttaccgacaacgtcaaccagtccaagagcgacaagtcccccgattcgtggaagcctcccctgaccagcttctactgcacctacgccaagagttggatccaggtcaagagctactggcagttaaccatcacaagccccgagaagactgctctcggctctatgcttgactactgctaggcttgctcacggtggagatgatggtctgacagttggggagtcggatatgagtgtagtgtatataccgatcaagatactttatgatttatctc

SEQ ID NO: 62570 - DNA, 572 bp, Triticum aestivum
  unsure (1)..(572): unsure at all n locations
  Clone ID: PAT_TA_62570
aactcgacaaggggtccctccggncgcttatctcacacacagccctctctctctcccgagcgcaccacaacaccagctctctttttctctagcagcgcgtggtcggacatggcagcctgcgtcgacaagtggaacccagcatactcctgccaccgcatctcccgatccatctaccgcttcatgccggactgcaccttcaccgcaccggcgggcgcggccgtgaacgggaacggcggctgctgcaacggcggcgacgaagtctgggaggagctgtacgccgaagcgcaggccgacgcgcaggacgagccgctgctaggcatgttctactccgagctcgtcctgccgcacccgtcgctggaggccgccctcgccgcgcacctgtccgcgaagctctgcatcccgggcgcgctgccgcaggacgcgctccgggacatcctcgccggcgcgctggccgcgcacccggaggcgagccagcacacgcgcgccgacctcctcgcggcgcgggaccgcgacccggcctgcgccaaaatggtccactgcttcctctactacaagggcttcctcgccctgca

SEQ ID NO: 62571 - DNA, 809 bp, Triticum aestivum
  unsure (1)..(809): unsure at all n locations
  Clone ID: PAT_TA_62571
tctttcttattgcctctctaaacccttccccttcatccgactagagcgctatatctttcaacatatcatcccatctacaccatataacttcagcaccctagtacatcgccaacatggctgattcagacagtccaggctggaaatggttcccaaacgtcaaaaacagctggtctctcgatgtcgttacactcctcgcagtcattggcgagtcagccatggctgagcagacccagaccatcacagcgtctttactatgtctccttccacgcctaatccctgctcctcaagctcttctcaagccctcacgcccaagtcgaatgcctgaaactctcgcgaaaatgacgggtgtctacagtggaactactctcgactccgtgggcttctttgcgacgatcatcacgcctctggatgcccttcaaccttacagcttcagtgtgttcgagattagacacaccgacccatcccagttgtatgaaaccgacatcaaccctccttcagcccaggaaagctggtccatgcgaagtctcaagtgggtcaagtcccgacgctcaagttcatacagtagagaacatcaacacaatgggaaagagacacgaggtaatcgtattcctcgtgccccgaggacagacggtggtctccctctacctgcacaagcaagttcaactgctgcaacgcgtacaaccaccttcgagatactaggtaaatcacaagttgatgaggatgcccccaacccatcgtacgcaggcccacggcaaagcaaaaagttcaggacatgctcgcaaaccctacttttgncaataccaaaagac

SEQ ID NO: 62572 - DNA, 623 bp, Triticum aestivum
  Clone ID: PAT_TA_62572
acttgcttcgctctcggtcttgcatgtgttgtatgcgccgtattccgacttatctacatctctaccgtcgatctcaacaccaacattacaggcaccatgcccaccaccgtcttcctcttcatcctcgagcccaacctggctatcctctgtgtcagcattcccatgctgcgacctttttacgccaaatacaagaagcgaatgggcggatcccgactcgacgaatactccaactcgaggagcaccggatttcgagacatgagccgaacaggtgctagcagtgctgccgcccccgaagccgttcgggaccccaatctatcaacctgggagatggtatttctaccgtccgcaagataagatccagcatggatacagtgtctcgggattcccgatgagtcaggatcagagaagaacctgactgtcggttcatctgaggctcccaagggcgagatcagcgtcgagactaagtggacggtgacgcactctacccgcaaatagggagagaattgtattggagtataacgataccatttagcattttagtctacttagccgaggccttacctcaaaccattttaaaataatatcttctatagtcaatcctataaaaattacctattagacag

SEQ ID NO: 62573 - DNA, 529 bp, Triticum aestivum
  Clone ID: PAT_TA_62573
cctttccaccttcaaaactctcaacaccctcaatcaccaccaaaatggtccgtctcgctgtcttggctaccatcatggctgctgccacctccgtccagggcgctatctggtgccagtgcctcttccccgacaagtcccactgctgtgttgccagtggaggtggcagctgccaggaaaagtgccagaatgccaagaagcctatcattgatggatctttcgttccacacaaccagccttgcaatgctggaggtgctgggttcggcattagcccaatcactgcccagggccgcactcagtgcgacaccagagccttctaagttcggctttgatgcctactacttcataagaagtgctctagtattaccttagatcaggactgatgtctgatgactaccgaagtgccaagaatacggggtcacaggtcgttttctcttctaactatcatgtatggagtacaacattgcacctttctatatgaggtgcttccgtatataactgtatatattatggaatgcattacatatttgat

SEQ ID NO: 62574 - DNA, 501 bp, Triticum aestivum
  Clone ID: PAT_TA_62574
atctcccgcaggcggagaggaccgacggcggtttcccgcagcgaggcgcccgtccacctcgcgcgcccaccccggcccccctggtcgccggcgatcccaaccgcccgaaccccccccagacgctggggggaagtccagccaccgcggccgaatgcccctccagcgccagcatcaccaacaaaggcggcgcctggcgcggcggcacgcacctcgacgccaacaccgtcgtgaccgccacccacgtgtgtccagcgacgaactgccagagcaccacgacatccgggccgcagccaactcccgcacctctggcggcgtcaccccccgcgcctcaagcaacacaatgcttgtaaccccacccgcaccacccacaacaacgacgtcgcccaccagaaggtctccactcacatcgcaggcgggggccccatagccaaaggacacccggccaccgccgcctccgacgccgacggcggcaccactcacaccgtcgctggctggggagac

SEQ ID NO: 62575 - DNA, 521 bp, Triticum aestivum
  Clone ID: PAT_TA_62575
atttcactactattgccatcgatgacgccctctggacacacgaactggacctattttttgagacgcatacccttgatgccttttttcttttacatattatgatggacgaccttgcatagtggatgagccttgcctggattgacgacctcatcgacttcgcactttattgccacgcggatgagaccatgctgcatacgttttatactgggacacggcgctgagttggaaaaggaaagggagccatccctcaccaggtggatttggggtggtatctcatgtcatggccttgctgtccggatccgccctcaggggaagtattctgttttccgttctttctggatctggctggctcttgctcttttccttcaatgtctttggccctcggattcttcgatgtgaaccatcgttgagacgcggcgttaattgaaataataattggcagaggccggcatccggacagcaaggtgagttcaaacgagcttgtatatattagccaaccttttcaaaggatctttttgcgt

SEQ ID NO: 62576 - DNA, 462 bp, Triticum aestivum
  Clone ID: PAT_TA_62576
aggattactcagcacatatctcttcccacaacgccgtgcgaaccaacgacgaagctcttcttgcacccaaccagatcgaaaaggtccaaaacagaatgcgtgcagtgcataacaagcgtttggaagaaaactaccaaaaggcctgcaaacgtgctgagaagaagggtcgcaaactcccaccaaaggatcagtattacgatcattgggggtatccctacatgatgtacggacctttcatggcacctacgatagtgtttgttcctgtctatgcttatgggactgcaccaacttgtgcgggtggaacctgtggagggaacgtcgctgcgggagcatgcggtggtggtgacggcggtgacggcggcgatggtggcggttgcggagctggaggctgtggagggggaggctgtggaggaggaggaggatgcggtggtggaggtggcggtggaatgtggaggtggtggt

SEQ ID NO: 62577 - DNA, 824 bp, Triticum aestivum
  unsure (1)..(824): unsure at all n locations
  Clone ID: PAT_TA_62577
aactccccccacccaatctcgtctccgatcgtcccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtggcatgcagatcttcgtgaagaccctcaccggcaagaccttcactctggaggttgatagctccgacaccattgacaacgtcaaggctaagatccaggacaaggagggcattcccccggaccagcagcgccttatcttcgcaggcaagcagctggaggatggtcgcacccttgccgactacaacatccagaaggagtccacccttcacctggtgctccgcctccgtggtggtatgcagattttcgtgaagaccctcaccggcaagactatcacccttgaggttgagagctctgacaccatcgacaacgtcaaggccaagatccaggacaaggagggcattcccccggaccagcagcgcctcatcttcgccggcaagcagctggaggatggccgcacccttgcggactacaacatccagaaggagtccaccctccacctgggtgctccgnctccgcggtggtcagtaattgccctggcgtcggacctgcctggttatccttggtcgtccgtaccctgtcgttcatttgaa

SEQ ID NO: 62578 - DNA, 439 bp, Triticum aestivum
  Clone ID: PAT_TA_62578
ttctagatctctcggcttgggtgagggtgggttctctggcatctcttctcaagaagatggaagcactatctatttatatgccacaggcgacaacagttggtttcgcctcttgggtccgacgacactgatatttcaagcaattggatttgcatggcttttcttcatgcttctgcaagaatggcgtgataaaagaagagcctccatgatgcattgtagctctcttccatctggagatcagtagctgatagatttggtcagactactggacatcagcatattcccaacaagaggcaacactaaaatcgaactctaaagcaacagtgacatgactacctgatatcttgatttgacggtcctttctttttggtgggagtggtttaatattgtcctccaatttgaatgttcgcattggttacgaataatttgcaaggtccactcg

SEQ ID NO: 62579 - DNA, 772 bp, Triticum aestivum
  Clone ID: PAT_TA_62579
acgtcacctctttttatttttatccctcctctcgataattccgtctgcccttgcagcggctttggtctcgatagcgtctctccggtccgtcgtatcgtatcatccagtctcgtcaccgacttcttgcgattttattcctcgcactttttccgtccctccgagaccctcgcgtcgtttattcccgactacaaacggcccgtggcgagtaaaccttgcgctttcttcaaccaacgaagcgacacccgtcatttacgaagcttaactcaatttcttgtcttgtatcttcttagtgcgagatttgagataccccgagccgaatcgaccccatcccggttttctccattcgatcccgaacatcatacaatatgtcctactacgacaaccctcagtctcagtggtcgtcttcgacccagcagcagcagcagcagcagcagcccacccagacccagaacagctgggagcaccagggctcgactactcctgtccgcgcaggcgccagtggtccccagcctcaggacgattacgccttctcttaccaatttgatgaggtcgaccgggcttatgagaatttgcagaagtctggcaagggttatggaatgggcggccgccactcccgtggttcccaccatacccccggctctcgccctcactcggtaaacaactttgatgacgcccgcggcggctcccggggcccaaccttcaaacttctacgccaaccagcgtcaccaaccctcacgaggctccaacgaggcagagcaggtcatgcaggcta

SEQ ID NO: 62580 - DNA, 283 bp, Triticum aestivum
  unsure (1)..(283): unsure at all n locations
  Clone ID: PAT_TA_62580
atttccaaaacggcgcccgcnccaancncctttcccacaacgccgccggacaacaccaccaccaccagcaccacaagaggggcncgttgcacgaggcggagaccaccgccggccccgcccgcgaccncaagaacgncaacgggcgcaacggcgaccacaagcccaacgccgcgcacaggagcgacgccggcgcgcgccgccccacccgcgccgaccccgacaacggcgacaacccggcccgggacgagaaggacgccgacccgccgccccccaccagccgccc

SEQ ID NO: 62581 - DNA, 299 bp, Triticum aestivum
  unsure (1)..(299): unsure at all n locations
  Clone ID: PAT_TA_62581
cattacggccatctttgaccccatcacgacttttaccaactcccatcacaaacacacacaaaatgtctgcttcgttcttctctcttcaaggccaaacggctcttgtcactggtggcacacgtggtattggccaagctgtagccatcggcctggcagaggctggctccgacatcattctagtacagagagacacaacatcacaatcgacgaaggagtcaatcgagaagctaggccgaaaggcttttnnatttacnnaccgccgnnacctattcaatcgcaagaatctgttgcctgctctt

SEQ ID NO: 62582 - DNA, 842 bp, Triticum aestivum
  unsure (1)..(842): unsure at all n locations
  Clone ID: PAT_TA_62582
aacgaacctcctctccttcttttcatcctgaccggcggctagggttccgtcggcgccgccacagccacagccaccggcgccatccttgctcgtccagcgctggccactggagaaggtgggcgccgtctccgtcgccatcaccgttgccgcctccgacatcgacctcgacctcgaccgtgtctgcggcagcggcaaggacctccacctgtaggtctccttctcgccaagcgagcgctcgggatgagcaggcaatctatgatggcatatttgttgattgttatttgcaactttcttcttgagcaagctgaaacaaaagtgctgctccatctatcggttgcagctacagcatgagcccctctttagatagatggatggaattatatactacgaagtctttctgtgaggaagcttttgtcagaatgtttcttttacaagaaaacaaagttgcactgatttgacaaggacgggggcagtggaaggagcgtggcatgggtacagtcaggcttctcaaacggacaaccaaggtccgccttgtcatgcgacatgccaagagcctcaggatctgcggcaagcaccttgagtttgcagctcatactacataggaggacatagcatgaagagggcgatgacccttgggcgcttgccacgggattaagggcttggacgtcgtcgtcgtccttgcccatccgcgcagggcaccatagtgaaccccgtcggctccgtcgatctgctagacctaggtttcatgccggcgcagatgaaggcctttttcgactccagggcggncgcagncacagcatcgacgacaaccagatcaaacccgactcctccgacatatggat

SEQ ID NO: 62583 - DNA, 700 bp, Triticum aestivum
  Clone ID: PAT_TA_62583
agttccgtggaagcctcctgttaccaagactgaatatgtcaccaagtggaagcctcccatcatcaagtacaagactgtgacggagaccgacaccgtcactaagtacaagtggaagcctcccgtcaccaagacagagacgaagtggaagcctcccgtcaccaagacagagacaaagactaccacagagaccaagtacatccacaagcctcctgtcaccaagtacaagaccgagactgtcacaaagaccatcaccgtcaacaagccaaagcctacataccacaagcccggttacgagaaccccggctacggcgatggcggtcacaagaaggagtacaaggcttaagtgctcaatcttggccaaccacaaagacttcagaccaaagattgtcacttctggcctgttggacttggtttaaaattacagatcatgagattacataacactccttctaattttttaatgtcttttttatgttgatatttacggattattcccgctacaggacgagctagtggaacggaatcaaggtggcggcttggtcgcgacggcgagagggtaaaaatggtggtcatattcttcgacacattctttcaataggggacatagccgcggcatggcagcgactagagttatctatagatttgaaataacttcaatattattgtgttttgctagaaaaaaaaaaaaaaaaaggcccct

SEQ ID NO: 62584 - DNA, 781 bp, Triticum aestivum
  Clone ID: PAT_TA_62584
agtgacggatactacaacatttaagcgtcttgtgcggtttgtccccaagtctgactcaactcgcatcctgatcggtgaaccatcacaagaagatctagatatcggtgttgccacgcgtgatgggaaagatgtcactgtcaatgtattcacggggtcttccgttctttctcctggcactcgaacagacagaaccgaatctattgagaggatcttgtcgcctttggcacaagaggaagtcggaaccattcgctgcattggactaaactatgtccaacacgcgaatgaagtgaagatggacattccaaagatcccaactcttttccttaagcctattattgttttgggagacccttggcctgctcccacctttcttcccaagataacccaaaatgacggaagtggtgattatgaatcggagctggcagtagttattggcaaaatcgccaagaatgtctctgaggagaacgctatggactacgtcttgggctacacggctgccaacgatgtctcgagtcgtgtttcgcagcttaaccagtctcagtggtgcttctccaagggattcgatggagcatgcccaattgggcctgttcttgtctcaacttcggctgttcctgatccttcgaagctgcacattcgtggcctgaagaacggaaaggtacttcaagactgttcgctggacgatctcatctttagcatccccaagctagtcagtttcttatcacaaggcactacacttccagctggcacagtaattatcacgggcacgcctgctggagtagga

SEQ ID NO: 62585 - DNA, 842 bp, Triticum aestivum
  unsure (1)..(842): unsure at all n locations
  Clone ID: PAT_TA_62585
cggccgctcgagccggcaggccgggaactctccttcggttcccatccttttcctcttctcccagttgtcgcccacaggagcactcctattcgtgcaccgtcctcaactgtggtcttccagccgccttctcgactcgactccaaacctccgaccgctgcttcaacaaagaatgcctggacttacacttccaaccttcactcgtgccgaggtcgaagagcacaactcagagggctcttgctatgtcacaattggcagcaaggtctacgatatcaccgactttattgaggatcatcctggcggtcccgaatacgttctcgagtatgccggccgagatatcgaaaagatcctcaaagactctgattttcacacacattctgactctgcctacgaaatcctcgatgagagcctagtcggattcctcgtacccgaaaagtccgtcaacggacatgccaatggaactgccaacggcaatggcaatgcgaagctgtccaacggggacgccaatggcacagtccatcctcgaaccggaatgtcctgcgaggaggacttgagcagggaaacagactacaacatggactacaagaagaacaagtttcttgacttgaatcgccctcttttccctcagctttggttcggtggattcactaaagaattctacctggatcaggtccatcgtcctcgccactacaagggcggtcagtccgcacctctgtttggaaactttcttngacctctctccagaccgcttggtatatagttcctattatttggctgccatgcattgcattcggtacccacgtcgcttcgcaaggcttcgacaccagctctacactcttggctac

SEQ ID NO: 62586 - DNA, 703 bp, Triticum aestivum
  Clone ID: PAT_TA_62586
atgtcccatgcatgactaattaacctttcagtttggacgatcatgttgggctgaacgtggatcacatccgcgtcacacgcctgcctctgcaaacagctagcactgtcgaccatcaccatgcagtccagctccaaggccggcggcaacggcgacgcgaagcacctggtttgcgtgaccggggcgggaagtttcatcggctcgtgggtggtgaaggagctcctcctccgtggctaccgtgtccggggaaccgccagggatcccgctcaccgcaagaacgcgcacttgctcgcgctggatggcgccggggagaggctcacgctttgccgtgccgtactttttgcacggcgacagcctccgcgccgcgttctggggctgccgcggcgtgttccacatcgcctccccggtctccaacgatcccgagcttgtgcctgaggccgtggaggggacgaggaacgtgatcaacgcggcggcggacgcgggcgtgcggcgcgtggtgttcacttcctcctacggtgccgtgcacatggaccccaaccggagccccgacaccgtcgtcacgactacgactactgcaaacaaaccggcaacctatactgctgcgccaaaatgatggcggaggtcgcggcgacggaggaagcggccaggagggggctggagctggcagttgtgctgccggctaccacaatcggtcccgcgctgtaac

SEQ ID NO: 62587 - DNA, 544 bp, Triticum aestivum
  Clone ID: PAT_TA_62587
aattcatgagcacttcggcgacgaggtctgatcctcccaaagatcgacctgcttctgtttgctctcctctctgtaataccactactagtctagtcacacaggaatcacaattccattgctggtcatttacccaaaacaaaatgagatggaaggaacctgaagagaagtaggatcatttgatcagcagtttctcagtaattatactcagctttgctatgacacgaggaacagttggatgttgcttgtagtaatttgtaatggaggcatgggattggtactacactactactacatgctagcttgatcgcttgtgtgtgcactgaaatgaatgatgacatgttgtgttaattatggatagtactagatcactgcaccactcggatcatcgtttgaagattctgcaattaattaattgcacttccttgtgattatgagtgagctgaatgtaggctatgagatgaattgagattacacaatctggagagtttactgggttttggtctttacacatatctgagtaattaagcatgccgtagagttatcc

SEQ ID NO: 62588 - DNA, 818 bp, Triticum aestivum
  unsure (1)..(818): unsure at all n locations
  Clone ID: PAT_TA_62588
aatgccttcatcttctccagaaaatcatcttaacgaacaaaactcccatcgcagcagtcgccgctttcgtgtcagcagcagcagtcctcacttccatctacaaatcttatacatcctacaaaatgtctcacaacctccaccccagcatcaacaagggcatcaccaagggctcttccagtttctctggtggcaagctccgatgcgagtgctcttccaaccccgttgaggtcaccctcggcggtcaagtcgctcacaaccacgcctgcggctgctccaaatgctggaagcctgagggtgctctcttctctgtcgtcgccgtcatcccccgcgatttattttcaggtcaccgccaacgctaacaaactcaccatcatcgacgagagcgctgccattcagcgaaacgcctgccgtgactgtggtgtccacatgtttggtcgcatcgagaaggagcaccccttcaagggtcttgactttgtccacgtcgagctctctgacgaaaagggctggcaagagcctcagttcgctgcctttgtctcttccatcatcgagcagggcttccccgccgagaaggccaacgaggtccgctctcagttcaaggaccttggtcttgagtcctacgatgctctgtcccctcctttgatggacgccattgcctcttggaccgccgccaaggctaagatctgagtgtctccgtctagtgtaagccactttttcaaaaaatgaagggtgtgctatgttacaaaaaagtgcaaatggtggttagcgngtgttagagatctggtggtggttgttttggaaatgtacctgggttgcaattg

SEQ ID NO: 62589 - DNA, 811 bp, Triticum aestivum
  unsure (1)..(811): unsure at all n locations
  Clone ID: PAT_TA_62589
ngacataccacaagacaataatcatcagatctctctatgaaggcaatccagatcaaagagttcaatgcgccctactccgtatcggaagtagacaagcccaaatccaagcctcaccaacttctgattcagatcaaggctggcggtttctgccacactgattgcatggctctcgcaggagaatttggctccaaactaccatttatcggatcccacgaaccaactggtgttgttgtagaagttggttctgaagttgagggttttacggaaggtgatcgcgtgggatgtctcaactttgatagctgttgcggaaaatgtccggactgtaaggctggaaagcctatatactgtgacgctcctctgatgaagggactcactgcggatggagcttgggcagagtacatggtatcggacgctcgctttgcagtcaagctgcctgatgcactcaagtttcctactgcggcctgtatgatgtgcgcaggcgcaaccatatacggcgggatcaagaacgccaaggttccagctggaggctcaattggcatcatcggcattggtggtttgggacatatcggaacccaactagcaaaagcaatgggctatcaagtagctgctatcgacgccaagcaagacaccttggatcttgtgtcgtcctacaccctcaagcccgacgtttgcattcttgcgtctgaccctctagaatattccatgaagaaaatcacagacgtcgtcaaaagtgattatccagnacttgatgctgtaattattgcaacagacgcgcccccagcattcgatcttgccgctcaacttacgcgca

SEQ ID NO: 62590 - DNA, 661 bp, Triticum aestivum
  Clone ID: PAT_TA_62590
tctccgccgccgagctgacggatggagttctcgccgacggcatccaggacgactgcggcaacgtgacccggttcgtgatgctggccagggagcccatcgtgccgcgcacggaccggccgttcaagaccagcatcgtgttcgcgcacgacaaggagggcacctccgtgctcttcaaggtgctctccgccttcgccttccgcgacatcaccctgaccaagatcgagagccggccgcaccgccaccgccccatccgcctggtggacgacgccaaccgcggcacggcgaagcatttcgagtacatgttctacgtggacttccaggcgtccctggcggagccgcgggcgcagaacgcgctggccgaggtccaggagttcacgtcgttcctgcgggtgctcgggagctacccgatggacatgacccctatgaccgccggctcctcctccaccgtcacatcgtccgactcgtagctccctagaggtatcgaggagaatcggtggagcagtagggacgtcggttaatttgtggtcatgtcgtcccactcctccctcgttggcagctggggtaattagttttgttctttatgttccttgtcataatacatgtaaaatcgtgccgtttgagccagttaatacgcagtggaatataccctgtgagatacagc

SEQ ID NO: 62591 - DNA, 841 bp, Triticum aestivum
  unsure (1)..(841): unsure at all n locations
  Clone ID: PAT_TA_62591
aacactaatttgactaaattcctgttaccaatatccgcataatggctcaatcagtacccccagcttcgtcgcacggacagctaaccgtaggggaagtcggaacttcagtaaactcggtaccttatgctcgccatgaagaaattatccgcgctccacttacctatcttcttaatctaccaggtaaagatgttcggagcaaaatgatagcggctttcaaccagtggctcaaaatccccgaagacaagcttgatgttatcaagcgcattatcatgttactgcacaatgcatcactcctgcttgacgatatccaagactcctcaaaactccgccgtgggctgccggtgtcgcatagcatcttcggcattgctcaaactatcaatgctgccaactatgccttctttctggcccagcaagagcttcccaagttgggagatgctcgcgcgtttgagatcttcactgaagaattgctacatctgcaccgaggtcagggcatggatatctactggagagatgcctccatctgcccaactgaggaagagtatttcaccatggtctccaacaaaactggaggactcttcaggctggctgtcaaactgatgcaattggcgagcgagagtgataaagattacgttccactcgttaacgtgctgggagtcattttccaaattcgcgatgactatctanacttgcagagcggcaattacgccaagaacaagggatttggtgaagacctgacagaggggaaagtttccttccccatcatccacagcatcccgctcaaccccgnccaacattcagctctccagtatcctgaagcagcgaacgacggacattgatgtaa

SEQ ID NO: 62592 - DNA, 794 bp, Triticum aestivum
  unsure (1)..(794): unsure at all n locations
  Clone ID: PAT_TA_62592
attccacctgcaccgaacccaaaacaggccagtactccacgagtcaagtcagccacctgccagccagccagccttcaacgctcacccaccccgccacgaccacgaccatgtcctcctcctcctcctcctcctcgtccatgggcgcgctcgccgcggccaccgccatggcgctctccggttccctcgtcctcttctccctccgccgcttcgccaagcccagcctcgacgacgacgcccctgcttcggacgaccccgcgtcccttcgtccatgcctctcctccccctcctcctccccagagaagcgcccgcgcggtgggaagctgcggcggatgggtgnatagcgcccgcgcctcgcggagggcgtcatcgacaatgagggcgcgccccccgtggccaggtcctcctccgcgcccccgccggcgccggcagcggccgagccgacgtgcaggggaagcgtgacgggatcggaccaccggatgccggcgaaccgggaggctctgtaccgcggcatgctccgcgaccgctccgtgcacaggaccgcctactcctactgaccggccaccgaccggtcggcccgacgcccgcccgccgccgtgcccgattagcccagcccgtccccgtcccctgcttttgcctggtcctgttgcttctttcttgggtttcttgctgtgccgttggtgtctggttgctttggcatcggcaggcaggctgttgactcctggtgtgcaaatggattgntagccaattaggagtagcagtagatgatttacgctttggtgtcgatctacctttgc

SEQ ID NO: 62593 - DNA, 816 bp, Triticum aestivum
  unsure (1)..(816): unsure at all n locations
  Clone ID: PAT_TA_62593
aaccccagtctagagtctagaatctagacgtgaaacctatcctcaccaagccaatacctggaggacggccttgcacatcacctcctggcaaatattacacgtcttgaaacttcaccatgcgtgctcgattcaaaggcccagctggcaccggcatcctcgagctaccagacgatgctactgttcaagccctctttgatgaaattcggatgaagactggcatttccaaattcggtgtgagatacggtctgccgatggcgatgaaatctctcgaagctacccagggtgatcagattgctcgatctcttggtcttcacggcgagacacttaccatattttctgaggagtcatcatctgcccctgtcgagactgtcccgaccgggacaccccaaagccaggttacggcatccaagacatcgaaaaagaatgaaagtccggaggatgtgaacgtgccatggcctcaaagagagggtactcttctgttacgagtgatgcccagtgacaatagctgtctgttcaccgcgttcggaggcgcattgcaaaatcaactctctgcgcaaaacttgagacggatgatggcagactatatcctccaacatccagaagaatattcggaagccgttcttggcagtccacccagccaatactgccgaagcatccaggacccggacagatggggaggtggcattgagctcagcatactatcctctatctttgacatacaaatatgcactttcgatgttcagacacagagtaaaattgagttcggngaggaaaagcaggatcgctgcattctcgtgtactccgggattcattatg

SEQ ID NO: 62594 - DNA, 701 bp, Triticum aestivum
  Clone ID: PAT_TA_62594
agatcccatatgcattacacagtgcagcaatctgccgattagccgaaagtgattttacacgatcgagtagctcgccgcgacttttggtcgggggactagcccgccagcgatcgagtccagagccgactgtcgagagccatcggccatgagcaagagaggcaggggcgtgtgggacatggagctgggcagcctcgacacgacccgcctgctaatgctcctcgcccagcagcaccagcaccagcaccaccaccgcggcgtcgccgaggcggcgcaggcgatgaccggcggccgcgtgttccagtgcaagacgtgcaaccggcagttccccacgttccatgcgctcgggggacaccgcgccagccacaagcgccccaggctccaccacccacccccgcagcacgcgctcgtcggcgtcgacgacgacgcagcactctgcctcggccgccgggcgccccaggcgccgccgcagccggccaggccgagggtgcacgagtgccccatctgcgggctcgagttcgccgtcggccaggcgttgggtgggcacatgcgccggcaccgcgtcgaagccgaggccgaggccggggccaacgccccgagcagcaaggcggcgccggcgaccgagatggtggtggcttcgtgcgacgacgccgggatctgcctggacctgaacctgacgccttcggagaactgcgccaaatgca

SEQ ID NO: 62595 - DNA, 569 bp, Triticum aestivum
  Clone ID: PAT_TA_62595
cactccctccaagggtagtcacctcgcggaatttcaacccgccatcatccgtgccattcctactgtcccagaaaacattatctcgttcacccggtaaagctgctccaggtgatgccagatgatgtggacgctggtcgtgggccaacatatgtctgaccaaccgcgggaaccacgacttccaatgccagtgacacgttgaggagactcacggccaagaaggcgccatgttcagaggatggcgacgccgagatgctgcctacgatggtagtggatgcatctgccccgagtttcgccaacatcaccaagctctctagcgagcggactgcattagaatgtttgcacacaaacggctactcacatgacttgactgcatcatgcctctatgcccgcgatggtcgccgactgagtgaatcattggagaccaagccgagactatctccagaatgatgctaccgactctcgccgagaccaccgaacgtagagacatgcaagtaggtgtacggcggcgcttccgcgggctcaagctttgcatggcatgcgtatccatggaaccgcaaagatccaagaga

SEQ ID NO: 62596 - DNA, 755 bp, Triticum aestivum
  unsure (1)..(755): unsure at all n locations
  Clone ID: PAT_TA_62596
accgtcgagtgacgctctgcgagtaccgtagaggtacaattgatcaactcgaggttgtttccgccatactggccgatgccaacctagaagaaaatgcactatcaaagaaaaagaaaaagaaggggcaacccacggaaacatatgcatctagagaagtgtcaagcacaacagcctgggcctttggccaggatattccagtggttcgactggacttgggcttgcccactgtcaccgaggaggagtacgatggccctgaggatcatattgccttgcccccttctgctatggagcgggtgatgcagtacggtgacgaagcgcagattgtggtgacgacgatgagacgtcgtggagctcaggggggcagtcaaggtgaggatggcttctttgaggatgattgcgaagttctcgactttgcagatcagagggtgtaaatgagatgagtctcctctcagccagcaatatatgcagggttttttttttggtgtatggatttttgagctttacttcattctatggatttgatgctagggatcaataatccattgcttaggctgttcaatcatggtgccaaatttcaccaatccatgtttagcatgaatggcagcatttaaccaaatcattgggtccggaatgttggagttgattgattcttgacgtgtaggcaatttgcttcatgtaagaaacactctttagcacggaattctttctttgacaggtcataatgccttattanataaatagaaacacctttagag

SEQ ID NO: 62597 - DNA, 397 bp, Triticum aestivum
  Clone ID: PAT_TA_62597
ccctaccagcaggacagcagcggcggcggattgcgtggcacagtgcggagcgcatcagaatccaagccagccggcgccgcaacgttgggctccattgttggcttcacgcccgcttcgtcagggagcaggggctgctgcgccggtcaccagccaagcggccgccgcggggctgtcgatgaagcggtcgttgcagcagtttctgcagaagcggaagacaagggtcgccgccatgggttcgccgtacgccggcggccggcgagcgatgcccttctagtcctagtccggtggttaaagacacatacgtacagtgcttgctagcatatggttatttttgttcttgagacttgcattttcaagcatgagattggagtgttcaaatgaagttttcgtttgttcg

SEQ ID NO: 62598 - DNA, 832 bp, Triticum aestivum
  Clone ID: PAT_TA_62598
aactcccagttgatcatctataccttcaatttactccctgccaacgcaatggctgacgctcctccttcacttccgggccctatgccctcgtctttcgatggtgaaggggaatttcataatgaacgtcctatgcaaaaggttgttcgcaagatcaaggaagagcctttgatccctctgggaattggcttgactactgctgccttcatcaacgcctacctagcccttcgccgcggcgactcaaaacaagcaaaccgcatgttccgagcccgtgtcgcagcccagggattcaccgttttcgccatgcttgccggcagcatgtactaccagaaggaccgagaaaagaccaaggagctccgccagctccaggagcagaaggacgccgaagagaagcgacagaagtggattcgagagctcgaggctcgtgacgatgaggagaaggccatgcgcgcaaaacttgagaagagaagacaacaagtccaggcacagcgggccgaggaagctcaagcaactgctgcgcctaccgaggcgtccagcagtggaggcatcttgagccgagtcgggttgtggcccacaggaagcaaggacgaaaagaaagatgtcgagaaggttgtagaggaggttgtgggcgaggaaaataccaaacagaagaagaagaaccccaagagctcccttggtgatctcggcgaaatcatctccaaaaagaaggattaaatactgaacctgtatattaaagcagttggacataagggaggttttgtacaaaagttccatgtgctgatccatagcagaagcacatcatgtatgatattgaagttaggcaaatttgatgatt

SEQ ID NO: 62599 - DNA, 532 bp, Triticum aestivum
  unsure (1)..(532): unsure at all n locations
  Clone ID: PAT_TA_62599
agagccatatcacagatcgacttcatttcgacgcaaccactacagactctgtctcggtctccattcctttgcctggctaacggggatggggatggcacttgctccacgctcgtctctgtctctgcgctccctgctgctgctcatgtcgcacaggaagccacatcggagctctttcttctcctcctccgccgccgttccgcctgcggctccaggaactgccactccggctgctgatcctgccgttcagcctccagccgctccaggtaacttgctgctgacgcactcaattgtgatttctaaacatcgagttcctgtgacttgcgagccttctcctgaatcnctcccccatagcaagcctgcgaagatcctgatcttgcagttcctaaaggtccgcgcgaaacaaacaaaagatggtccgccacgccaacctcctggaactatggatatagacgctaaagaccccggcaagaagactctctaacagctaataatacaaagtcagtgggagcctttcccacattcctcaaggttc

SEQ ID NO: 62600 - DNA, 768 bp, Triticum aestivum
  Clone ID: PAT_TA_62600
atttccaaacagggccgagctcttccgagtcttccaagccacctcccatctcctccatcgtttcgcagttcgcacagacctacgtagtaccatcgagctcgtaccggaccaggaccagctagccgcgcgccgatggtttcgtcgatgaagcactgcagagatcaggcaccggaggtgcctctgtccctctcgctctccctcggcgccatggccgaccgctccaagaagcagcgccgcggcgcagacggcgagttcgtctgcaagacatgcagccgcgccttcccgtcgttccaggcgctgggcggccaccggaccagccacctgcgcgcccttcttgttctcgcgctaggcctcactggcgggtccgatcagccggcgaccaacaaggcgacggaccagaagcaggcccaccagtgccacgtctgcgggctagagttcgagatggggcaggcgctgggcggccacatgcgccggcaccgcgagcaggaggccgccaccacggcgcaggcaccgcccgttctgctccagctcttcgtctagaaccgcacagatttctctcaagttcaatagctaggcatatcagatttacaggtcgacctatgtgcgcgatttgggttgtacatttgctgcgcactagttggtcttgatccttggcccgttcgctcatttattaggtatatatatacgtacatattttagggaggactcattcattcgttcattcatcactgaattatacttttatgattcctacatttattttgttcc

SEQ ID NO: 62601 - DNA, 628 bp, Triticum aestivum
  unsure (1)..(628): unsure at all n locations
  Clone ID: PAT_TA_62601
ccggccgctcgagccggncgggacgggcccttctntagttgcagaacaaagnttattgactctcacccacagccgtcgccatgcctacccgtttgtcgaagacccgcaagcaccgcggccacgtttccgccggtaagggacgtgtcggaaagcaccgcaagcatcccggtggtcgtggtcttgctggtggtcagcaccaccaccgtaccaacatggacaagtaccatcccggttacttcggaaaggttggtatgcgatacttccacaagcagcagaaccacttctggaagcccatcatcaacctcgacaagctctggtctctcgttccccaagagacccgtgacgcctacgtcaagggtgatattaaggacaccgtccccgtcctcgacctcctccctctcggttactccaaggtcctcggaaagggccgtctccctgagatccctctggtcgtccgcgcccgctgggtcagccgccttgctgaggagaagatcaagcaggccggtggtgtcgttgagctcgtcgctttaagcgaagcatccgcaactgtttctgtaaatgcttgaggagtcggttggggtttgtatgggaaattctacaaacggaaaacaaaacctctccacccccg

SEQ ID NO: 62602 - DNA, 588 bp, Triticum aestivum
  Clone ID: PAT_TA_62602
cctcccactcgcgtcgacagcaacatcagataaatggcccccgccgcaaagaagcagaagaagaagtggtccaagggcaaggtcaaggacaaggcccagcacgccgtcgtcctcgacaagaccacctctgagaagctctacaaggatgttcagtcttaccgtctggtcaccatcgccaccctcgtcgaccgaatgaagatcaacggttctttggcccgacagtgccttgccgacctcgaggagaagggcatcatcaagcctgtggttacacacagcaagatgaagatctacagtatgctcgcctttcccacccctcactctccccgcgtgaattatctttacacacatctcgatacgctatctcgacacaactgctaacatgattccagcccgtgccgttggtggtaccgactaaatgcaattcaacgaaaaatttgagtctcacgattgtgcgtctgggtggcctggacgatagacaggccacaaggtcggagggtgttgcaaggcgaaaaagaagcctggtttaggacgctattcatgctcggttaagcattgggacggaatcgctttagcaatggcaacggaatg

SEQ ID NO: 62603 - DNA, 815 bp, Triticum aestivum
  unsure (1)..(815): unsure at all n locations
  Clone ID: PAT_TA_62603
gccgctccgagccggccgggccgggactccaaaaatgcgcgggcgaaaccgacgctctcctgaagagccttccgtgagactatgtccatttttccgcgatctagcgctatggccacgattggtgcgcgagatggtgttaaatggcttagcggtcggggtcgttccaatttcccgggaatggctcatttcaccgggccgaagcagggggccagacaaatctcaacccaaatttgctccgataggccaactcgccaaggaaacctagctttgttctatccccattcccttctctccctcccatccgaaaagattgtggcagctcggcggcttggcacagctgtgctcggcgggccggcggttgtttcgcagcaagccgaaggcagcgacgggcgaagcggcaagacggcgaccagggccccgggcagcaggctgcgacccacaaccaggggcctctgcaccacgatgtcgtctcagccggttccaactcccagtctatcaacagcaggtaaaggcacgttcctacgggactcaacattttcctgtatggacaaaagattattgctatccgggccatagtgggtttgaggaggtattggggtgacagaagctatcttccgccttctctgacatcttgataggggattaccggagaccgtctttatctgcgttcatggggagacctttaattatcgttgccgaaacctgaatgtggngagcaattgtgatgacttctgtgatatgtggctgctgcatgtagagcaactgcgatgactcctgtgatatgtggctgctgcatggatccacgtatctatact

SEQ ID NO: 62604 - DNA, 485 bp, Triticum aestivum
  Clone ID: PAT_TA_62604
aatacgagagaacggccttcattttccctcctatggattggaggtacctcttggttcttcgacttattacaaccgggattatgctgctcattttcttgcacccggcatcttcgaatactgaacccaattgtccaccttgtacttgctgcagaccatgcagctgtggtcataactgattgtacatcgttccagcagtcttcttgggattactgttccgcagaaagccgatcacgtctcctctttttacgccatatatatgtattactcggttgcaccgtagtaaaacaagatactgttgtaacgatggatgctggtgtattgagtatttacctggtctaagactcggagcactatgccaaacttgtaacgttgaatgctggtctctatgtaacgatcttactactattcacaagggcatgagcaaggtgctgagcatctacatatgcccaaaccggtgcctaaatagtgagataatttcagtttcc

SEQ ID NO: 62605 - DNA, 537 bp, Triticum aestivum
  unsure (1)..(537): unsure at all n locations
  Clone ID: PAT_TA_62605
agatccaccacgcgggtttctcccattcgttctttcgaggacctaggtgagattattttgtgacagagaccgttctgttatctatattgcgagttagacctggtgccggtctacaagttctagacaaccttctattttacttcgacctttctatcatcccctttccttctacaaggacagttccagaataatcttatacaaggatgcgacatgagaggtgtactgcggcgctctttagaacatggctgctgttgcagacgctgctgtgattcaacgacgacaccccttgcttctcgcactccaacgacaacactttgccgatgacggcggcatacttcctcttgactatatcgctgacacacgacatgcaacaacggaggcaaccacggatgctacaactgacgcaacatctcttctaactacgataagcgacaacgtgtggtnatggctggtaacaacgataagcatcaacgttggacaacagcgtgcgagcggcaggtgcctaacagctctcctaaggcaacgcacgtacagacc

SEQ ID NO: 62606 - DNA, 346 bp, Triticum aestivum
  unsure (1)..(346): unsure at all n locations
  Clone ID: PAT_TA_62606
cccgccggccgctcgancggcttcccggaatcaaaaagagggatctgcccgactttcgacaaacaacccgacaaatcattgctctatttctgcataatatcagaaaagaggcatcaccatcattgatccttaccgccaccccggcccaacctgggtcatcttaaggcgaccatatgcccaattccttactatagatgcaagaagccgcatcacccaccgcctgaggatttggcggaggccccggaagaatatcttccccatctaaatccgagtctccatcagagatacggagagctccaaaggtcgcgacgcggcccctagcccggcccaaccacagcatcccaaa

SEQ ID NO: 62607 - DNA, 234 bp, Triticum aestivum
  unsure (1)..(234): unsure at all n locations
  Clone ID: PAT_TA_62607
acagagaagaacggcgagggcngcggggacgacancgncgacccnnnccgggacccgcaccgggacgcngggangcncacgnccanccacaaggnggcggagcnggcgnncaggggccgggcgnnccacagcgagaacaggccgnccagggccgaggncgccgacgaggnnggagcagacacaggncagcgggggggcgccgncgacggacgacgccgcgggcagggccaccac

SEQ ID NO: 62608 - DNA, 797 bp, Triticum aestivum
  unsure (1)..(797): unsure at all n locations
  Clone ID: PAT_TA_62608
gccgctcgagccggcgggcgggttttcaaaaggggccgncgnttttgagtttctctcacagaaccacactgtctcccagtccggctttgagaccccttgcgatctcatgaccggtggcatggactctggcttcatggccaaccccaacaacaccgtctctcctcctcctcaagttgccatgcaagtcatggttgacactcctctgtggttctactgcaagcagggtaaccactgtggtcagggcatggttttctccattaaccccaccgccgagaagacacaagccaagttcaaggagttggccatccagcagaagggtgacggcaagcttgctccgatccaaggtggtttgcctgcatctcccgccgcctccaagcctgctgaggccgctcctcctgccgctccccctgccgaggatgctcctcctgaggctacaggggttgtccccggcaagggcaccatggctcccgatggaagctgtgtctgccacgtctcttgtgcagctggcgctttccctgccgctgcccaaggcatcaactcactcggtggcatggccggagctctgccttacaacatgggtggtgtgagctaagtaacgacatgaaaagacgaggagtgttaataccacggaagattgcttagtagtttgcgatgatgttattacttgaatgtaccatttatgtatgngtttttagacggtctcgattatttccttgggtagcctagatggcaatgaaatcttcacgggtttggaagatcggtttagttagttaatgggacaaaaacctatgggacgt

SEQ ID NO: 62609 - DNA, 562 bp, Triticum aestivum
  unsure (1)..(562): unsure at all n locations
  Clone ID: PAT_TA_62609
attttcaaatcggggangaaaaaaaaaaaatttaccaaaaaaaaaaaaaaaaaaaaaaaaaaaaaaaaaaaaaaaaaaaaaaaaaaaaaaaaaaaaaaaacccctcccacacaactacccgagtcccaaaccttctgcaagaatcgttcttcctagccaggctccaaacttactggaaccttacttaaacaaggaagcaacggcggcagcaaaaatagttgaggaaaaggagagggggagctgataaggcatggcgtccttgaggggaggaaacttcggggaggcctacgggctcaggaacgcctacaaggaaaagctgaggcgaagggaccaatcttattttgcggcgccccaaaaagcaccaaggaccccgccggggccgctgaaaaaaaaaaaaaggttgctgctggcgccgttgggggcgcaaccaccaggggaggcttctttgccctcgggaagaagaaggtgcaccccaaacccaaagaagcagccgcggccactccctctggattatactacggtattccccttgccaccaagtggaaagccgcagttttcttct

SEQ ID NO: 62610 - DNA, 756 bp, Triticum aestivum
  unsure (1)..(756): unsure at all n locations
  Clone ID: PAT_TA_62610
cgctccgagccggccgggccgggagtccgnaatcagcaagcaagaacctgtaagttacgctagcaaaggaaagatggctgaaccggttaagctcatcggcacattggcgagcccattcgtccaccgcgccgctgctgccctgcggctcaaaggggtcccctacgagctggtcctggaagatctccagagcaagagcgagctgctgctgaagcacaaccccatccaccagaaggtgcccgtgcttcttcacggcggcaaagccatctgcgagtccctcgtcatcatggagtacatcgacgaggccttcgacggaccgcccctcctgccgactgatccctacgaccgcgccaccgcccgtttctgggcgcagttcctggaacagaagtgctcgaggccgttctggctggccttgtggctggatgccagcgaggagcagaaggggttcgtcaaggagatgaaggagaacctggcgctgctggaagggcagctcgaggggaaaaggttcttcggcggcgaatccattggctacctcgacgtcgccgcctgcgggccggctcactggatctatgcgttcgaggaggtgaccggggtgagcttgatgggcgagaacgagttccctgctctgcgccgctggggaaaggagtataccgagaatgaaaacgtccaggagtgcctgccgacgagggagcagctcgtcgccctcttcaccgcgaagaaggacatatacaagatggatagccacgcgatgctccatca

SEQ ID NO: 62611 - DNA, 755 bp, Triticum aestivum
  Clone ID: PAT_TA_62611
cctccaaaatcctccctagccccgccgttgccaccgccgcacaatgggcaccagagaggaggacgaagaaaatcccccttaaggaaattgaagcaaacaagaacagatcttagtgatgcagttacctggactgatgtgcattgttctgctttggaagatagtgtgtccctggaggatgttactatttccaagaagcatcgccgtgcttcctgccctgcacctttggatgtctctgaattgcgtcgcagttctcgccgcaccaggttccaaggatttaaggctacatttgttgctaatcgtcccaggaggcaccccttagtcaagccccgcccctcttctacaactgtagctggaccacacctaccactggtggcccctcctactgctggtccatctgcgcctgcaccgcctccatcgtccacctcaatacctgttctcgagcacatcggtgtctcccattgtagcatctcagcttcagagcggtccaacgagtgcctcgtgcaggctccatccactgaagatgatgggaactctacctgatcggctggatcttttcgatcattgcaccaagagtgcacttatcttagtttcatgtcgtgccgtgcttccattgcccctgtccccatttaatattttgcatgtgtgtttaagagtactttgttgaacttgtggtccatctaaacttcttttcggttatatgaattttattgtttggaagatcttatgccggaacatccgagatattaatctttatg

SEQ ID NO: 62612 - DNA, 292 bp, Triticum aestivum
  unsure (1)..(292): unsure at all n locations
  Clone ID: PAT_TA_62612
actgagntntctctaagnttggagagnagaggaaagattgaaagagagacagggaaattttagtggtgtagaagnttagnagggnnagaatggggttttgntgtgggnnttnagatgtnaaggtggtnnnnaagaannantntttggngtnntngnnntngnngtnngntaaagaatnnagnggtggtgggaagaagaagnagnngnagggngtaaagaaggaggggaaagagaagaagaggttgttttttgagtgggatgngatggngnngnnagggtttttttttttttt

SEQ ID NO: 62613 - DNA, 677 bp, Triticum aestivum
  unsure (1)..(677): unsure at all n locations
  Clone ID: PAT_TA_62613
tcgttcaaagactagttggaaaagttcatggttctctcttatacaggatggcatcgtcaatacaaccactcaccaaaggcgtatatgccccttcaggccctaatgatatacgaggtccctgtccactcatcaacagtctcgcaaaccacggttatcttccacgggatggccggaacgtgcgtgttgaagaagtcctggcaggcatgaacgccgttggactctctaaacctcttggggccgccttcgccaatccgatcttccaagagcgtgcgccctcaaaattccacgacgatcaagtcacccaaaggtcgcttttgcagaagttatggcagacagtaactgacccgtggtccgtcctgggaaaattcggtatgcgcaagccagggcaggttgactctgagggtcacagagtcttgaacttggaccagctcggcttgcccaacacagttgagcacgacatatccttgacccgtcgggatcatcaacaaggtgataatataactcttcaaaaagatctcgtcgaggatcttcttgctagctcanaggatggcaaggttatcacggttgatgatcttgttgagtttcgcaagaaacgcatcgctagacagaaagaagacaacccaagtgttcagtatggagcatttgaaaacgatctcgcttgtgctgagatcgcgttg

SEQ ID NO: 62614 - DNA, 556 bp, Triticum aestivum
  unsure (1)..(556): unsure at all n locations
  Clone ID: PAT_TA_62614
cntttcaaaactggtgctgaaaagatgatgcttccccatctgagattgcgcagcgcgccgtctcgcgtctctgcaacagcgacaacaacggattgaagccccgcgttctcgttgtcggaatcgggttcaagcgtggtcaatctcatctcgcaaactcgcctggtcttgagctggctaagaaattggtcgagacgaacaaggtcgatgttgcttgggctgaccctttggtggcgcaggaggctgtgcctcagatcgagcgcctgcctgaatcggattggacagttgaagcactggaacgtgactttgacatggttatcgtcgcattccgtcaagacggtcttgattttgatgtactagaccaagttcaaggagtcttgattgagcgttggtgtatttgaggtgggaggaaggaagcggtggggtaaagcttaaaaacaacggtcaacacacgacgaactattgattgctctttcttaattagaacgtttgttaattatttctttctctattgttctctaattaggcactaaaataattaaaacgaggttattgatag

SEQ ID NO: 62615 - DNA, 487 bp, Triticum aestivum
  Clone ID: PAT_TA_62615
gcttctctgcgtggtagtggtttctttgctcttaccagcacgcttgatgcgtcgcgggacagccaccgcgtggtggttgcttgtcgccgccgcgctcctggtcctggttctgccgctgctggcctcgtccgcgcgtcctcctccagtgctgcaacgaggtggtggcgacgccgggctgggtggagggagagagctagcggccatgggagctgcgaggcggttggggcagaggacgccggtgaataagcctccctcgcccaacccccacggcgcgtcgtcgatggccgtgccgccgccaccgtcgcttactagctagggccaaggtcaggtgcgtgtatgtgaatgctgatacgtgtatgcgatggtgcctgtgatcgcctagcttggataggcagactatgttcttcccgatagccgatctcctgatcggtattagagaagaaacaactagcagctgtgcacaataaatacgggttttgctactgat

SEQ ID NO: 62616 - DNA, 524 bp, Triticum aestivum
  Clone ID: PAT_TA_62616
acctccccaccctttctcttgcgagtttggatccgtcgtctgtcctgggcgactaaacgagcttcgatcaaccgttggtgtgctggcgtccaagactagtccaccctaacgcccaccgccaccaccctctagtctccacagcttcatgctgagtcgtcacgtccagcttctagttagagactatactgcactgtactgttccataccatactcgatcggcaagctatctggttatctatctaagccgttaccgccagccttgagacggtcgttgcaatagattgctctcccaactcttctttctcattcccagaggggcaaggtcatattagtcttctatatggccctcgaatattcatttgacttttctcgatctgaaaggaacctagcctggtgcgacagacataacatatcccccgaagagccaaatagcatgatgccaccatcgcctttaccaatggactcgctatggatgtcctctgtggcaaatcagctacagcctggccagatatcacctttaagtg

SEQ ID NO: 62617 - DNA, 400 bp, Triticum aestivum
  Clone ID: PAT_TA_62617
aactgtcggcatcttgttgtccttgctatatcacactattgacagctcatggccgaagcatcagaaccctctacctaccaaaaccccacctcctccgagcctcctctgcctccagctcctcctttctcttgatacaatcgctgcaattatcactgcttgacaagatttctgttacaaatacatcggggctaacattgcagacaccgttttctttcataccgtcacagggcacagttggaccaaaagacctctcaagtatcgcccggcattccatgcatctcgtcatgacacagatcgtattgcacatgttgacggtttcaaatattgtttaaagttgattactggcttgttataagataataggttgtttgataatacttctatgtttatactgtcccgg

SEQ ID NO: 62618 - DNA, 490 bp, Triticum aestivum
  unsure (1)..(490): unsure at all n locations
  Clone ID: PAT_TA_62618
ccgaagcatgcccccaacccgcacccnaccccgcagcaagggcgcgcaccaagcagacggcgagtaagccgaccggcggcaaggcgccgaggaagcagccggcgaccaaggccgcccgcaaggcggccccggccaccggnggcgagaagaagccccaccgcaaccgccccggcaccggggcgcagcgngaganccgcaagnaccagaagagcacggagnngcnganccgcaagccgccccnccagcggccggcgcgagagancgcgcaggacnncaagaccgaccnccgcaaccagagcgccgccgggaccgcgcnccaggaggccgccgaggcgcaccccgacgggcgcaacgaggacaccaaccncngcgccagccacgccaagcgcggcaccaacacgcccaaggacaaccagcacgcccgccgcaaccgcggggagagggcccgagcagcgacagccgcgcgcgagcgccgccagagagacccaca

SEQ ID NO: 62619 - DNA, 174 bp, Triticum aestivum
  unsure (1)..(174): unsure at all n locations
  Clone ID: PAT_TA_62619
agaaagaaaaagagtttccccaaaacgggnggcgagcaaaggggcagcnaanncaaccacagncncaagactgtggaccaagacacggancacgcgcnccgnnggnggacggccgggacncaacggaagcgccgggacgggaagancacgggggcgaaaanacaanccaccacg

SEQ ID NO: 62620 - DNA, 314 bp, Triticum aestivum
  unsure (1)..(314): unsure at all n locations
  Clone ID: PAT_TA_62620
tttcccccccggagcgccccccggcagcggccgcacgcgcaccgggacacccgcgagggcgcggccccgaagaaacgcgcgccagaaggcngcancaacaaaggaagaggcggcngccaaaacagcggcagcgacggcggagacgggaggaccgaccacgggggacaagaccaacgcaaaggaaagcccagcaagcgacgccaacgaggangagaaaggcggggcagcgagagagaacaaaccacaatgtttttgttcccccccccccccccccagaaggaagagaggggnaaacgggacgcgacaaggaagaa

SEQ ID NO: 62621 - DNA, 422 bp, Triticum aestivum
  Clone ID: PAT_TA_62621
tatttcggaactagatggctccatccaccatcctttccatcaccacgcggagagccaacaacagcaaagcaatccaccgagcgcgacgatgtgctaccaggcgaagtgcgccacttgcggcaagcccacgtgggcgggctgcggccgccacgtcgcctccgtgcaccggcagatccccgacggccagcactgcgcctgccgcgactggccgggcgtctccgccgacgccaacgccgccggctccacctccggcgccgtcaaggagtcctccacctgcgtcatcctgtgatgtgaggcgcgagtcgccgtccgccgtgcccgtggccgtacgttgacttgttctctgcctctccggccggatccaagccgtggcggtgggcgcgtctcgctgcagcacctagcgcatacatttgccatctctt

SEQ ID NO: 62622 - DNA, 615 bp, Triticum aestivum
  Clone ID: PAT_TA_62622
aattcacaccagaggtctcttcctcccttgccttcacaagacgaagtgtcgcacgccactccgcatcatccatcacgcaccgggacctgggcactcggacgcgcaccgtccaagagatcgtccgtcccgcggcgactgttggatccatgatcgacatgaacgacgagctgaagctgcacctgcacgacaactggcacaagctgaaggccatcaaagaacgtctccactctccacggcatcgaccatatctacgaggacaccaacgaccaccagatgactgcggacttcatcggccaccccgtccacttcacccgcaagctgcgcaccaagctcttctgcatgtaacagatcgactccgtcgacccgaacaacgaccacaagaacgacagcgccgctatcaacgaactcatccctgtgtacgcgccgagcaacccgtcgccgccgtacctctaccacccgcactcgtactatctcaaccacaacgacgaggacgatcccagctcctgcgacatcttctgatccagttgcacatttcataaccggccctcccatagatcaacctgctttcagcagtgatcatcgccgactgcatgcacctgtacatcgcaacgcgcg

SEQ ID NO: 62623 - DNA, 605 bp, Triticum aestivum
  unsure (1)..(605): unsure at all n locations
  Clone ID: PAT_TA_62623
aactactgtctagggcacatctagctacctattatggcctccccgtcgtccctcaaggtggctgccaccgcccccgtgttggtgctggtcatgctgtcttcatccccttggcaggcggcggcacagatgcagtgcagcaggtgcaccgaagactgcaactcttcgtgtgatggttccagtagcagcgtgagatgcagcaggacctgcgccactccaacgttgcagtgcgccaactgccagagatgcatgaactcttgcttaagctactgccagtccacctgcgttaattaacagctgaaccaatattcttatcgaattgctcttggggattcttttattaagcaaaggttgcaatccgcagttatatcaagttatatctataaatttattttcgtatgtgtaagaattgcttgtgtcctcttgattgcttgttcatgtatgttttgtgtgtgtagtatgtaagatattgcgtaattatatatcacttgtaagctgtcacgccaatcgcatatatatacactcttacgctaagctgcactgtacttagattttctactaataaagattggagttgatgctgannnnnnncnnacnnnannacaacc

SEQ ID NO: 62624 - DNA, 729 bp, Triticum aestivum
  Clone ID: PAT_TA_62624
acttcccgccgccgccgctgccgacgacgactctaaccgaccgagcgcgagcaccgccgccgccgccgccgccatggtctgtccctcgcctgtgctcctcccccgtccacctaccttaggatgcgatttcctgctagaggatcactttgcgactgcggtagatgcgctcgtgtttaccaattgttgcctctttttctccgcggctcacgcgctggtgcttgtgggttctctgtgatgatcaacaccgattagatgtccgacccaacccattccgctaaaacatggggacaaaacgaggcatttgtctgagagaacactggttctgttatgcctttgtcctgtcatgctgctgcttgaattccatgtgcttattgtgtactagtaatttgtacgtgctttgcacgttagattattatgtgtgaccataatactaaatcatgtaaattaaaaattgaatattctgtgctataatcaaatggtaacttctggatttttttacaattcgtcttgaatcacggtagcacaacggatttctatatgaagaatgttttgaaaaacatacttttattccaaaagaaatgttattgacgtgtttgtgaaatcttttagctttttcatgttccaacttgaaaatacaaataaagttagtttgatgttaattttcaccatttcaaacagtaaactttaaataatttaacatccgaaaaaaaaaaaaaaaaaaggccccta

SEQ ID NO: 62625 - DNA, 321 bp, Triticum aestivum
  Clone ID: PAT_TA_62625
actaccaccaggggcactacgaataccttttttctgtctttttgtttttattgtatttctctatttgaaagcgggagttactctatcaggactacaaagtgcacagcagccgctatactagccaaaacattttgtctttttcggttttcatatgttttatctgagtattagcaaggcgttttggacaacgggactgcaaacggcaccggacaataacggattacggatggataccaccatattactacagctgagcaaaattgccagttattttaccactagttacttacaccacacccaatgaactcaaattacctattc

SEQ ID NO: 62626 - DNA, 625 bp, Triticum aestivum
  Clone ID: PAT_TA_62626
cggccgctcgaggcggccggccggtgttccgaaggcgtggatcaggagctccaatatgccgacgtcctctggcctcagcacaactccgaccaccgccgcgacggcgacgacggcagcaacgtcgacggggacataacaaagctatcctcgccggagctgtctgccccggtccccgtgcctcaccggaagcggcggtctcgctcctggtcgacgtccgacgggagcggcagtggcaacgacgactgcagcgacggcgacgtccgatgcaccaacgacgcaaagaggaacgtgccgccgcacgtcctggccgagcggcggcggaggctcgccgggaggtcgacggcggcctactccatgtgcagcgggaaagggaggacgctcaaagggcgggacctccgcaacatcaggaacctcgtcctcaggttgaccggattcatcgagaaatgaaatggattcagcaccgtggatgtgggtatattgctgcattgcttgggaacgtccatgtccatggacgtgtgtgaaagtttgtggcaacctaattagagttttcagtgagcgcagaggtgaagaaagacaagaaatgtagcaataactctctgtttaattaattaattttatctgtttc

SEQ ID NO: 62627 - DNA, 649 bp, Triticum aestivum
  Clone ID: PAT_TA_62627
agtgctatctacccacccatcaacgtgctgccttcgctgtctcgtctgatgaagtctgctattggtgagggcatgacccgaaaggatcacggtgatgtttccaaccagctgtacgccaagtacgctattggtcgtgatgccgcagccatgaaggcagtcgtcggtgaggaggctttgtctgccgaagacaagttgtctctcgagtttctggagaagttcgaacgccagttcatcagccagggccagtacgagtctcgatccatttacgagtccctcgacctggcatggagcctgctccgtatctaccccaaggagcttctcaaccgtatccccgccaaggtcctcaacgagttctaccagcgagccgccaaggagtccaagtccaagggcaaggcccgagcagacaccgaggcccgcggccagcagcagacagaagagaacctgattgacgcatgaggggatgacttgtcagcattttgatagatagtataatgagcgcgcgcaagagggaagagcagacagagcaacttgtttttaagtggattgttttcatgccgtcttttgatggaagctgtagatcagagaaagagtaggcatgtgggtaaagatagggaggcgagctaatgcaattcaaccaaccctctacctg

SEQ ID NO: 62628 - DNA, 818 bp, Triticum aestivum
  unsure (1)..(818): unsure at all n locations
  Clone ID: PAT_TA_62628
acttccttaactcttctcttcccaagtcagcaagggtttggatattcatcatgtcgttcacgaaaagatcaggctggagagtcctacaaggacacctccaaggaagacccttcaagtcttctcgacaaccctgagaagcttgttgcggatctgatgaaggattttgctggtgttcgaagccaagctagtcctgctgatctcttggctcttgtcaagcagcttctctccaagggacagcctcttgatgataagaagggaactactgaactcctcatcggtattctcactgccctgcctcgctcctccaaggctcgcaccgctcttacaaacaagctcatcgacactctctggggcaatcttcaacatcccccactgagctacgttggtggcgacgtcaagtatgaagtcgctggcgcagagccagaccacaagagccattgcgcacaatacgacacaatcgagtttcaggtaccaggtaccaatgttaccctcaaagaacaagtccctcaagcacccgacggtctccatcaataccgcatgcctgatggaagcttcaacaacatccttgagccaaacttgggcaaagctggcaccccctacgccaaatctgtcaggactgagaagcgcctgcacggcgtcaagcctgatcctggtttgctctttgatctcctcatggctcgtgatgaaggctccttcaaggagaacccagctnggtatctcttcatgctgttttacacgccgncatcatcattcatgacatcttccgcacaaaccgcacagacatgaaacagtctgacacatcttcataccttgatctt

SEQ ID NO: 62629 - DNA, 777 bp, Triticum aestivum
  unsure (1)..(777): unsure at all n locations
  Clone ID: PAT_TA_62629
aacctcttccctggcgcagccctccctcctcatacacctcctcatcctcctcctcctcctccgtagtgcttagcgaagctctgccggagaaccacgagctccattgccaccacgttgtcgtgctgctggagtcctccctcaacttctcctctccccttgctggatcaagaaggaggagacgtccccgggctgtacgtgtgttgaacgcggaggcgctgtccgttcggcgctagatcggatcttccgcgcttgaatcgctgcgagtacgactccatcaaccgcgttcttgtaacgcttccgcttagcgatcttcaagggtatgaagatgcactccctctctctcgttgctaacatctcctagattgatcttggtgacacgtaggaaaattttgaattattgctacgttccccaacagtggcatcatgagctaggtctatgcgtagattctatgcacgagtagaacacaaagtagttgtgggcgatgatttgttcaatttgcttgccgttactagtcttatcttgattcggcggcattgtgggatgaagcggcccggaccaaccttacacttactcttacgtgagacaggttccaccgactgacatgcacttgatgcataaggtggctagcgngtgtctgtctctccactttagtcggatcggattcgatgaagagggtccttatgaagggtaaatagcaattggcatatcactgttgtggattttgcgtaggtcagaaacgttcttgctagaaacccacagcagccacgtaaaacatg

SEQ ID NO: 62630 - DNA, 809 bp, Triticum aestivum
  unsure (1)..(809): unsure at all n locations
  Clone ID: PAT_TA_62630
aattttctgccacttcgattcctcgatcccgcgttttttatcatcaacaacatcaatcgattattcgacatatcggataccgcgttcgagtccttggacactcatcctcagatttttgatacttttatcttacgacttttttaacgcgactacatcgacaatgcctggtggaaagggaaaatcttctggcggaaagagctccggcggcaagacgagcggtactgagggcgccaacaagaagcagcagagtcactctgctcgtgctggtcttcagttcccttgcggtcgtgtcaaacgtttcctcaagcagaacacccagcaaaagatgcgtgtaggagccaaggctgctgtctacgtcactgccgtactcgagtacctgactgctgaagttctggagttggcaggcaacgctgccaaggacctcaaggtcaagcgtatcacaccccgccaccttcagcttgccattcgtggtgatgaggagctcgacactctgattcgtgcgacaatcgcctacggtggtgtgttgccacacatcaaccgcgctctactgctcaaggttgagcagaagaagaaggccaaggcgctcgagggttaaagaacaggtctcctatcggggtttagttttgctttttctgcttccttgngtcttgtggtatactagtttatgggacggtaatgcataaattcgaattcgacggtggcgccgcgtcgcaagaatgagcggacgtccgcacgaccacagcttgaatattttttttggctgaagatgcctgcgcttttgaaagaggcacacgacgagctctcgcgtc

SEQ ID NO: 62631 - DNA, 472 bp, Triticum aestivum
  Clone ID: PAT_TA_62631
aacccaatcacccaaagcgtgtgtcttttcaacaaaaaatgtgcggaatcgttccattcgtcaaaggtctctatgaggatcttctagaagccatagacgacctctttccaagccggaccgccgatacagctccgctcatgaacaatcgtcaatcgttcccactggcgcagccctacaaccaagcatacacatcagcctctcgacctgttgcagaggaccgttgcgaggtcacagaaaggctggaggtcagaacggcacgcgcaagaatgccgtcgcctccgagaggaccaccgactagatgatttgaggagagatttggaagcaattcactatggatagtaaagggtcgttcaacattggaagtatctggaaggtatcaaaattatgcccatcaaggcttgctttagcatggatagattcaagaaatgactaataaaaaagcttccaaataacacgtcacaacattcttagc

SEQ ID NO: 62632 - DNA, 399 bp, Triticum aestivum
  Clone ID: PAT_TA_62632
gctcttgacagccggtaacggcagggacagcgcaatctctcaggaccgagaagggcacatcgcggctcctctaacaatctctacccacacttcgcgtcacctttccctctctttcacctcgcacaaatgtttctatctcttacatcctcggatcccgacattgtcactcgacccgcgcctcccatcttatcgctcacataattcccacatcactcatcgctctcacataccccccttgacatcaccaacgccggctcgcccattgtgcattcagctcctcgcgacccaataaccatgttaagtgactcctcgttccgtgttgggatttacaagatattcttagcaggggtggatttagcttgggcccaagagccatcaaataaaatcaaaattatgagc

SEQ ID NO: 62633 - DNA, 763 bp, Triticum aestivum
  Clone ID: PAT_TA_62633
cggccgctcaggcggcgggcgggagtttcactccaacaccagccagatcctcaccatcaccgcagctttctgtcactattcgcctgggctttgttagagatcccttctttgttaacaattccaatttcgacgtctgaaggttttcgccatgtctcgtcgttacgattcccgaacaaccatcttctcaccagagggccgtctttaccaggtcgaatatgctttagaggctatttcacatgcaggtaccgccattggtattctggccaaggatggtattgtcctcgccgctgagcgaaaggtcacctcaaagctgttggagcaggacacttccgctgagaagctctacatcttgaacgataacatgatctgcgctgttgctggaatgaccgccgatgccaacatccttatcaactatgcccgacaagccgctcagcgatacctcctcacctacaacgaagacatcccctgcgaacaactcgtacgccgactctgtgacttgaagcaaggccacactcagcacggtggtctacgtccgttcggtgtgtccttcatctatgctggctgggatcctcgacgacaattccagctctaccttagcaacccttccggcaactacggtggctggaagggcacaagtgcaggtgccaacaatgcaagcgcgcagagtctcctcaagcaagaatataaagaggattgcactttgaaagaggcttgtggtatggcagccaaggttcttagcaagacgatggactccactaagctg

SEQ ID NO: 62634 - DNA, 742 bp, Triticum aestivum
  unsure (1)..(742): unsure at all n locations
  Clone ID: PAT_TA_62634
gttctacttctttcaaagacataaacttgagaatcctggttggagcgtcaatatcacaaccgccgagatggttcgcgagagtggcatctcggccacaaaacctattttccccaatttcttactacccagtatcaagcttcccttctcccgtcgccactcggcatcctcgagctcagcagaatctgctgcatcgtcagcggtgacaacgccagcaagttcacccccgaacgatggtcatttagcaaaggccggtcgcaaccgactatctcgtacctcgccgaacacgttacgttgctcaacatgctccgcagacatcgcctttgcctcccaggtcatctcgaagggcttcaccggccgatacggtcgagcgtttcttgtcgcgccacccgctctccctgcccctcagactctgagtaacatacggattggcaagagtgagaaccgacaacttgtgacaggttggcatgttgttgcagatatcaattgtggggcatgctcgagtaaacttggttggaagtacgtggatgccaaggaacaaggccagaagtacaaagtcggcaagtttatactggaaatggagcgagtcgtcacatatagaagctgggaagacgccatcgatgaacatgaagaggagcctcccgcgacatccaagaagagtagcgataacgaggttgagtttgattcggacaatgatgatgaatgtgaggatatttttgcggggacttgngaccctgaagttgtc

SEQ ID NO: 62635 - DNA, 766 bp, Triticum aestivum
  Clone ID: PAT_TA_62635
catcttgaacttattcccgcctatgggctacatccgaggctggccaagctcagtctcgcacccaaacctacacgtacctactaccccacagaaagcctgaatctgcacacgctttggcccagatctatgctacaagctcatcaccaatatcccgcccacccccatcttccctatccaaccccccgaccgacaatacgccatgtccgatagaccatcacaccgaggtggccgcggccaaggatcacatcctcgaggtggacgcggaggcggtcgcggaggaggcgcgggaggcgctcagcaggagcgcgagagacccaagaaggagaacatccttgacctgggcaagtacatggacaagcagatcaccgtcaagtttaacggtggccgtgaggtcaagggcacgctgaagggctatgacgctctgatgaacctggttctggatgatgtgcatgaggttgttcgagacgacgaaggcaacgagtctactcgatccctcggtcttgtggttgtacgaggcaccctccttgttcttgtcagccccgtcgacggcagtgaagaaattgccaacccttttgttcaacccgaggatgactgaagagacaaacacaagcggactggaaatgaaaatcatgacgatacgcagtaaagagtcaagtgcctgattgagcgccagccacaaaatatacagccctgtcaaggctcgacgactccaagaagagatcgagcaattacttagactagactgccttcctcaagcatgccatct

SEQ ID NO: 62636 - DNA, 596 bp, Triticum aestivum
  Clone ID: PAT_TA_62636
atcccctctcacagtatttccttgagattatatgcgtcccgaagctttcagttcatcattcaaaatgtctgccggcgatatgcaagacgagcagctcaaggaggctctcatcacctacgagaagctccagggcatcgaggatgactttgaggatgtcgagctcgagatcctccgtcagcaggacaagctcaccaaggatctctacgtccgacgtgctgaggttgtctccaagatcccccagttctggcccctcgtcttcgagcagtcccctcccgaggctgacgagtacatccagcccagcgactctgagctcctcctcaacgccctgaccgttctctccgttgagcgcttcgagcttcccaacggcgaccctcgctccatcgccatcaagtgggagttcaaggagaacgagtggttcgaggacaaggcccttgagaagaagttctactggcgtttccccaaggacggctgggctgggctcgtttccgagcccgtcgacatcaagtggaaggagggcaaggccctgactaacggtatgctcaccctcgccaagaacgcccccgaccaagaagaaggccggccagaagcccccggtg

SEQ ID NO: 62637 - DNA, 486 bp, Triticum aestivum
  Clone ID: PAT_TA_62637
attccagagctggccaaggtgctacgaacgcacgaaaagaacatctgcgacttttcactacctaccctaaccggccggtgagagattaagtgacagcctcgaaaagtctagagccatgaataagagaggtagggatgagtgggacctgcacctggcaaatctggacacgtcccgcctgctcatgctcctcgcgcagcagcaccagcatcaccagcaccagagcgccgtcacctgggcggtgcaggcgacgggcagcggacgcgtgttcgagtggaagactgcgcaaccggcagtgccgcacgctccagaagctcgcatgacaccgagccagtcttttttgactcaggctgccccatccgtatccgtgaatcgctatcagaacggttgacaacgacacagagcaccgcctcggtcgtcacgcgccgccggaagcgggcagcccgaagtggcacgagtgtcccgtctgcggggtccagatcaacgacg

SEQ ID NO: 62638 - DNA, 708 bp, Triticum aestivum
  unsure (1)..(708): unsure at all n locations
  Clone ID: PAT_TA_62638
gggccgggactcaaaaagaggagtgcccgcccgggtttgccggtcgagacggcaacagatcgagtcgagctcctttcctttcccacgggccttcggaagcaccgggcaaagcggcatcatttgcgcgcgcgcggacacggacgcgcatgtccatgtgggctgtggagcatgtacgtatgtctgtccccgatcccagtggcgcgttaatggacacacgcacgtagtacgtacgtacgtacaggggtcgggccatggcctccctccctgtcctggcaccacatcaagggcgcggcagagctgcaaacacggacacgggggctttcactgtcgtgccgtgcatgttccgccgaggcgccgggcgatgccgatgcacccacccacccggncaccccagctaggccggccgcccattgatggccgcattcattggcacacgcatacgcccgcgtgctcgctcgctctcccaaacccagcgcgcgcgcagcgcctctatctcctctcgtctccaagagaatccgtccgctcgtcacgtacaagatcatggatggaccgccgcccgggcgacggcgaggacgcggtcgaggtgatagatcgctcgccgggacgcgacggagcgggcccaggggggcggcgaaacggaactgcggaagatacggaaacgtgccccgttttttgagctccggcttccttctcctggccggggggccg

SEQ ID NO: 62639 - DNA, 764 bp, Triticum aestivum
  Clone ID: PAT_TA_62639
aatacaaacactgaaggatccttcgagctttgcaccacctcccaaacgcactggcactggtcttattccagcagcacccagaagagatactgcctccccatcaaaccatcaggatccctacgcccctggctcccaagaacatggatataccgagtctcaggaccaagccgaggagccgccaaaaccccgcggtccgtatcgtgtagacacgaccggcctctcgacagataacctacccaagccacctggacgaagagacggcgccgatggacgttcggcacagccaccatcatatcagtcagccatgacaggtgtaggaggaggaagagcagcacctcctagcctaccaccacgtctgcccccaaggaccaactctgcgagtacagtggagagctcacccggcgctagccctgctcctataagcagtggactcttgaaccaaggagcagtgagccgcttgggcgcagcaggtatcaatgttcctggcttcggtattggtcgctcgaatgctgcatctccaagcccacctccgcccccgcgcgcaggtgtcgctgcacctcctcctacgcagactccatcgcatatgagcgaactacagaaccgattctctaagctcggttcatcgtcgtctaatgccaatgcagcagcacccccacctcccagcgaagggactacgtgggcacagaaacaagccgctctcaagactgcatcgtcgtttcaaaagatccttcatcagtctcattttcagacgcccgagcagccgc

SEQ ID NO: 62640 - DNA, 757 bp, Triticum aestivum
  Clone ID: PAT_TA_62640
atcattctcccaaccccgctatttaccatagctatttgcatagatttccgcgctctttcacttcaaacatatacctgtatcactgaataacaccaggctcatactcagtattaccgcaatgggcgccgacattcagcaatggacgatagagaagccctggcttgagacgcattgtctcttgggtgaagggcctttctacgagaaatctgtcgacactttgcgctttgtcgacattcgcaacaagcgattacattacgtcaaggttaccgaaggcccttcgtctctcaagaccgttcagttggatgtgtgtcctactgttacagccaacattgccggcgtcgacccacaggagcgaattgcactgggcgtcaagtatggactggcgatctttgatgtgaagaaggagacatatgagctcatccaaccattcgaggagccggcgaatgagcgtctgcgtagcaacgacggcggcgtggaccctctcggccgattctggcttggaaccatgactgattttggtcttggaccctttaagcctgaaggagcggtttatctcatggattccaagtcacgggaggtgaagcttcctgatatgacgattcccaacacgccagggtggtctccagacggaaaaacactatacatcacgcattcaagcgccagggaagtctttgctttcgactttgatactgaatccggagagatctccaacaagcgtgtcttctatacgcataacggctcaggtgagccggacggt

SEQ ID NO: 62641 - DNA, 751 bp, Triticum aestivum
  unsure (1)..(751): unsure at all n locations
  Clone ID: PAT_TA_62641
atctcccgttgtcctcagtccatcacccaattcttcaacccaggtctcgtcttataatacacaatggctggtatcgcttactacaccattgccggcaagcaggtcgccggccactacctggccatggcctggttgggaaccctcttcgccggtgtccagtacgccacctctggaagctcagctaagcctaccgctaccgctactcctcccatcaacgcctccagctccgacgaggccagcttcatccaggacttccttaaccagcaggacaagaagaactagacggttgcatcaatgacaatggtcatgcggttatttggatgcggtgtacgtttataagccatggaagcataagcggtccatcgagccggacagtcaaattcagataccaacaaaagcctgtttcgccaatcgtggcatgacgatactgaagaccgatttcctccatttgtgaaacactcgaatatgcgaccgacaagctatcgatgtcattagtccgggcctgaattttgatgttgcgattttgcgtgtaaccttcacgccaggctgaaattgtcgatgtttttatcgagttcgaaatgtgcaagagagaatccatttttatgtcaatatcgagtactgccaacacgatctcggcttgaactttctgttgngtcgatgtttcagcattgtggttcaattcaatttcgagccaagggctacgctattgttgagttgtgactatagtttgtccattgactccttacttaac

SEQ ID NO: 62642 - DNA, 815 bp, Triticum aestivum
  Clone ID: PAT_TA_62642
tcgaggggccggccgggcccgggcatttccacaagcaaacacgttaccagaacagaaacaacacatagtcagataccctgcatcgactgaatgctaaggcagacacaatgcagacagccaacaaccccatctcccaccacaccagccacaccatgggcgaaggtgctgctagtagcaacagcggcgacaatagctgcggagcgaatagcgtgggtcaccatactagccacaccatgggccagggcgccagcagcagcagctctggtgccaatgggggaggtggggttgctgaggctcagagagtcgacgatggcatcaccctgggagcctccctaacagacgtcgagacctacaacaacgacaacgataacgaatccgacgatgcaagctcccttggcgacagtctcgccagtctcgatggtacagctggctctgtagctacctccatgcgaagctctggtagtctctccaacttcaagatcatcgacaccaccctgcgcgagggagagcagtttgccactgcctacttcaccaccgagaccaagatgaagattgcaaaggccctcgacgacattggtgttgaatacctcgaattgacgtcacctgcttcctccccacagtccaaggccgatgcccaagccatttgcaagatgggtctcaaggcaaaggtcctggtccacatccgatgcaacatggacgacgctcgcatcgccgttgaaacaggcgtcgacggcatcaacatgtgcattggcacttcggcccagctcatgaagcactcccacggcaagaacctccactggattgccgcaaaggcc

SEQ ID NO: 62643 - DNA, 745 bp, Triticum aestivum
  unsure (1)..(745): unsure at all n locations
  Clone ID: PAT_TA_62643
atcttcccagcactcacaatccaatccatccaactatcatctacttgagcttcagcctcgaccattatcaacactacctcaatcaactacaatcaactttgacaatttgtccaacaccacccaatccagcacaatgtctgcccctacttccaccgcttctccccctcctgcctctgaccttccctttgccaaccttccctcttcccctgctcctggccgcaactccactactgctctgtccaagcctgcctacgcctccgactccgactctgacggccaggctcgaggtggtcgccgcagccagaagcagcagtttgttgttcctcttcccacctccaccggcctctctcagcccgctggtcaacttctcaagggtgccaccgatgagaatggcaaccaaaagtccgctgctctccttgtcggtatcaagctcgaccttgaggccgaggttcacttgactgcccgagtcaagggagacatctgcattggactctactaggcgacggacattccttctgcttcgacctcgacttcgacttcgacttctgagtttatgtgcttggtgatctggtcgcagaacacagccggtgatcatgttatgatgatgaatggaacgcctcaacgtgcctgactctctggacgagctggcaaacatattgnggtgtttaaaaatggatgggattttcttttactctgngcttgcatgtaaaatttatagctnagataataacagctctttgctacc

SEQ ID NO: 62644 - DNA, 174 bp, Triticum aestivum
  Clone ID: PAT_TA_62644
gtctgcaggaagaggacgggggagtggttgccgccgttgacaaggagtgatcgatggagcgagcgagtcagagtagctcaggatcaggatatcatcatgtgtcagacacattttctccctatttgttattggagatgacgtttatttctagcaagtaatgatgacgcttacatt

SEQ ID NO: 62645 - DNA, 652 bp, Triticum aestivum
  Clone ID: PAT_TA_62645
cctttcccggcgggcggcggctggtttaggcatcgagctgacggcggatctcctcaattccttggtgttcttcagtcccctcccctccttctcctatagtaaaccacgcggagacgatccaagatgggtaggtgctgctgctgtttcccctccaaacccccaagggagaacccaatgcacccaatcgcagagccgctcatcaagcggaagcccaatcacacccctccctaccatcaaaggcccccggtgaccacccatgctcacaagggtatgaacgctgtcgtgcgcctgaagaccggcttcgagcgtttcagaacgaatgtgtacaacaagaacccgaagctttttgaatcacttaggaaggaccagtcccccaagtacatggtgtttgcatgtgctgactcgcgtgtgtctccaacaataaccctcggactgaatccaggagaggccttcactgttcgaaatattgctggaatggttcctgcctatcaaaagacaaggcactgcagcgtcgggtcagccatcgagtttgccgtggttgtcctcaaggttgagtgaattgttgtgattggtcacagccgctgtggtggaattagggaactactctcactgaaggacgaaggggctaacgcctaccacttcattgaggact

SEQ ID NO: 62646 - DNA, 760 bp, Triticum aestivum
  Clone ID: PAT_TA_62646
actgatcatttatctgacttcagccctacaaaatcacaactaaccccccccccccccctctcacccaactgaacattggcctgagcatcatctgctattttttatgaagggtgctcacctgttcatagcccgtcgtttcttacgtcgaccgaaaggttttagtggcttgataatttgttatatcatcttcctttcccacctacggtaacccgaacacaacgagcgtcttgatcccatcccatacacaagaactcaacttgatataaagcaccaccaccgcacagcaactttccaaacatgtgcaacccagtgcgaccagccatgaactgcaagaccggttcatcagaactcgtcaactatgccaatggtgtctgcgcacacaatcttacccacaactgcttcgagaaggccgccccaaatgacaccctttgcataatgtgcagaaatcagtgccctgcttaatcaaagcacgcaatttgacctggtcgacacggacctgtcatgataaaggctcggcaatagggagccatcatgatacggtcctagctcacctgttgcactgccttgtaggccccaattggcacacaaagcaatgcaagaacgccaaggtatcgaaggaaggagccagaaagaagtgctatcagtttggtggatcagactacgcaaagtgatagtttggagagggtgggactcgattttggatccagacgcatatgcaagacatggtcacagtcaagatcctgggcatgacctgggtttc

SEQ ID NO: 62647 - DNA, 798 bp, Triticum aestivum
  Clone ID: PAT_TA_62647
gaatctcacatctacaaacaaaacaaactcaataaagcttcaaaatgaaggtcacttttgccctcgccgttgccatcctcggcgctgaggtctctgctttcccccagttcatccctcccaagtccaactacgcccttcgtccaggcaccaccaacaacaaccaggacagcaacaccaacaacaagttgtaaatgcgcccaacaagcacgctgccggtacaggcatcaagttcactcccaaccaaaagtcaggcaccaaagccgacaacgtggttcccggcttcgtccccgtcaagggcggcacagtcagcagacgttccgacgatgatgatggtgatgatgatggtagctacgatgtccccaagggagatcaagatgatgacagtggtgatggagtgatgttcactacctttactgctcctcacaccaaggtcggcaccatcaagaaggaagagagtgccggtgatgatgagtctgccgaggagcgcaagttcaaggcgcccagcaccaagaagcagaacggcaagaagcagaagcacactggtgatgatgattcacccagcaagactgatgaccaccccaagacctctccttctgctaccagagcaagtctgaggataagcccaaggcttctggctcaagctcgtccgatgacaagaagaaagcagccaagcaggcccgagaaagatgccaagcagggcgaaaaagacaagaatgaggctgaaaagaaaaagaagaagcactctggcaacgatgactctccttccaagacgacgatcaccccaaggtccctccctct

SEQ ID NO: 62648 - DNA, 615 bp, Triticum aestivum
  Clone ID: PAT_TA_62648
atcagacctcctgacatctttgaaccactttgagctggcctcaatcacaagtcttttactctatttaatcacccaagatacccaatacccaatacccacagtacagaccgttcaactacttcaagatgaagtccttctccctgatcactctcttttgcaccctggtcactgctgcagtcatccctcgagatactgtctttgacggccactgctgcttcactctacatgacgtagccaacgatgcagcagtgcaagaaaacagcaatggaaacttgctcctcaatgctggcagcaccagtggcttcttctgcattgacctgtccaactcgtaaaacattctgcgagaccgctctttcaatgcctgcttcctgaaccctagcggcgaggttaaatgcgtcgacccaacacccggctttgagtcttggaccttgaagaagagcggcagcaacactcttctccaccgcgacggtgcaaccgctttcaactcatgctccaagacttcaacaagttcaaagggaacggtgctatttggcgaacagcacactggtgcttccacgtgcaagaagactacactccaggtgaaaaatttgaaggggacatgcaagaacttttgag

SEQ ID NO: 62649 - DNA, 625 bp, Triticum aestivum
  Clone ID: PAT_TA_62649
cttccgctacagggccacatcggtgcctacctcgtcgttgctggtgtcgaccctaccggcactcacctcttcaccgtccatgctcacggcagcactgataagctcccttatgtcactatgggaagtggtagcttggcagccatgagtgtattcgagacacagtggaagcctgatctcagccaggaggaggccatcaagttggccagcgatgccatcttggctggtgtgtggaacgatttgggctctggttcaaacgtcgacgtggctattatcaccagcgacaagacaacgctcaagagaaactacattacacctaaccagaaggagcctaagctccagagttaccgattccctaagggcacaacagcggtactgaacgaaaagatcattaagaaggaagaaatcaagaggtacattactgtggaagacgtgcctgttgaggagaagatggatgttgacacttaggggacaacacgtcaaaccgctagcctagctttgcaagctatgggggttgaagagcacgaattttgaaccatggaatcctatggaggataaccgaatctgcctcaatcgatcggcagagttgtggctgttgaggtagcaaagaacaataaagtatttccat

SEQ ID NO: 62650 - DNA, 794 bp, Triticum aestivum
  unsure (1)..(794): unsure at all n locations
  Clone ID: PAT_TA_62650
ctcccaagtaccaagttagctctgatggacactacncaccatgaagagatccacagctaccatcctcctgctgatgctttcgctcgtgtccctcgcttctgccggcgacgtggacaacaccatccgcctcccgagcgacggcaaaggaattcctgatgaagcgagcatggcgctgaccggggcgagggagaagctgggcggcgaggagaggccgtgggaatgctgcgaccggaccatctgcaccaggtcgatgccgccgctctgcctctgcctggaccaggtcgagcgatgcgccgccgcgtgcaagcgctgcgagccggccgactctgaccggtccctctacgtgtgccgcgaccagtacttcggcgaccccgggcccagctgcaccgacggcgacgccgttgccgccgccggcggtaactagcacgcgcgcgttgatgcatgatgatcacccggccagccggtcaaactgcgttgtggtcgtcgtcgtcgttcgttcgctaggtcaaactgcttgctgcagcatggatgttagtgtaagaataatatatcggtggccctactatgccacgtctttggtgacgacctcgacactcaatacaagatcctaagaatacgcacgtactaccacgtgttgatctgatctgatctttgattgtacaacgttcgagatgatcagtcagacggagtgctaggtgctgctccatgctgctgtaatggcagttgtatggtagntcggcaacgacgatggatatgaataataacaggagctgtggtgatcagggagtgagtgc

SEQ ID NO: 62651 - DNA, 697 bp, Triticum aestivum
  unsure (1)..(697): unsure at all n locations
  Clone ID: PAT_TA_62651
aaatacccaaattatagactctgacaatttctcactttattcgtatttattacgtgcatagtatatacccaacttccaaaacaatgggcgacgcttcagtctttaaatatccctcccctctgacgggatatgaggatgctccaccattgcccaacgacatggcagaagatgggaagagctatgtcaacccagcagcaaagaaaagcgaagcctacgaaaagttcatagacccctttgatcaaactccacggggcgccttcgatgttcacatctattatttccaagggaacaaagaacagaccaaatacgccaaagaactctgggagcgcatcaggcgggaattccccgagctgcgaacctacaaagtatgggatggacccatcggacctcaccctgtcgccatgttcgaagtgaatatctttacacccgcacaattcggagcattcattccatggctaaatgtctggagaggaccgctgtcggcgcttgtccacccgaacattattccagaagagggcgttgatcgctgggcgtcgatgaagagggatcatttggagagggcgatctggatgggggagagaattcccttggatctcagtctttttaacaatcagtcataaaaagatgcgcccgaagaatgattgcataagaaagggaggcgatgtagaaaattacaaaaaatttgagcttctctang

SEQ ID NO: 62652 - DNA, 547 bp, Triticum aestivum
  Clone ID: PAT_TA_62652
caagataataacgaaacagtcaagtgaacgcgaatcgctttatctccctggcgatacccatcaattgctcaacagtaacgagcctctctcaactagggccggtaacgcgtatcacgatcgcctcacaaaccatgtcgacgcgacgagccgccttgtctctctaccgtcgctcgctaaagctggcgttggattgggctgtccaccgacatttatggcgtggccaggctctctatattcgctcactatttgaggccaatcgcagtgtcactgatccccgccatcaagggcgctgtcgatcgatacagacaacccgctagagagctggaaacacccagacccttacactcccccgacagctccaggaggttcgaagtacgagagaaaccttccatcacctgttcttgaccctcccccgcaccctgtcaaccgacactaaacaacgacacttcattatttgagttgcatgaggagatatatgtacatagaggttatggatctcctacatgaaggaactgtagcatgaattcaaaccaaaattactcacccg

SEQ ID NO: 62653 - DNA, 463 bp, Triticum aestivum
  unsure (1)..(463): unsure at all n locations
  Clone ID: PAT_TA_62653
acccgaacganncaagaagccncccaacaaanccggtatgaacgcgcgcccgccccnnncccncagggnaaggcgggcaagaaggccgcnaagaacccncnccncgagaagcgaccccgcaacaacggnancggccaggacanccagcccaagcgaaagggcncncgcagggncaaggggcccgagnangnccgncnncagcgccagaagaagaaccnncagaagcgccggaaggnncccccggnncncgcncagnaccagcacggccncgaccgcaacacggcggcccaggcnnncaagcgccggcaacaagnaccgaccngagaccaaggccgagaagaaggagcgaccccnccaggaggccaccgccgncaaggagggcaagaagaaggaggacggcggcaagaagcccaacaccggcaaggacggccacaaccacgaggnccgcccgaaggagaacaag

SEQ ID NO: 62654 - DNA, 842 bp, Triticum aestivum
  Clone ID: PAT_TA_62654
gattcctactactgttgtttgatcctactactgaatcattcacctacatacactcctaacgcatcagttcctgccctcgaactctctcgagtcaccagctactggatatagctcagaacaagctctcaacagaccgacataatggctgcgagttctgcacccgcggcttcgctgctgaagcgacagctcaaagagatgcaggcgggcagggaccttcctggaatctcatgcggccttgtcaacgacgacaacatctttgagtgggaagtgatgctcatgatcagcgacgactgcaaatactatggcggaggaaacttccgtgcccgtctatcattcccaccgagctacccgcatatgcctccctctcttaccttccaggacccaatcccctttcaccccaacatctacgaaaacgggaagctctgcatctccatcttgcacccgcccgaggacgatgagtacggctacgaggatgcatctgagcgctggagtcctgttcagacacccgagagtatcctaatcagtaccatcagccttttccacagccccaacgacgagagccctgccaacgtcgaggccgcgcgaatgttccgtgaggagagggagggcaagcataaggatttcagaagacgctgcaggaaatgcgtaagggagagcctgggagaggattagattagtggttatatatatgaaggatttatgggtgtaggatgcatgagcaattcggcgcaaggtggctggaaaggctgcgacgacatcagtgttttgagcggagtcatggagcttcatcgtgttttatcatcatcgagaccaatcgcttctctgtccgcatccccgatcat

SEQ ID NO: 62655 - DNA, 260 bp, Triticum aestivum
  Clone ID: PAT_TA_62655
cgcagagcgagatcgagatggcgacggagctgacggcggcgcagctgcgggcgcacgacggcaccgacgcttccaagccgatctacgccgccatccgcggcaaggacttcgacgtctcggccgggcgcggcttctacgggaccggcggcgactacgcgctcttcgccggccgcgaggacgcccgcgcgctcgccaagatgtccaaggacgccgacgacgtctacggagacctctccggcctctcccacaaggagctcggc

SEQ ID NO: 62656 - DNA, 756 bp, Triticum aestivum
  Clone ID: PAT_TA_62656
ccttctaagatcgtttctcagtgtgtgtgttcgcgagctagctttagtattagtgcagtttagctactagctagttggaacttactttgacactgctcttcttctgcgtgttgtgcactagtgtgtccgtgtgctagtagcctacagcaccgtttctctcgggaggcatttcatatacacgcgattaacacgtacagtacagacatccttcaacgacaatcatggtcggcgctcaagagcaagggctgaagctgctggtgccgcggagcggcgtgagcatatacgccatccgcgtccagatggcgcttgccatgaagggtctggcttacgactacctccccgaggaccccaggtgcaagagcgacctcctcctcgcgtccaatcccgtgcacaagacactgcccgtcctcatccacagcggcaggcccgtctgcgagtcgctcatcatcgtggagtaccttgacgatgcattccccggcaacggcgcgtccatcctccccgccgacccctaccgccgcgccgtcgcccgcttctgggccgcctatgtcgacaacaaggtttgttcccttccctctcgtctagctagtttgagctacaagaattgaagttgcatcccacgggtgccgtgttcttgccgcagatgttcccttcgtgcatcggcattctcaatacggcgaatcagcaggagagagctgacaaggtgcaggagaccttggcagctttcgggctcctagagccgccttggcggagtgctcc

SEQ ID NO: 62657 - DNA, 605 bp, Triticum aestivum
  Clone ID: PAT_TA_62657
attcccctccccctcccacgagccacagatggcgagagagagcgccccgcccgcgacctgctgcagaccgcgcgagatgctggcgctgcttcgggtgcgccgccgccgcctcctctccgcctgatcccgcccccgcgaggtgagctccgccgccgccgtcccgctctcccgctccgcagccaggcgaccgatctcggcgcgacgagtttctcggttggatttttctgaggtttttccgggggcgtgggctctcctgatttggattgggtgcctactgcttgtcgcgtagcccctcgggccctttgggtggctctccttcgtctcatctccccggtcagagggagaaaaagataactcggcgccgtttgccgcagaaaggttccctttctttctgattagtgcgtaaagctgcaaaggctcgcgggaattcctgcgagttttggaccggctgggcatgtattctctcgggatgatgaacctttttccttcatctattcctatttaactcgcagtaggcatgttccatcccatcttgtaatactcgtatctgcttgactgcttaccgatggattcaggaggtgaaaaatttgtccaacttcctgcgg

SEQ ID NO: 62658 - DNA, 555 bp, Triticum aestivum
  Clone ID: PAT_TA_62658
aatctccattctccaaactcactcatatcttatctctaatctcaaaagtgacacaccctgtctgaagctcacccacctgaagctaccaaacgccatgcactactactcatttatccccctagctatagcaaaaccttctggctcccgtctgcacagccacaactacgatagcctgaaccgccacgacattgcatcgcacgatgatgctgctgcagtcgctcttggtacagatgctaaacgtcatgcacggctcgcggaggactttgaagcaaggagatctgttgtcaaagatcgacatctttatagaagatggagatgctgcttcacctgaaatctggttttgctcctcccacgcactgctgctaatcaaagagatcaatacacatgtgttcttctaatacaacaagtcagatgtgaggctctctttttctttttgcctcctagctgcacaagcgtacagacaaataggatcattctcccaatggagatcatctgggccctcgacacaggtctaactgtatccatgctctttgagtacaacattagttcattctt

SEQ ID NO: 62659 - DNA, 776 bp, Triticum aestivum
  Clone ID: PAT_TA_62659
gctcgagggcggccgggccgggatttcgacagactccctcaaatctctgtattctactcagacgacacaatgcgctactcagtccctctattggcggctctcgctgcatcagctacggctacgccagctgaggcgatggggaagcgcgccgagaagctctttaccctcgagactgcccccggtgagacagttgaggttaccgaggatgagaagttccaaatgattgatgaccacatccactttttcgacatcacggaatggaaggaccacaaccctgctgacgccagtcttgctttcacaacgccaaaattccctgagacgctttctcatcaatccaatgttgcaaacattgtcattaagctcagcacaaagaacatggagaagcaactcaagaagctctcttcgttccacaaccgttactttaactctgcatatggtgtcgaagctgctgaatggctacactaggaaggtcaaaaggtcatcaagaagagcaagcatcctctggcctctgtccgtctgattcagcatcaggcgtggtcacagccctcaattgctgtctccattcccggaaaggtccgccttacaaccgttattaccggatcccaccttgactcggtcatttctaacgaccgcggtgctgggcgtgctcctggagccgatgacaacggctctgcatccatcatgcttctcaacctgttgagagcattccttgaggacccccgtattgccaagggagatcacctcagcactgtcgagttccactgatactctgctga

SEQ ID NO: 62660 - DNA, 566 bp, Triticum aestivum
  Clone ID: PAT_TA_62660
ccgtactggtttccgactgagcaccagccttattgtcaggcacgtcatcctcagctaccttggtagaagggctacgtcgtgggtacttgcgataacagatatagtggccattctcgtgtcgcccataatgtgtcaccaccgcacgaagctcgtaaatgggtcctgcaagcttgcttgaaccctgatcgccggctaccatcgattttcgagggtcagtaacccattcttcttccagcctcgacttttcgtccaatggattcgagccagtactacccaagcaccaaggtgcaagatctagcgtcatagggaaatcgactggcgctgagttcttcttcatattgaaggtggagggctcaaacaccgatcgttgcatgtgaatcgccaaactctttggtggtcgagagatgacaatctgcttagtctttgtcgaactgactttgttctgagccgagatcttacacttttcggtcaatgtcttgtcgtcaaagtcatcttcttccaaggcgagctcgaccgcctccaatcgctggtttagatgctctagaactttctcggtgggtgacccg

SEQ ID NO: 62661 - DNA, 383 bp, Triticum aestivum
  Clone ID: PAT_TA_62661
attctctttatcatggcgtctcatatgctgcgtccgttggcctcgtccgcggttcctgcttcagcttctgagctgtgcgcctcgagcttcttcttccagaagcaactgaatggctacaggctcaaagatggtcgtctgtcgagtcgcaaacaatggcacagcaccctcaaagcttcgtctcagcgcgcacttgtcgcagacgtctccaagcctctcgctctgatccgtcatgtttccacgcctacgcctcgcaactattctacagtggtacttccaaagacaactccctacgaaaatcttgttgtcggcgttcccaccgagatctttcctaacgaacgtcgtgttgcccttacacctgctaacgtagctatcctcaagaagaa

SEQ ID NO: 62662 - DNA, 515 bp, Triticum aestivum
  Clone ID: PAT_TA_62662
cgggaattacaacctcccccacttctgccttccttatgagtttctttcgatcattcttcactcgagcaacaagccccggcacaatgtctcaagcatctaccaaggttcagcagcttatcgacaacaactctgttgttgtcttctccaagtcttactgcccctactgcaagcagaccaagaagactctggatgatttgaacaccgagtacgagctccttgagctcgacgaagtttccgatggctctgctccccaggacgctctcgagaagatctctggccagcgtaccgtccccaacgtctacatcaaacagcagcacattggtggtaactcagacctccatagcctgaactctggcggaaagctcaagaaccttctcaaggaggccaatgccttgaaggcttctaagctttagaggtgtttacactgcacaaggcgtatagattaggcaatcgaggattagacggtactgcagcttgggcaacagagccccaattgagtagaattcatgacttcc

SEQ ID NO: 62663 - DNA, 765 bp, Triticum aestivum
  Clone ID: PAT_TA_62663
acttccgcgaaagcgaaagggaagactagcgattaacctagcaggccagaggttgcgctgttggtgcccatcatctgcccaacgtacgacgggaagcttgctgggcgagagggagatggccatgggaagaggccaggcgaggctgctctgcgccatgatggtggtgctgctctgtgtggcctcgcagttccaagcagggtggagcgccggtggcggtggcggcggtggtggcggtggtgcgagaggaggaggaggcagcagcggcggaggaaggacaggcgggggaggcagcagcggcggaggaagaacaggcgggggaggcagaggcagtgcccctttttggggtagcggcgggggaggaagttacgtacctggagccagaggtggttacgtgcctgggagcaccggcggcagagggagtacagcggggtccaacggacgcagcgccgccggcgagccgtatgggtattggccgcgtcgtctgcatttccggtgccgccgccacgctcgccgccatggagcttcttcggttgttctgagcgtgctttcgcaagcatgatatccctagacgagtcaaatacagaatttatagtaatttagcagtggtataattgtataaatggtggatgtagtccagggttggtgagtttgtgtatttgtggtctccattacaaggccaatatgggcagtttatgtcttgaattctactgtgcaagatgagaagtacttgataagcatacaccctctgttcctaaaaaaataaaa

SEQ ID NO: 62664 - DNA, 665 bp, Triticum aestivum
  unsure (1)..(665): unsure at all n locations
  Clone ID: PAT_TA_62664
ctcgcgcctctgcaccttctgcgtgttcgggtggaaatggagcggctggggttcgggaacatgcacgtgcacggcgccatgttcgcgctcctctgcttcgcgccgctgtgggtgctcaaccatgccgccacgaacatccggagcaaggccgtcagcaacgcggtcagcgccgccggggtggtgctctgcgctctcggcctgctctacggcgggttctggcgggcgcggatgcggcgcaagttcgggctcgccggcaaggacagactacccttcttctcctcactgtcgctcgacgtcgccgactatctgcagtggatgttctgctgggggtgcgcgctggcgcaggaggtgcggaccgggaaccttctcctcgacgtcgagtcgaccggaggctccggtggtgtgcaagtgcaagttgataacagcctacggcctttgccaagagaggatggtagctttgagatcgcagcagtcgctggcactccctctgttccactggcctataactcgccgcgtcgaggcgaggagttgccattggtgcagctgaagcgngacggcagttggtcacctggagaaatgaggccaccagttccgccattgatgcaggacggcggaggtcctccaggtgggcgaattcagtgacgggtagtactaccgtacggttg

SEQ ID NO: 62665 - DNA, 846 bp, Triticum aestivum
  unsure (1)..(846): unsure at all n locations
  Clone ID: PAT_TA_62665
atccctagcttcattttcggcgtcaacaacttcatccgtcaacattcgacacctttgaaatactgctgccccttgtgccgtgctataacctttttcaatcgccgtctctttttttttaggaggcgatagtttgtcaaccctgaactacaccaccggttgtgtgtaacagaccctgtttgcgactgacgtcaagccgcaccttttcccagagctgctatccaaagcagctatccaaaatcggaggaacaattattcagttcttggccggttcatgagacaaaattagcaccatgagccccaaggatgatgctccctcccatggagctgtagtcttatatcggcggcagtaacatgtacgatgatgttgctgaacggctggagcagaccctcatgtcatcgtactcttccggctccaagccaacccttccagacgagctcctttacgacgatgtaggcttgcccatctggaaccagatcatcttcacccccgagttctaccagactcatgacgagattgcgcttttcgataagcacggtgcagatgttgctgcacgttgccaagctggtgtcactattgttgacctaggagccggtgacacccgcaaggttggccaccttcttgctgctttcgacaaggccaacgtctccaccaagtaccttgcattggacatctcccgatcgtcattggaccacaacattaagtatctggtgggacagcattcgagcaagcagtcttcggtgacctgcgcaggtatttggngaacctttggcgatggcatgaactacngtaagaagatccagtcgcctcgactggtcctctcgctcgnatctgtactatgcaatgat

SEQ ID NO: 62666 - DNA, 311 bp, Triticum aestivum
  Clone ID: PAT_TA_62666
cttttccactatcttacttcctctttcttatatttttgcattactcttcactctgcgtctatttcagcctcacgatccctactttttcggtcatcgcctcccgcgtctgcctttaacttccaccggtttctccggttccaaggctctcgctttttcgactcccaaagtcaatggccggcgccattcgctgaagtgggaagcggccggtcacggccgcgtgggagcgagcgttcgttcccccgcagtacctttgtaaaggatgcgaagctccaacagcgtcaaaaagacgaaacgcctttctttcaagaacc

SEQ ID NO: 62667 - DNA, 840 bp, Triticum aestivum
  Clone ID: PAT_TA_62667
gcatgcgatgatggcaagacagggacacgggctcgggatggaggagtttgtgccggagaggacggcggcgtacataagccagcacgacctccacataggggagatcgtcgatcctcactgatcagcgaacatggacactccaagctccctccgacgcctcgccgtcgccctcctgtctttggctcctactgtcctggcccagaacaaggccgatgtcatctccaaatgcctcgatgacgccggtgtccgtaatgtcatcgacacggacagttcatgggctcaagaaacagtcatgttccagaagcgtctcaagcctgaccctgaagccatcgctttccctgaaaacagtgacgaagtcgcctctgccttgaagtgtgcgcgcgaatcaaaggttaaggccaatgctcttgggcctgcccactcgttccagggtaacggctttggaatccctggcaacctggtcataaacatggctgcctttgacgaggttagctatgataagaagtccacccttctgacctttggcggaggtacccatgtcggtcccgttcaaaagtacctctgggatactgccggtcgtcacgtccctcacgtccgtggcgcccacgttggtgtcactggctccagcatcggaggcggcttcggtaccacttcacgataccttggaacccccatggataatctcgttgagatccagtacatgctgtacaacggaaccattgtcaacgccaagaaaggctctgacctgttctggggcgcccagggagcaggcgcttcgtttggtatcatcctctccacaaagaccaagaccttccagcctcagttcgacaaggctatcaa

SEQ ID NO: 62668 - DNA, 496 bp, Triticum aestivum
  unsure (1)..(496): unsure at all n locations
  Clone ID: PAT_TA_62668
ngaatacaaaaaaggggaaaaaaaaaaaaaaaaatttacaaaaaaaaaaaaaaaaaaaaaaaaaaaaaaaaaaaaaaaaaaaaaaaaaaacaaaaaaaaaaacaaaaaaaaaaaaaaaaaacactttcaaaaaaaacctgaaaccaatgtttttttattgacctcctaaaattcgtccccccccctgcggatgatactggggcccgggttttatcaagataccaatgtttcttcccttcacttagcctaaccttacgcacccaggacaaaaccacattttccttcaaataggaaaaacccatcatctttctctggacatcctggaactcgcctttgcttgagaaggtttttttttttctgggacgggccacttggataaaaaaagggatgccacggggacatttcgctgccagagaaaggttgcgaccgctttgccttttggatacccaggttgcaatttgaaaaaaggaaaccagagataaaaaaaggccccaaa

SEQ ID NO: 62669 - DNA, 716 bp, Triticum aestivum
  unsure (1)..(716): unsure at all n locations
  Clone ID: PAT_TA_62669
ccgctcaggcggcgggcgggttccaatccgacttaccatacaacaatcaacaacactccacacacctttcaattcttatctcttatctcctcttatctttatctcttatctcttatctctcatcaccaatcatgaagattctcaccaagcaagaagaagaggctcactatgccgaggtcctcaagggcggtattatcggtggtactctcttcaccggtcttggtctcgcaggcgtttttgtcgcttccagacggtatccctcattccgaggcctgaccctccccttcagagccttcctcgtcacttcaactggtacattcggcgccattgtcaatgcggagcgatggagtatcgcccatcaaatcgccctggaccctaagcgcacatacagggaccaggcagcccgcacagcagatctgatccgtgaaaatgagacagcatatgagcgcttcaaggactacgccaaggaaaaccgttaccagattgttttcgcgtcttgggtggcgtctatgggcatcgctttcgccatcgtgagccgacagcctatgagcacagccaacaaggttgttcaagctcgtgtctatgcccagngcttgacgctggctgtgttaatagtgtccgctatctacgaaatgagagatctcaagaacggcgacagcaggttccaaactgtcagaatggtcgaccctaatgaccctaccnaggtcattgaacag

SEQ ID NO: 62670 - DNA, 810 bp, Triticum aestivum
  unsure (1)..(810): unsure at all n locations
  Clone ID: PAT_TA_62670
cggccgctcgaggcnncggccgggcccgggaaatccaaaaaaaaaaaaaagagacgactctccatctagaccatgatggacttgcacattaaaccagaccctcaacaagaggcccacgagtcagcgccttcaaccaagtcttttcaacacagtcccgaagccacgggcacagaacttgaaagagctcttcatggccgccatctccagtttatcgccataggcgccgccgtcggcactggtcttttcatcggaacaggaaacgccctggcgacggctggtcctgtatcgcttctcattgcctttatctttgttggaacgctcttgttctcagtcatgacagcgcttggcgaaatggcagcatatatccctgtcgcaggcgcctttactacatacgcgacgcgcttcctcgaccccacgtttggcttcgctatgggttggatttactggttcagctggtcaatcacttttgctctcgaactgacagcggccggtttgatcatccaatactgggagaaggaccttagtatcggaatttggatcactgtgttttggtttctcttcacagcagccaatttcatgcctgttcgttggtttggagaatttgagatgtggttctccagtatcaaagtcatcacgattatcgggtttatcattttctcaatatgcgtcaacgcaggtgttggagaccaaggatatatcgggtttaaatactggaaagaccctggtgcgttcaacgagcacatcgtcgagggtgacattggacgatttgttggcttctggtcggttttgatcacagcaggcttcagctac

SEQ ID NO: 62671 - DNA, 447 bp, Triticum aestivum
  Clone ID: PAT_TA_62671
ccgctcgggcggccggccgggtttccccaagctccgatctgccaatctttttccatcacaaacgtacacacacaccatccacaaccgtcaaaatgggcaacgaggagaagactcaccttaacgtcgtcgccatcgaccacgtcgactctggcgaagtctaccactaccggccacttgatctaccagtgcggtggtatcgacaagcgaaccatccagaagctcgagaaggaatccgccgagctcggcaagggctccttcaagcacgcctgggttcttgacaagctcaaagccgaccgagagagtggtatcgaaattgatatcgccctctggaagcccgagactcatcgttattcagtcctttttcacccccccccccggtaaccgtgatctcctcaagaacatgatcactgggacttcccacagacagatagcgccattttcatcatt

SEQ ID NO: 62672 - DNA, 587 bp, Triticum aestivum
  Clone ID: PAT_TA_62672
aaattccaaaaaaaagaaaaaaaaaaaaaaaaaatttttccaaaaaaaaaaaaatcgaggacaaccaaaaggatcttgagatggctgtggagatcttgcctgaaatgtttgagaagcccattacagaattatctgaccccaaactcaaagttgatattatggataaaacgtcatactgcaacaagcgtcgtgttatcctccttgaggatacggccgagaacctggcaaatggcgaatggaactttaacgcagatcttttggttgccactacctctgcacctgttcatcgtcgctgaagtatggatgcaatacaatacgattttcatcggaatttcgtattcttgccaagtaaagacagcattcattgtcgtgctagacacagggaagctatgagttgaactcccagtccttgccatgtcgccagcgtgcggccaagatgattggccaatcaacgatctacttgtcccttgggcaagcatacgctcaggaaatcctggtatgccgcatttagttaggacttggaggtttaatctctacctacaaggggtcatcctgctatatgacttcccatgattttgccccattgc

SEQ ID NO: 62673 - DNA, 793 bp, Triticum aestivum
  unsure (1)..(793): unsure at all n locations
  Clone ID: PAT_TA_62673
agaattgacattctaatcccgacccaatcccatttcgacaataccacaattgtcgcgtggactcttcagtaatctccatcacataacttgcggcgaatatcaccgttgacaccttcacaatgggtgggaatgcgagtaaagtcacagcccaggacaaggcgatcctagatatgaaaaaccaacgcgatagactccatcagtaccagcgaaagataacagtcttgacggacaaggagaccgatatcgcaaggcaaatgctggcaaagggcgacaagaagcgcgctctgctggcactgcggcgcaagaagtatcaagaatcgctattgaccaagacggatgcgcaactggcccaactcgaaaagttgacatcggacgtcgagtttgcgcttatacagaaggatgttgtgtttggattgcagcagggtaccaaggttctcaaggagatccataccgagatgggtggtatagagaatgtagagaagttaatgggtgaaacggcagatgctatcgcatatcaacaggaagttagcgatttgcttggagggcgtatgacgaaccaggatgagcaagaggtggaagacgaactggaagctctcgaagctgaactcgcgggcccagtgcctgcagaacgactacccgatgtccccatcaacgaactcccagagtcgcaaaaggtcgaggcgcaggccgagagggcgaaacagccagctatgcttgcagcatgaacgttggatacagaccagacatcttttccnaagcattttggatagagagcatttgcatttttcaggat

SEQ ID NO: 62674 - DNA, 742 bp, Triticum aestivum
  Clone ID: PAT_TA_62674
gccgcttcgagccggccgggccgggattcctcctccctgccaagcgagccccagaatgtctccgatcgaatcgaagcaaaggctttctcgtccgcctccaagatgcagatctttgtgaagaccctcaccggcaagaccatcacccttgaggtcgaatcctctgacacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaagaccctcaccgttattaccatcaccttggaggttgagtcatccgacaccattgacaacgtgaaggcaaagatccaggacaaggagggcatccctccggaccagcagcgcctcatcttcgctggcaagcagcttgaggatggtcgcaccctcgctgactacaacatccagaaggagtccaccctccacctggtgctccgcctgcgtggtggcatgcagatcttcgtcaagaccctcactggcaagaccatcacccttgaggtcgagtcctctgacacgatcgacaacgtcaaggcgaagatccaggacaaggagggcatccccccggaccagcagcgcctcatctttgccggcaagcagcttgaggacggccgcacccttgctgactacaacatcc

SEQ ID NO: 62675 - DNA, 659 bp, Triticum aestivum
  Clone ID: PAT_TA_62675
aatatcgtcatcaacagcactcgtttttaactaattcatgctcatcttgttttttgtcaactcccgctgttggtctgactttctgtgttaccccaaacattagacgtttatgatcacacgacgttcaacaatcaagacagcagtttaaacctttgtttcacttcctccttcaactacaactcgacgctgttgcaccatgccttctcccaagcaaagaaaggtcgctattgtcggcagccgctccgtcggcaagtcgtctctagcggtacgattcgtcgacgggcactttgtcgacagctactaccccacgatcgaaaacactttcagcaaaatgatcaagtacaagggacaggactactcaaccgagatcgtcgacacagcaggccaggacgagtacagcattctcaactccaagcactttatcggcatccatggctacatgctcgtctactcagtgtcgtcgctgccatccttcgaaatggtgcaggtcatccgcgagaagattcttaaccacctgcgcactgactccgttcctatctgcattgtcggcaacaagagcgacttgcgaccccgagcaacgacaggtcacccccgaagatggacagaagctctccgaaaagatacaatgcggctggaccgaggcgagcgcacgatacaac

SEQ ID NO: 62676 - DNA, 725 bp, Triticum aestivum
  Clone ID: PAT_TA_62676
acatgctcgatccgggcacaagacgaaaccactcgtacgtacagctcgatccggccgggccgggacggcgaaatgggtcgtaccaacaggtcggccctcgcgctggcgtgcctgctggccctgctgctagtgcagctacctcgaggagcccgtgcagtagatggggatctgtgcggcaaggtgaagtgcggcatggggagctgcggcgagtctggcgactacatgttcgggttcgcgtgccgctgcaacccggggtggagccggtaccatctcggcgacgtggacttccccttcctcccctgcgccataccaaactgcaccatcaactactcgtgccaggacggctcgtctcctccggctccgtcaccgccgccgccagcagcgccaccgctgacaaacctctcagtctacgacccttgcttgatgcagtactgcgggggcggcacctgcgagaaggtggagtcctcggcgttcgcgcacaggtgcgcctgccccgacggcttcaggaacctcctcgacgacgacgcctacccctgctaccgccagtgttctctgggatcaggctgctcagacctcgggatcggcataatcaacgggtccgacccgagcacgtcgccgccagcacccgtctccttcaccgtccagaagagcggcgctgcagggcggtcaacaccaccggcgcacggtgctgctggggctcctcatactgattaccttcctctggg

SEQ ID NO: 62677 - DNA, 666 bp, Triticum aestivum
  Clone ID: PAT_TA_62677
tgtgaccgatcgttttggcatgccaatccaagcagaagcagtcccaaggaaacttgccgacccctttgactttggtggtggacacattgaccctgatagagccgttgaccctggattggtttatgatgtggatgcaagggagtacaacaagtttttcaactgcacccttggatatgtagacggttgtgagtcctactacctcaatctcaaccttccatcaattgctgtgccgaacctcaaggaccatgtcatgcttcggcgcactgtgactaatgttgagccagtggaagcaacatatcatttaatggttgaagctccggcgggaatagatgtgtccgtggagccatctgtgatcaatttcacccaaagcggtagtaaaatggtgacgtttatggtgacattcacaacaaggcagagagtacaaggaggatacactttcgggagcttgacatggtcaaacggaagtacccactcagtgagaattcctattgcggtacggactgtgatacaagactttgttgcagatacagcttaaacttacatctagttattgtacacctttgtgtattcacgtaggtcgcataaacaatgtaggagaaacactcagtatcgaatttgtatgtaataaatatttttttatacagaaacaatatgattcttctttgc

SEQ ID NO: 62678 - DNA, 779 bp, Triticum aestivum
  Clone ID: PAT_TA_62678
acacctacacttgccatacctatcatatctacacagtaaatatggctctccctcctaaattcgccgggcagaagctccaattcgctcaccctcccgcctcagactcaggcgtcgcccacacaactcacaccctcgagttctacctcgactactgctgtcccttctcagccaagatcttccgcaccctccgctccgacgtgatccccgccatcaaatccaacgaacactgggcctcgagcctcacctttatcttccgccagcaggtccagccatggcacccttcgtcaaccctgatgcacgaggccggcctggcagtcttgcgtctcgcacctgagcgcttctgggactttagcgcagcgctgtttgacgagcaaaaggcattttttgacgtatccgtcgtcaacgagacccgcaatgatacttatcgtcgtctggcaaagattgcggcaaaatcgggcattgatgagaataaagtgtacgagctgcttgtgattcctgacaaggcgggggatgatggagcgttgaatgcggggaatcaggtcaccaacgacctcaaggttatcaccaagatgaaccgtctggttggtgtgcatgttacgcctactgctgtgtttgacggtgtggttcaggatgttagctctggttggaacaaggaccagtgggttgagtggttgcaaaagaacgttgtttgactgccattggagggcaacaaacgtacgagccataagctctgatagtaaagagctgtacatacaacacaatttgaagttgtcaccatc

SEQ ID NO: 62679 - DNA, 693 bp, Triticum aestivum
  Clone ID: PAT_TA_62679
tcgaggggccggccgggccgggaatttttcctgttatttcatccttcgcattccacatatcatattactactgcttcactccattgttcttactgcattatctgagtttcctctctagctcggccaggtcgctgatgatttcgagagtggctgccatcctgtctgttggcctactatgcacctgactgtgtagcacagaggaagagttgctcttggacaacaccaccgggctcagcggaaccaattctatcaaggctgctggtggtcccaatggtttctgcggtcacaagtgtcattcctgaccgatgctcattcccagtggtgaatgtctatgtcacagcttggatgaagtctgatagagacccttgttgattctcacgacacctatcatcaccatgaccgaagcatgcctagaggaaggtcatagcacctccgtattggaggccagaggaagatcctcatgcacgaccacgacgtcgacgatgccactcttcccgatctctaccctgaatgcttcgccgcctacaagaacatcgctaccgaccacggttagtgcctcgaggataacgtctctgctgacggtaccatctccaactgtgtcaatgactgccctgtcaaggatatcgtctatgacaccaactaccctgctgcttatggcaacggttgaaagaactgcaagactgagcccaacat

SEQ ID NO: 62680 - DNA, 815 bp, Triticum aestivum
  Clone ID: PAT_TA_62680
gacttcttgtcctttgtctttctatgcctacctgtttatataaatgccgagcgaagccctccacctgctcgtcctcttggaaaactgcaaaccaaggaaaatacctgagctatcttgaacttatatgctacggtaccattgccacgtttactacccagccgttgctcaagtgatcactgatcccagatcccagaaggtttcttgctatcggctcgtttaagtcttttgcctgcctaccgtttatttattatcattgttgctcttctttgtcctgactataaaataattgcttgcggtttcacaaccatccatcatatctttctcttcttagtcctgtcatacaacgaaagcacgacatgactgctcgagtcgcacctggctcctcatcctacacagagccatctactaccatgtctccaactgccgaccacgatgtcctccgaggccgcaagagagagcgaagcatgacccgcggcagcgtccgcacattcagagccgcaccagcagacgagtcgagcaacctccgaggccgctctcgtcggcgcgccgcttctccagctctcagttacacatctcgaccatcctctcccaggagagtaccttctccaactcgacgccgtctgcttcatgcccgtcttcgaagagagcactgtccttctcgtgttgcgtcccccattgagcagcagctccagcagcagcaccgacccgttcgtcgaaggcagcgaacccgaagtcagagccggggtcctcggttggagatggagcttggctcccgcagcacccgatggctttctggactgcggaacgagtccgag

SEQ ID NO: 62681 - DNA, 378 bp, Triticum aestivum
  Clone ID: PAT_TA_62681
ctaaccctaaccctatttccaagcttagcttccatcttcttgatccagctagagcatggtgacgactcaggttgaggggccggtcatcgggatcgacctcgaggaccacctactcgtgtgtcggcgtgtgtgcagcacgaccgggtctagatcatcgccaacgaccaggagcaacctacccacgccctcgcactccctcttcaccgattcttcagcgcctcatcggcgatgccgccaagaaccacgtcgccatgagccgcatcaagagcgtcttcaatgcgaatagtattatctcgataacggtggctgatggtcctgtccagagtgatattacgatgtggccgtacaaggttattcctgccccggcagacaagccta

SEQ ID NO: 62682 - DNA, 449 bp, Triticum aestivum
  Clone ID: PAT_TA_62682
actgctttgttcctaatatggttaccatatccagccaatttcctttgaaggagatctctcgctaaacacatggctggaatttaattctttttatgtgttttgcaagcaagtcttttttgagtcggattgttttaggcaagcgcgaagccaaacgcaaaacatgcaagctgcatcgaattcaccaggggcgcacagggagtggtcaaggttgatacgatacaggacgctgaaagttcggcagaagaggatatttctaattaagataaaccacaacaatagcgagcatggggagtttttggacttttttgaagttgctggcgttatgggttccatgtatgagcacagtgatgccatacatgtgtaacaactggtaattatgcggtggagcggctgttagagaaccaacacgtcccgagatcccttaaagagaaggaaagtaagggtgtatg

SEQ ID NO: 62683 - DNA, 361 bp, Triticum aestivum
  Clone ID: PAT_TA_62683
acctgcgtcctcctccagtactacggtctcactgaggctaactactacaccgtcctcttcggtgtctcccgtgccattggtgtccttccccagctcatcattgaccgcgctctcggtgcccccatcgagcgacccaagtccttctccactgacaagtgggctgagcttgttaagaagctgtaaaggatttaaaagcaaaaggagaaaagcaggtgatgggagggttctgtttaagaaatggacagaatggattgccgagtcaacggcatttgtacaacacaatgggactgttttagtttagtaatgagcaagtcgtcgctggagcgccgattgaaatgaaatgatttgacagttaatctgt

SEQ ID NO: 62684 - DNA, 754 bp, Triticum aestivum
  Clone ID: PAT_TA_62684
aaatccaaccgccgctacaaccaacgtcatcttctgcgaaacacaccctttctctgtctgtcttacacatcgtccgacttttttgtctacaaaattacaaacatctcgaaccacccgaaccaaacaattgtttttgcgacagagtaaccgacaccatgtccgccaaggttcctcgcaactttcgtctactggaggagcttgagaagggagagaagggtctcggcgccgaggcatgcagttacggtcttgaggaccctgaggatcttctcatgagtagttggaatggcacaatccttggtcctcctcattccgtccacgagaaccgcatctactgtttttagatgcactgcggtcccgactaccccgacttgcctcccacgatccagttcatcagccaagtcaaccttccctgcgtcaaccccaacaacggcgtggtggaccctagccaactcccctgcctcgcccagtggaagcgcgagaacactatggagactgtcctcatcgagttgcgaagatacatggcttcatcccagaacaagaagatccctcaacctcctgagggctctacctacccttaaatcatcactacgaacttcatatcacgcctttatatcaagattaagaaaacagaactgcaagatcaacaaaatcctttgaaatgggttgagaattggctgaacggcttcgttccgctgttgttcgagaagatgcgactatcgcgaactacaatatgatacacaaagctacccgtccc

SEQ ID NO: 62685 - DNA, 558 bp, Triticum aestivum
  Clone ID: PAT_TA_62685
tacttacacgcaactacttcgccatgttcagaattccgttctcgctcttctcgtcgctgccggggccactcaaagccaggctgctttcacactgaagaagacatatgattccagcaattttctggactcattcaacttccgagaccgtgcctactttgatagtatcgaccctggctatgagggcgatccgactggtggctccgtcaactacttgagcagaagtcaagcagtgagctccggtatcgtcaataccaataacggtaagattctccttggagtgaactctgtcgacaaagcgccgcttctcacacctgggggatccaagcatggacgtggaagcgttcgtcttgagcccaaggagtcttacagctcgggcattctgatcgctgatattgagcatatgcctggagtcgcatgtggtgtctggactgcctactggtcttacaattttgacgaggatcctgtaggcgagaatgatatcatcgagggcatcaacgccaaccagaacggcaactatgtctcctctgcacacttgtggaagatgactccccaaccgtc

SEQ ID NO: 62686 - DNA, 517 bp, Triticum aestivum
  Clone ID: PAT_TA_62686
gtgtcctatagaaggccggccggattgacatgaccgtctatggtgtctggatcgccgctctttgtctcagctccttcgtcctccgcatgtacgcctttggcgatggtgagctcggtgaggactgcaacgaccgatacagcgacagctgtgagaccgtcttcaaggcccgtgctaccacttttgcctgtcttacctggttctctctcttccttgcctgggagatgattgacaagcgacgatcgttcttccgcatgcagcccaagtccaagctctactttacccagtggatgcacgacatctggcgcaaccagttcctcttctgggccattatcctcggtgttgtcactctcttccctatccagtacattcccgtcatcagtgacaccgtctttaagcacaagggtatcacttgggagtgggccattgtctttatcgctgccgctttgttctttggtggtatcgaggcatggaagtttgccaagcgtgcctacttccgtcaccaggccgccaaatccca

SEQ ID NO: 62687 - DNA, 708 bp, Triticum aestivum
  Clone ID: PAT_TA_62687
tctgaactacctagctggcttctttagcatattatattgagtcccattgcttcaaaaaaaaaaaaaaaaaaaaaaaaaaaaaaaaaaaaaaaaaaaaaatcaaatcaacacctcttctactcagacattcacatcagactcctggcccaaggaaaactctcccaagttcatcatctacattctacaacatgcagttctcaactatcgttcctctctttgttgccgccatgggcgtcgtagctacccccgtcaactctccagctcaagagcttgatgccagaggcaacctattccctcgtctggaatactggggaaaatgcaccaaggccgagaaccgatgcaagtacaagaacgacaagggtaaagacgttcttcagaattgccccaagtttgacaacaaaaatgtaccaaggatggtaacagctgcaagtgggacagtgcttcaaaagcgctcacctgctactaaactcctcatgacaatccaagactcctgaatgtctttatgccccactgtggttgcagcaagcgaggggtctctcatatctctcaaggccaacttgattgcgcagagtttgggctagggcaatatcaggtttctggagatcgaatggaaaaaaagttcgggttggaaatgaagttgaattaaaacctcatttgtatccaactaaaaattttaaccgatcccaatggggattgaaacgcttctgg

SEQ ID NO: 62688 - DNA, 473 bp, Triticum aestivum
  Clone ID: PAT_TA_62688
aatacaaaaaaaaaagaaaaaaaaaaaaaaattaacatcaaatatacaatgcaaatagaaagtagatatacatcaatactgaaatcaaatactacgatcctcggcctctgggggacctttggtctattctcagggccacttgcttctgacaacgccttctcgcggcaccgagtattaccctgcagcatgtctcccgaccggagctgacagatcccactgttcacccccacctgcatcgcccgtcgtatggcctatgagatcgtcccaggctgcatgctccaacttcgactggctatggtgcatgggactggcgtgatttttgtcggacgcatatgcccgacttgcaacttattgttcagttccgggggtgctctggtgtaggtggcgtatcgcgtggactggaatgggtgagctgatgcccgctcctttggtcgcgtgccatatgtaacatgctgtaggcgtgaaaagcaagc

SEQ ID NO: 62689 - DNA, 675 bp, Triticum aestivum
  Clone ID: PAT_TA_62689
atttccattacatctttatctcattctacgaaccactctcgcatcatggcccagcaagcccccactatgcagatcgacaacctgcttgcgcaggtcaaggtgcttggtagttctctcaatgttgcagaccgtgcgaaagtccaaaagtctctacttgatgctctatcccatgtggaaactccatatgagcatatgctcaggctatctggatcccacttacagctcgcttgtatccgttttggtgcggatataggactgttcaaagccttggtggagagccaggaaccattgacatgcagctatctcggtgagaagcttaatgctaacgctaacattctcggccgcattttacgacttctggcctcggctaggttggtgaagcagactgggttggatacattcactgcagagaagataacccaagagttggcagcccaggccatggagtctggcgcgcatcttctgtttgatatccacaatcgaacgtaccaggctttaccggattacctctgcgaaaataaatccaaggacgtcgacaatatgcacaacggtattttccaaaaggcgtttagtacagatctttcgtgctatgagtatctcgtcccacaccccaaattgcagggctttatgcaggacgccatgaaactcaaccagacagaaggggactggctgtct

SEQ ID NO: 62690 - DNA, 743 bp, Triticum aestivum
  unsure (1)..(743): unsure at all n locations
  Clone ID: PAT_TA_62690
gatgctgaattctctccctctctcctcactccgctgtctacctcctccagcttatccagcaaatctccacctttgccatcaactaccagggccgtcccttccgtgagtctctctctgagaacaagggtatgttctacggtatcgtcggtgtttctggtctcgctttcgcctgtgctctcgagctcttccccgacatcaacgagggcatgaagctcgtccccttctctgaggagttcaagacgaacatgaccgccgtcatggtcgtagactacgcagcttgctggatcattgaggtcagtctcaagaagttcttcagcgactaccgaccccgtgacatcgccgagcgacgacctgagcagctcgagcgtgaggccgtccgtcgcgccgttgtgcagaagaagaaggaagaggaagaggagaagaagagacttgagaaggtcgccgaatttgagcgtaaggtcgaggagcgacgaagaaagattgaggagtggagagctggcaggacctaaagataaggtctgacagcaatatcctaaatttgtgtacgagaagttgggcatcttttggggttagagcagatgaaaggctttagattaagcatttattagacttgaaagggaggagttattggagatgaaaggtgagcagacagaagtcagagtctgctggagatttagtagatgtacattatgccgngggagttagacttgatcatatacataatagccaatcgttctcatccc

SEQ ID NO: 62691 - DNA, 586 bp, Triticum aestivum
  Clone ID: PAT_TA_62691
agcaggccacaagcaagctcgacaacaaagagtgccaacagaaaccacaacaatcccacagaaggtggcgatgtccgtgagcaagcaatggacgcgggtgcgcacgctcggccgcggcgcctcgggggccgaggtgttcctggcggcggacgacgcctcgggggagctcttcgcggtcaagtcggctagcgcggcttgtgcggcggcgctgaggagggagcagcgggtgatggccggcctgagctccccgcgcgttgtctcctgcatcggcggccgcggcgcccccgacggctcctaccagctcttcctcgagttcgcccccggcggctcgctggccgaccagatggcgacaggcctcgacgagctcgccgtccgcggctacgcggccgacgtggcggccgggctcgcgtaccttcacagcgccggcatggtgcacggggacgtcaaggcgcgcaacgtcgtgatcggcgccgacggccgcgccaagctcgccgatttcggctgttcgaggaaggctggcgctgacgtgccgatcatcggtggcacgccggcgttcatggcgccggaggtggcgcgcggcgaggag

SEQ ID NO: 62692 - DNA, 603 bp, Triticum aestivum
  Clone ID: PAT_TA_62692
attccaaaaaaagaaaagaaaaaaaaaattatctcggatcccagtagcacggccccttcttctccgtcttgacatctacgtcgccccggctggctaaccaccggcgtcggcaacttcctggcccgccgctaaatgaccacacagcaaaaccaccaccgagcagcagcggaagaattcccgctgcactcgcctgcctcctccaccggctccgcggactccgcgccccggccatgccgccggtgctcccgttcgacaccaacggcgccgacgagatgctcctgctcgatatgatctcccagtaccaccacgtccagcatgccgcgtttttttctacgattgcgccggtgaagcgggaggccagccaagaggaagacaaggcggccgtggacgtcgggcgcgcgttccgcggggtgcgcaagcggccgtggggcaagaacgcagccgagatccgtgactcgacgcggaacggcgtgcgggtgcggctggagaccttcaacagcccggaagatgcggagatggagtacgacgaagctgacttcgccatccgcgggggcgacgacgtgctgaacttctccggcgagcatgtccggcgatcgcttgagg

SEQ ID NO: 62693 - DNA, 814 bp, Triticum aestivum
  unsure (1)..(814): unsure at all n locations
  Clone ID: PAT_TA_62693
aaactacgctactaacaacactgactaaccaacttggccattgatcgtccgttttgcaatgtggaacgcagcatttctcgcctctcttttcctcatcccattggccaccggcgctccagccataaggatcgaagagcgtcaagcaccatgccagaatgtgcacatcttcttggctcgtggtactgacgagccttatccaggtcgccaaagctccgttgtctcagccatttgcagtggcctacctagttgtgactacgagaacatcaattacccagctggtttcaatacatattgcagttcgatatacgctgggatcaccggcggtctgttgcagatcacgacatatgcgaatcgatgccctaattccaagatagtcctgagcggctattcgcagggtgctcagctctttggtgacatccttggtggtggcggcgggcagagcttgggatgtacccagccgtccaaccctgcgttaaatcctgcgaattcgcctggcaataagattgctgctgcgttattcttcggcgatcctcgctacgttgccaatcaggcctacaacactggtaccggtgcttcaaggagcggaataaaccctcgaaacggtgcccaactgacatcgctgaacctcttttccagcgtactccgatcctggtgtttggcaggcgatactgtgtgcgcgcagggtactgatccaacagcccacacctcctactttaatgttntctctcaggaggcaggtgtttgngtcaagactanagtctaggggntctctgngcttntcacgtttatgactgctccgctactcccatgctac

SEQ ID NO: 62694 - DNA, 425 bp, Triticum aestivum
  Clone ID: PAT_TA_62694
cgtcacgtgctgcggaactagatgtctcacgtgcgtcagccggagtatggcagaatcatgataaatacaagtatggcaatggggccgccccctcttcctcgtcctcttcctatgcaggtacttcctatacatatagattgggtgcggaatgtacattctgggggcttttggtgatacctttttacgagtagggtactggatgaatggcattggtgttgcgggtatatggataaagattcttgtttcattaacggaacaggcccaaggatatagggtcggagggcgtatttaaatgttctttctgcttcactgtacagtactagttacgttatgttattgaagccattcaatcaaagattgatattccagactcaaaaaaaaaaaaaaaaaaaaccagaagaaaataaacatctaagaacgaatat

SEQ ID NO: 62695 - DNA, 293 bp, Triticum aestivum
  unsure (1)..(293): unsure at all n locations
  Clone ID: PAT_TA_62695
ccacagnctggatcgtatgtaacctaccacgcgcagngcgcagagcgagatcgagatggcgacggagctgacggcggcgcagctgggggcgtacgacggcaccgacgcgtcccagccgatctacgtcgccttccgcggcaaggtcttcgacggctcggacgggcgcggcttctacgggaccggcgcctactacgcgctcttctccggccgcgaggccgcccgcgcgctcgccaagatgcccacggacaccctcgacgtctccgtctacctctccgtcctctcccacaaagagc

SEQ ID NO: 62696 - DNA, 761 bp, Triticum aestivum
  Clone ID: PAT_TA_62696
aaaagaggtggcgatggttactctgatcctcgaactgagcctccttcgtcctctggcggtcgagcgaatcgagaaagcgttatgagcggcacctccgactactggagaggttctatggcatgggaccccaaccagcaagaatcacatcaccttgctctcggaacaccgatgcgacctataagtggtgtgccggtcatccgatcaggcccggcacgcacaccggtcacggagtcaaatccctttactgatcccccgaagccaaaacccgaaggggatggcctcggaggatcaactggggcaggatctgtcacttctcgtgatggatcgtttggctcgccgtcaagatttcaggagcggatatgatcgattctgcttgctatttcgtattgctttgccatatgttgatacctgagcgttttgtccattttttattgcataacgaccatctcgctgtgctctttagtaccgccatcggtgctgtactcaccagctatatatgactgctgttggtcattgcatttctcttcatttcaatcttggccacatacatgagtggtgcgagaagcattttgttcggcgttcatatgtggtcatcatgacaccactggggatctcttttcggaagtacaaaaacctgaagatatgggagtttagatccggaggtgaaaaggataaagatgggtaggggtcaccacaaaaggaggaagctgggctaatcgaacgaaacacaattttttttatctgcgacgcttgacgatcgg

SEQ ID NO: 62697 - DNA, 405 bp, Triticum aestivum
  unsure (1)..(405): unsure at all n locations
  Clone ID: PAT_TA_62697
ggccgctcgaggccggcnncgggccgggaaaaatacaaaaaaaaaaaaaaaaaaaaaaaagcagtggccgttcagatgtccaggtgctcccaaagaacacctcctccgcatcgtcgccgtcttcctcgtcggctgctaaagattccggccacagtgagaagaacaagaagcagcagggtgtaaagaatgaggagaggaaggagaagaaaaggagcaaccttgaccgggctgcgctcacgacgccccacttcccctttcattctcgccccggtcttctgtaatagattaactgagaaaatgctgcacacatgggatcctgtagattttcctattagcctatgatttattcattgattggttggttgtatttgatgatctgaattacaattgtttctttttaacata

SEQ ID NO: 62698 - DNA, 838 bp, Triticum aestivum
  Clone ID: PAT_TA_62698
ccccttcaaacgacgcttgaccgtacccgtaccgctttgcactgcactgcaccatatcgacaaaagagagcaggactgcaattccttgtccttcaactacaacgccagcgttccagcacaaatcaccttcgccatgaaccctcaccagaagaacaaggtcgacgtcaagtcactcactcccgaggaacagcgtctcttccgtctctacggcaagctgccctctcgatccgaccacttcgcaaagcatctcaaggaccgcaagtatttcgactcgggtgactatgccatgtccaaggccggcaagggtgatggtgttgacgctggtgccgtcggctctcagcatcctctccccgagaacattccccacctgtcatccccggtgaacggctccggaaccaacgtccccaagcaccacggctccgtccccggcatccaggccggtagccctatcaaggagagcagcttcctcaagagcgagaccagcgtcgacgagactcagggagacaatgttgacaagccccagggtgcagacgcagctgctgcacctgagcctgttgccgccggcggcgagggcatccccatccgaagatagagaacattcgtaataacaagcgaagaaatacgcggcttcaataggaacaacggaatagtctttttttcatcattgtttttttttatcatgcacaacacgaaatggtggtttgtacgaagtctcgtacgtgggcttatagtggattgcgatatcagttttgacgacttacgagtatcgcacagttggcgtttggggattggcagaccatctgaatcgcacgcacaaagggaacatatctcagtctga

SEQ ID NO: 62699 - DNA, 750 bp, Triticum aestivum
  unsure (1)..(750): unsure at all n locations
  Clone ID: PAT_TA_62699
gcatccaagacgttttgaaacgtcgtgaaaatatgcgatgtttcgagggctgaaattgggattttaggaatccgcccatctccatctccccggagtcaccccaattgagcctctaccagccattcaaaatgctcatccaactctccagggctacgcgcgctcgctccgccgttgcggctgtttctcgtgtcgccagacccaatgccgtccaggtgaggggcttcattgctcctaccgtctccaggaaagccgattttgttcaggagctttaccttaaggagctcaaggcctacaaggtccccgtcgtcaaggagtccgatgccgagggcaacgtctatgactttcagcgtccccaagacccccgcttcccccgaggagaccgacctcgctggcaacctgaaggagtacgagagcatggccgttgagatcgagggtcaggacacctccgctcagtctgccggcgcccccaaggttgccgactggctcgaggctgaggaggatgaggagcctcaccactaagcggtttattttctctctccattaccatatgagggtggctcataaaactatctgtaccgcagcaatttttcggnggtgtctcatttctcaccgcccagctgccgttacttggggatagcaaaaagagggagggctgacactaaaactcagcccggggatgaagagccggaagcgaccaagaaaggagctgaagcaagtggattgtggacgagaatcctgtgtacatttttc

SEQ ID NO: 62700 - DNA, 818 bp, Triticum aestivum
  unsure (1)..(818): unsure at all n locations
  Clone ID: PAT_TA_62700
aagttcacgacgataataaacatttcccttatcatgtgtgaaccaagttcaaatgatcaagaatcagcggattccagagaaaccgatcagggcattgcatacaaagatctttcaccagaacaacaagaaatgagcgatattttatacaaaatggagagccatgacctaaatcttttgggtattgcagacctcggccgtgacggcatcttccgatatctcgatgctgatcgcaacattcactacgcaattgcattgaggcctgcattgataaaggcattgctggaccgcttgccatatgatatggcggaagaaaagttttggcgcggagttgatgggacaaaggtgccgaaagaacagtggtacgatccgccaccgggtatccttcccccaccgctatctgaagaacatcggaaagaaggccgagagatcaataaaaggctgaaaggaaaaatggataagattgtcgaagacatagagaactacaaggagcgacttgtctttattgagtccgataataagcttgaatagagatactgaagctcgttggagacaaaataagtcaatcatccgaaaacccgtcgcaatctctaggcttccctcggcggacaactcaagagcaacggcatgacctgcgtcataggtagcccaagcttcagcagcaagctcatcagcgnngagaaacaggggtactagaggttaaactttttacttcagcagttagtcttggcacttgcttattgccgctcaggggaaaggctatttttatggtctgctgggtagttagacgctccctaacctcagatcaccctatttttatg

SEQ ID NO: 62701 - DNA, 277 bp, Triticum aestivum
  Clone ID: PAT_TA_62701
gcgtctttgtctccctcgcctcctccctccccctccctcctcgtcgccggccactcaggtatttcgtagttccagcagtcatggccaaggacaagatccacatcagcattgcggtcattgaccatgtcgactctggcaagtcaaccacgattgcccacctcatctacaagcttgcaggtattgacaagcgtgtgatcgagagagtcgagaatgaagtcgctgagatgaacaagaggtctttccagaacgcctgggagctagacaagctccaggatga

SEQ ID NO: 62702 - DNA, 712 bp, Triticum aestivum
  Clone ID: PAT_TA_62702
atttcccttggatggccccctcagggcgctctccctaaataataatatagctgccaggacagcaaagctaccgagaacaacttctccgccgctgaggagtagctccttcagaacaccttcctccctatcgagtgcataaccctcgctgatctcttctctgctgccattgcctcccgtggcttgcaggacttctttgacaagcactgcagagcggagcaccctgccggcacccgatggctcgacactgtccgcaaccagcccatcttctctgaggctgctgagaaggtcgagctcctcgagaccgttactctgaccaacccccccaataattttgactatcctaacaaggaggataagaaggaggccaagaaggaagccaagaaggaggccgctcccgctcccgctgccgctgccgctcctgctgaggcccccgctgctgacgaggcccctgctgcccccaaggccaagcaccctctcgaggctctcggccgcccctctttccctctcgatgagtggaagcgcaagtactccaacatcaaggaccacaacgaggccatgaagtacttctgggataacttcaacttcgaggagtggtcgatctggaaggttgactacaagtacaacgaggagctcaccctcaccttcatgtccaacaacctgatcggtggtttcaacaaccgtctcgagggttcccgcaagtacatcttcggat

SEQ ID NO: 62703 - DNA, 287 bp, Triticum aestivum
  Clone ID: PAT_TA_62703
agtacaaccttcagctctatagcaaagcagatgatctaggaagcacaggcagggtcaggatcaactactaaagcatccggcgagaatggttgccacaaagacgggcgagctgagggcgctcttcttgtcactggaccggcacgcggacggcaggatctcggcggcggagctgcgggggtgcatgcgggcgacgctgggcgaggatgtgctggcggaggaggccgaggcgctggtggcgtccgcggacgcggacggccgacgggctgctatgtcaggccgagttcctc

SEQ ID NO: 62704 - DNA, 329 bp, Triticum aestivum
  Clone ID: PAT_TA_62704
aatgcataacagtacgctccagctcctccttccccggcagatccaaagatagcgccaccgggcctccatatttcagacagagcccctctccctcctcctcctccctccccgtggagctccaagaatcatccgacgacagcagcggccaggccattgattgatcgttggatggcggcgatgatggtggcggcgaggcaggggcgcgagctgcagcggtacagcgccagcacgggcggccgcatcgtcgtgggctgcatcccgcacagggtgcgagacgacaacggcgaggcggaggtgctgatcatctgctccggccagaagggggccag

SEQ ID NO: 62705 - DNA, 652 bp, Triticum aestivum
  Clone ID: PAT_TA_62705
aatccagacgagaacattcacctccgcccgtaccatcttctcgtcttcatccctcccaggacgtgccacacacttaccttcaagatgaccaagcgaacaaataaggtcggagttaccggtaaatacggtacccgttaccgtgcttccctgaaaaacagggtaacaagatggaaatcacccagcacgccaagcacacttgcaccttctgcggaaaggtcaccgccaagcgacaggctaccggtatctgggactgcaagtcttgcaagagcaccgtcgccggtggtgcttacaccgttgccacccccgctgccggcgctatgcgatcaagtctgtttctatccgacacattgctgaggtttaagggtggactttagcgaaacgggaaaatggctttgcttttcggtatggtgtacggggggatatgatttcgcgcctacattacgaggtgacgatctggacgtcgacacccgaacttcggtcacatagaagccgatcgaatagcaataaacgataaagaattgcatggtttcggatccattcaacgactcaccagctgccacaaaatgcaaaataccatcagctattgagatcgtgggcagcctacgcatgtttatcatccaagtttggactctaccaaataatattctgcctc

SEQ ID NO: 62706 - DNA, 789 bp, Triticum aestivum
  Clone ID: PAT_TA_62706
gctcactgactcagtatagcagacccattcgtgtctcgaggattcattcccgtcaagaagtgcatccgagttccgggtcaatggctggccgccggcgacgacagcgcagcaaaaacaagctcaaggcagcgtcgaggagcgacatcccgtcagggccgacgactgtccaccaaatccccgaccacctcctcgagctcgtgctcctccgtcgccctcgtccgagccgccttcacctgcaagcgctggcgccgccacgtcgcggacaccgcattcctggcccggttccgttccctccacgcagcccacgtcgccggtcactaccacgtcgtcgaccggtcctaccgcgagaagctgccgcccgacgggaacaaccaggtgttcgtgccagacccctcggctgccgacgccatcgacagacgccacttctccctcgatttcctcccggaatgcgatggctcctcgtcctgggagctcgccgacagccgcggcaggagaggtgtgattctggaccatggtccacccgcacccacgctcggtgccgtccgattaatactactttcatggaatacgagccagcttatcactcaaactttaaagattaagctaattctagaacagtacggggaccatagatatgccatttcttttctgaatctacgtgggcccaagcagtaccccaatgctgatttccctcctggttgtcccatgcaaataaaccaattagtatatttttggatatttatttgtagaatagctacggtgcacgtatggtacatcgatgtttgtacc

SEQ ID NO: 62707 - DNA, 836 bp, Triticum aestivum
  unsure (1)..(836): unsure at all n locations
  Clone ID: PAT_TA_62707
gatacctcttttgacctggattttgtcggtactgtaagcgagcagcacatgccaccatggacgccatccaagaacagttcaccctactctccctgggccttttcaccattggggtgagaatggtggtgcggacgcgatcagttgggttctcgggatggcagttggacgattacctgatgccaatcactggtatcatcttcactgccgagacagtagccgcgtacctcgtcggagcgaaattccaaggcctcacgaatagttacatgacggacgaagaacgcgccaacatcgacatagacggagaagaacactacaaccgtgtctggggatccaagattcaagtcataggctggtccttttatgcttgtattctctggtgtctcaagttctgtgttactgctttttacgctcgactcacatcgggcttgtcgcatctcaggatccgtgttattatcgcttatgtcatccttggaattacttatgctgttgttttctttactattttgttatcgtgtcagccatttcaccacttttggcaggtcaatcctgatccgggtcttatttgtcagccgacaaagtcaccggcttatgttttggtggttgtcattcccaacatcttgactgacatttatttgttgtccattcctttacctcttctttggggcgtcaacattagtttgcgacgcagacttacactcatgctgttgttcagtggtgccctcttcatcatgatggcgggtacaattcgagcagtcaccattcttacggnncggtgttgaaggcgcaatctctggtagctcatgggcatgtcgcgaaaactttgtcgncatcatcgt

SEQ ID NO: 62708 - DNA, 588 bp, Triticum aestivum
  Clone ID: PAT_TA_62708
tctccgtcaagcacctgcccatcccgcacgtcgacgttcaggagcgcttcctcttccggcaagtggaacccaaggagagcatggtgttccggtgcgtcgctcggtacggctaccgggacaccctcgagatggccggtgacttcgtggccaccctcgtcgagtacctccagtactatgtccgggacctcagcctctactgtacggccgagcctctcaggacaagctaccctagcattcggatcgatagctttagatgggagaagaagccctcggggcgctcggggcactcggggcatggccatggcatccatgccgaggagatgcttacaccaatccagtccttctctgagctcacaatgcatcaagttggtatgagcaaccggctgccgcaatttcagacggccaagatgaacctagaggagatgctaagaatagaggaggaccaaaaggtgatccaacgggaggtggataatggtgtggtgtacatacttggggagactgaagtggtggtcaagactcactccaacctccttaaaaagattgccgcaaactacatcttcgacttcctacggaagaactctcggaaag

SEQ ID NO: 62709 - DNA, 393 bp, Triticum aestivum
  Clone ID: PAT_TA_62709
gagcgacgctaccggttatcttgtcctccccgatcctcgcacttaccgacatgttatcggccccaacggctccaaggttaacgctatccgcaaggagagcaactgcaagatccaggtccctcgcgaccaggccaaggatgaagccattgagatcgtcggaaccaaggaaggagttgagctggccaaggaccttatccttgaagctgtccgagaaggcagcaacaagacccgagaataatgattaacgggctgacatgacattgcgataatctgtatcatgagcatgacatgacacacacggagcattgttggggagaatgaatattcgaagtaaaagcacagtttcaagtaactaaaatattaatatgaataaaataatgatgcattgtcttc

SEQ ID NO: 62710 - DNA, 240 bp, Triticum aestivum
  unsure (1)..(240): unsure at all n locations
  Clone ID: PAT_TA_62710
aaaaaaaaaanaaaaaaataaaataaaaaaaaaaaaaaaaaaaaaaataaaaaaaaaaanaaaaattaaaaaaaaaaaaaaaaaggccctcaggttttcaagggactcgaataactcgacctttctccttaagttagttttttggccccaaggggccgtaaagactaaaccgaaacccaaagggggcccctgtattaaaagcttgagggtaaaagctgtaaaatggggcgaaaaaggagg

SEQ ID NO: 62711 - DNA, 685 bp, Triticum aestivum
  Clone ID: PAT_TA_62711
aactcaacactcgacatcaattactaatatattcacaatggatcactcacacatggatcacagtggtatggaccatggagatatggatcatggccatggcggaggaggcatgacggacatgtgcagtatgaacatgctcttcacctgggataccaacaacctttgcattgttttccgtcaatggcacgtccgctcgacaacttcgctcctcttctctctcatcgccgtcatcatcctcgccatcggctacgaagcccttcgatctgtctcccgtcgctatgagcaatctctcgataaccgcgttcgctccgtccccagacaatcccagggacaagccgaccagcgcgcccatctcatcaaggccgtcttgtacgccctgcagaacttttacgcctttatgctcatgcttgttttcatgacctacaacggctgggtcatggtttctgtttcgcttggcgcatttctcggatatttgttctttggacaaaggacttcggccacaaaggaaaacgcatgccattaaaaggcagaaattgtgagggcagcggctatggcagagtcacgagttatgaggcgttaccgttggaacagctcaaagtctgtttgaagtaattacgtacctgaggatccaggcaaattcttatcaaagacagcaaagtaactacggagggtaatcctccgattc

SEQ ID NO: 62712 - DNA, 826 bp, Triticum aestivum
  Clone ID: PAT_TA_62712
acgctcaaacgctcctgtctttcgattggtcttccgccgccgcgtcttctttgctagggttttgtttcgcctcccaatcttctgatcaatggcggccgtggaaggcgagaagaagatgatcacgctcaagagctcggacggtcaggagttcgaggttgaggaggcggttgccatggagtcgcagaccatccgccacatgattgaggatgactgcgccgacaacggcatcccgctccccaacgtcgactcaaagatcctctccaagatcattgagtattgcaagaagcacgtccaggccagccccaaaccggctgactccggtgccgccgctgacgccaactcctccacctctactgcagcccccgcctccgccgaggacctcaagagctttgatgctgagtttgtcaaggtcgaccaggccacccttttcgacctcatcctggctgcaaactacctcaacattaagggattgctcgaccttacttgccagactgttgctgacatgatcaaggacaagactccggaggagatccgcaagatttttaacattaaaaatgatttcacacctgaggaggaggcggagatccgcagggagaaccagtgggcttttgagtagaaagtagtaacgtcgaggcaatgttgctcttaagtaatgctagtattgatcttgttttcttagatttcatatgtctacgtttcagcgctgctttttctatgtcgtcgtaatcgttgtaattattccaagtctaaacatcgtttatattcttataaaaaagcctatgatggtagtcattacttgtgaaaaaaaaaaaaaaaaggcccctag

SEQ ID NO: 62713 - DNA, 413 bp, Triticum aestivum
  Clone ID: PAT_TA_62713
accgagttggagaagacaagcgataatcgtgatacaatttacttgcgacagtcattggtcctagctcacttgcagctgggcgatactgcgcgtgcaacagaggagctggagaagggcatgcgacgagtcccatggctgtactgcggactgttccaggagttgaatctcgacacaccaccatcaatctggggtattagtgccgattcagactcgcggtctttctgggtcacgctctacatccatcaagctaaggatctctggaacaacgcacaggttacctctctcctcaccacggaggtcaagaaccttgaaaaggttgacacaagcgtacttgcctgcttatgattctccaccccaccacggagttcactagactcatattccttgtagccccaaacccccttatcgtactg

SEQ ID NO: 62714 - DNA, 805 bp, Triticum aestivum
  Clone ID: PAT_TA_62714
atacatccagccaagttttaacttaaccaacctaacgatgctcttatcaacacgtttccaagccagagcccttcggcaactcatctcgaagcagccatctcgctcaattagcacttctgccgccaaatcactgctcattactccctcaacacaactgactgccaagtctctcacaactttcaactcttctacacctcgctcagcatcttttgctaccagtgccgaagcaactgcggagccggtgaacacaaactttgctgcggtttcaacaggcggaattccctaccccggtattcctaatattgaggacccttataagaagcgccaatggcagctcgagcacatggcgggtgcctttcgtgtgtttgcccgtatgggatttactgaaggagcggcgggacatatcagcgtgagagatcccgttgaccgtaatacattttggattaacccaatgggtgttcactttggtatgctcaaagcaagtgacatggttcacatcaacgaagatggccaagttatcggcggtaatcgtgtagctgtcaatgcagctggtttcacaattcattcagctattcacaaagccagacccgatgttgacgctgcatgccacgcgcactccaaatacggcaaggcatggtcgactttcggcaagcctctcgacatgatcagccaagacgcatgcatattttacaaggaccacagcgtatactccgactttggaggcgttgtctttgaggacgacgagggcgctcgcatagctcaagctctgggccccaagaaacgatcagttattcttcaaaaacat

SEQ ID NO: 62715 - DNA, 774 bp, Triticum aestivum
  unsure (1)..(774): unsure at all n locations
  Clone ID: PAT_TA_62715
agctacctttgttcatacgcctctttatcgcaacaatgtggaaattcgtcgtcactggaatgctggccatggcttcggccgtcagcgccgcctaccccaaccccggtcctgtcactggcgctactcgcgttcacgatcccactgtcgtcaagatgccccaaggaggatacttgatggctcacaccggagactatgtcacactcaagacttccaccgaccgaactgcctggaaggaagctggcgctgctttccccaacggcgcaccatggacaacacagtacaccaagggcgagaagaacctctgggcgcctgatatttcctaccacaatggccagtactacatgtactactctgcctcttcgtttggtcagcgcacttctgccattttcctcgccaccagcaagactggcgcttcaggttcttggacgaaccagggcgttgtcattgagtcaaacaacaacaacgactacaacgccatcgacggtaacctcttcgtcgacggtgatggaaagtggtggctctctttcggatctttctggtccggcatcaagatgattcagctcgatcccaacaccggtaagcgcaccggaaccgcgttttactctcttgccaagcgcgattcctctgtcgaaggtgccgtcgaagctccttttatcaccaagaagggcaacttctactacctctgggtctccttcgacaagtgctgccaaggtgccgccagcacctaccgcgtcatggntggtcgatcaagcagcgttactggtcctttcgtcg

SEQ ID NO: 62716 - DNA, 665 bp, Triticum aestivum
  unsure (1)..(665): unsure at all n locations
  Clone ID: PAT_TA_62716
aggtatccttctcccttgcatcgagtcacgttgacacnaaaaaaaaaaaaaaaaaaaaaaaaaaaaaaaaaaaaaaaaaaaaaaaaaaaaaaaaaaaaaaacctttccccctgcccgccgccgcctcctctcggttccttcttccttcgagtttcagccatgggtaaggaaaaaactcacatcaacatcggggtcattggccatgtcgactccggaaagtcgaccaccactggccatctgatctacaagcttggaggtattgacaagcgtgtgatcgaaaggttcaagaaggaagccgctgaaatgaacaagcggccgttcaagaacgcctgggtgtttgacaagctgaaggccgagcgtgaaaggggtatcaccattgatattgccctggggaagttcgagaccaccaagtactactgcaccgtcattgatgcccctggtcaccgggacttcatcaagaacatgattactggtacctcccaggctgactgggctgggctcatcattgactccaccactgggggttttgaggctggtatctccaaggatggccagacccgggagcacgccctccttgctttcactcttgaagtgaagcagatgatctgctgctgcaacaagatggatgccaccactcctaagaactcaaaggctcgttatgagga

SEQ ID NO: 62717 - DNA, 609 bp, Triticum aestivum
  Clone ID: PAT_TA_62717
atccgacttctgctctttgttctatctcgaaaaggatctctcgattgatccaatttggaacagacaagagctttgaaactactttttttccccatcacaaaccagacaacgcagttgcaacaaccgcaaagatggttcagtccgctattctcggtttcccccgtatgggtgttaaccgtgacctgaagaaggccaccgaagcttactggggtggaaagatctcccaatctgacctcctagctgaggccaagcgtctccgccttgctcactggaagatccagcaggatgccggtgtcgacatcatccccagcaacgactttgctctctacgaccacgtcctccaccagatccaggactttggtgccgttcccgagcgatacaccaaggatggccttgaccccattgaccagtacttcgccatgggccgtggtcaccagaaggagggtgtcgatgtcccctctctggagatggtcaagtggttcgactctaactaccactacgtcaagcccaccctccaggacggccagaccttcaagctcgctgagagccccaaggctgttgctgacttcaaggaggcccaggatgctggcatcagcacccgccccggcc

SEQ ID NO: 62718 - DNA, 633 bp, Triticum aestivum
  Clone ID: PAT_TA_62718
cccgccgccgctcttcttgacctctctctgtgttagggttagggtcgttcgctccctaagatcagagatggcggtgccgcttctgaccaggaagatcgtgaagaagagggtcaagcacttcaagagggcccatagcgaccgctacattggcctcaagctggcgcaggccaaagggcattgattcccgtgtcaggagaaagttcaagggatgcaccttgatgcccaacattggctacggttctgacaagaagaccaggcattaccttcccaacaagttcaagaagtttgttgtccacaatgtgtctgagctggagctgcttatgatgcacaacaggacctactgtgcggagattgcccacaacgtctccacaaagaagcgcaaggacattgttgagcgtgccgcgcagctcgacatcgtggttacgaacaagcttgccaggctccgcagccaggaggatgagtagactgtctgtcagaactatgttttggtctggttcgtatgtaggaaagtattccgctgttcttcgttgtgtgactgtcagggatatctgttattccaacctttttgctaccagtgcagactgtaatgcgtcaaagatctactattgcctttataatctagatcccattgtt

SEQ ID NO: 62719 - DNA, 340 bp, Triticum aestivum
  unsure (1)..(340): unsure at all n locations
  Clone ID: PAT_TA_62719
ngaattccnaaaaaaaaaaaaaaaaaaaaaaaaaattaaaaaaaaaaaaaaaaaaaaaaaaaaaaaaaaaaaaaacaaaaaagaaaaaaaactaaaaaaggctgccgccccccccaaccggtcaacctccatgcagcagcgaggtgaggaaggctggtggggacctcctgtcggtcttggggttctccaggacggaagctagacccaaaccgcagacgtggcctttgcttccgctttcggaggcacgaggctctttcacccgcacggcgcatttggggatccagcaccccggtgccccgcgcgtccccccccgcccttgggccaccctcccacctggttc

SEQ ID NO: 62720 - DNA, 234 bp, Triticum aestivum
  unsure (1)..(234): unsure at all n locations
  Clone ID: PAT_TA_62720
cccggccgctcgaggcgtcgggccgggaaattcccaaaanaaaaaaaaaatanaaattttaaaaaaaaaaaaaaaaaaaaaaacaaaaaaaaaaaaaaaaagggcccaaaagaaaaaaaaaggccccgaacgccctcgcacccgcaccctaaatgggatttttaggggctaggggcgcctaaagtggaccaaatgggctacccataaaggaaacccccaaacttcgggggtgcc

SEQ ID NO: 62721 - DNA, 708 bp, Triticum aestivum
  unsure (1)..(708): unsure at all n locations
  Clone ID: PAT_TA_62721
aatagaacacagctagcttcgacctatatataagcaccccctcggcaagcccattcccggcatagaacaacagctagcccattcccggcatatatcaccaccaacgcacagagatcacctcatcacagctttccagttcaccggccgtcgtcgcgatgaagcccggcaccgagccggccaccggcgtccccgtcggcggcgcaccgggcgccccgaccgcctggtcgtccggcctcttcgactgcttcgacgactgcggcctctgttgcctgacttggtgctgtccgtgcatcacgttcggcaaggtggcggagatcgtggaccggggcgcgacgtcgtgcgggacgagcggcgcgctctacgtgctgctggcgtcgcttacggggtgccactggatctactcctgcacctaccgctccaagatgcgcgcccagtacgcgctcccggacgcgccctgctgcgactgctgcgtgcactactgctgcgagccctgcgcgctcgtccaggagtacaaggagctcaaggcccgcggctacgaccccgagaacggctggcacctcaacgtcgagcgccgcaacggcggcgccggcgtcaacccgcccggcatgcaggagatgngccgctgatcgaaaccggnttctcaatgccttgctctatgtgggaagggagtatgagtatccatcgagcatgggttcctttcggcttggt

SEQ ID NO: 62722 - DNA, 484 bp, Triticum aestivum
  Clone ID: PAT_TA_62722
aatttctctttcaggtatgcctatgcacatgctacaccagattccccacggtatccaagagcagatgcaattcatgcaagctgctacctacggcgcccagcacaagccacagacatcttggggaagcatcccccaaagaccaggaactagtggaagcatgactcctcaccagaagccttcgcttccagcttacggaggatatgcccagtctatcccaccagcggagcgaagcaatgtcggtttaccaagccgatacagagcgtcgaagctaaagggttagacagagaaagaaattgtatgaacaaaaatggaaaaatgaatatgaaaacggctttttgggatgagaggcacgatacctacataatgcgtctcgtataagagcgctttacaacaatttttactatgtctgggagggtttatggggttaaaagattttaataggttatgtacattacgtataagaattctacctggtatcacgatc

SEQ ID NO: 62723 - DNA, 477 bp, Triticum aestivum
  unsure (1)..(477): unsure at all n locations
  Clone ID: PAT_TA_62723
gaaaaaatnnnnnnaaaaaannaaaaaaaaaaaaaaaaaaaaaaaaaaaaaaaaaaaaaaaaaaaaaaaaaaaaaaaaaaaaaaaaaaaaaatccttttagtttttccccccaaaaaaaactcaacctttttttaaaaccttttcaaagtttttttccccaaaattttcaaaatgggcccctggttttgctggaaccaccccgggggttcttggaccaacgattggtcttggtgcaaaccctaaatcctttattatccaaacctgaaaaactttggtttaaatcccgggatcacgggaaaatggctaatcggaaaaaattatggggacggttcgggatcggtctttctttaaaaaaggcaaaagaaaaggggaaagggcaaaaagaaaaaaagggtaaaaaatgggagaaaaaaacggcaacggccacttttcgaggggggcgcatggcaaataccaaattggagcttgcatacatt

SEQ ID NO: 62724 - DNA, 750 bp, Triticum aestivum
  Clone ID: PAT_TA_62724
gattcgggtatccatagcggcaatatccaaacagctattgaaacattaaatgatttcgaccccgagatcctagatgaagacaaagcactgcatttttctctgctacgacttcaacttgtcgaactcattcgtacctgtaatacacctggaggcgatattgggccggcgctcaagtttgccacagagcaactaggccctagagcacctacgaacaacaagttcctcggggatctagagaagacgatggcactactcatgttcccatcggactcgcttgagccagaattagcagctctgttaaaaccagagctgcgcctagaagtagctgataacgtcaaccgtgccattctggaacggcaatcccaaagacgcgagtcggccatccgccagctcgtgagaatgcgcgtctgggccgagaatactgctcgcgacaaaggcaaaagtctacctgagtacctggagcttggcttgtataacgacgtgcctgacctcggtagactgcctccccagacacgaaacggccacgaccccatgattacaacgtgactttgatattagacctggaaatatggtcggactagcctttggttaagcggtagagaatgccggcgttatcgtaacagttcctagcttggcgttaggggtaaatatcaacattgtggtaaggataggaatgagaaacagaaccaggccgggcgttttggagcgacttcgtagtcgtactccaacacatcgtggactccatattcc

SEQ ID NO: 62725 - DNA, 745 bp, Triticum aestivum
  Clone ID: PAT_TA_62725
tggatttctgcaagatcacaacaatcatacatcatggcgtcaagctcgaagcaaccgccaaagggtattctcaagaagcccaagtctatccaagagagaaacgccgaccccaaagagatcgctctcgcgcacgccaatatcatccagcatcgcaaagaccttgaagcagaaatcctcgagagcttggtcatcctgtccgaatatccccaagtccgcaaacctccccataacgcctcgaatcccgcctcgtccgacatagccgatttcaaatcccatgttcgtctattccagccctcagactacgacgacctcatcattgaacgcaatgtgaatgatctttgtggctacactctctgccctcgaccacgacggaatatggggcctggcggtcagtggaagattgcttccaacggcagtatcatgaagcgcgaggaccttgaaaagtggtgttcgcagcagtgtgcccgccgcgctctctatgtcaaggttcagctaaatgaaacagcagcctgggaacgtgcaggcatcccggatatcgagatcgatttgcttgatgaagacaagtcccaggaaacagacgttgatcgggctgcccgagagttgggcaaactcaagcttgaggagcaacgacaagctgcccgtgacactgcggctcttgcccttgagcgaggtgaacctgatgcatccaaaaagcagagcaagaagatcaacattacgcttaaggagaaggatgcaaaggcacctt

SEQ ID NO: 62726 - DNA, 336 bp, Triticum aestivum
  unsure (1)..(336): unsure at all n locations
  Clone ID: PAT_TA_62726
aggactgactagaatggcaccagcgaggggctggncttttgcctacggcggagcaaatctgacgaccgttcgcagccggcgaagggcagcaggagggagcgccncgaacagccggagcgcagggcgaggcacggcgacgccacccgcaacggagagcgccagaccgggcagaggaggcaccggcaggaggngagcacgagcgagnacgaggacgcgcgcgagaggagggagaagcagagccgcaccgcgaccgcgccgccgccgccgccggcaaggcgccacagcaggaaccggcacgccgcggccgcgggcccgtttttttttcccccccccccc

SEQ ID NO: 62727 - DNA, 459 bp, Triticum aestivum
  Clone ID: PAT_TA_62727
ggccagtaccaagactgttcccccaggtcggactacgtaactacacccgcttggctggtttctggacaatccaaactttcgatcgatggatccttccatcatattcaagctggttgggtgtggtgttcgtctggatgcacacgccgttcgtcctgcggtgcgtccagtggaccgacgcgcaggccgccgacgacagcaccctctggttcgggatgctgtgttgcgcgctactccaggcggctgcggcggcgctggcgctgcacctcccgtgccaccgccgctgggcccgccgcgccctcgccttcctcgcgctcgtcgtcaccttcgtcggccactgcatgtacgccgccgcggtccgcctcctcctcgccgtcgacccagcatacatcatcgccaggatcttctgcacgataaacatcgtcatcttcgcggggggcgacctcatatgcttactgggat

SEQ ID NO: 62728 - DNA, 426 bp, Triticum aestivum
  Clone ID: PAT_TA_62728
gtgataccattaatctcctgtgttgctgttctgccattatggggttactccttctgccggctgtggctctcgccgcactcattgtttactatgtcttgttccccaagaagcagactggtctgcctcttccacctgggcctaagcccctccctattatcggtaacctcctcgacctcccacccgctggcacagctgagcaccagcactgggccaagcacaaggaactctatggacccatccagctctctcaacatcctcgttcagcccatgatcgctctcaacagccccgatgctatgcacgagcttcttgagaacacgtccaccaagacctcttctcgacctcatcgcaacgtttgcaggcgagctttgtggtctccaagcgatgcttcctcttatcccttacggctacaagcccccgatactttc

SEQ ID NO: 62729 - DNA, 490 bp, Triticum aestivum
  Clone ID: PAT_TA_62729
aatccattctccggtcaaggatcaatacaacacctcccttataatctcctctgcaagctctgcttccatttccaaccgcaatggctacaaggagaaccattcttctcgccatggctgccatggtcatcctgagcacggcgtctgcggcaatctacaatgtgggcgagccgggcggcgcatgggacctcagcaccaactacggcatttgggcgtcctctaggaactttcaaaccggcgaccagatcgtcttcaagtactccacccaggcacacgacgttcttgaggtcagcaaggccgactatgactcatgcagcaccgccagccccgtcatcaccttcaactccgggaatgatgttgtaaccctcgtcgccaccggcacccgctacttcatttgcggtttccctagtcattgtgcgggcggcatgaaggttaagattgatgtcatgccaggctcctcctctacgtcacccgccccggccagcggcccaac

SEQ ID NO: 62730 - DNA, 842 bp, Triticum aestivum
  Clone ID: PAT_TA_62730
atacttcgaaaagacacttttactttcgaccattatcatccgataccccctacaaagtggcgcataccctcgactaagcgattaatacctaaatttatacacattcaagatggccgaccgattcccttcgctcgaggacttcgattccggggcgcaaactgatatcaaggacccgaccgctgaaccatcgactgacgattttctcgctcgtgaaaaggctctccttggagacgatgccgagcagttcacaaccaacaatgacgccgctgctttcgctgatgccgacgatgaccttcttggtggtgctggtggcaatgagcaatctactttcgagtctcaatttcctgatctgactcaacctgaagctggcactggagtttctgctggaactgccattactggaggaccttccgtaagctacaactcaggataccaggccgcctcctttgaggaggaacaggaacccgaggttatcaaggaatggcgcgaaagccgagacaacaagattgccaagcgcgccgaacaattcgctgcccagcgagaagagacaatcaaggaggctcagcagaacatcgatgacttctatgacaactacaacaacaagaaggagaagggtattgcccaaacacgaaaggaagccgacgagttcctcgagagccgagaggacaccgtttccggtggcaccagctgggaccgaatcgccaagttggtggatgtgagcggcaagggagccaagggagggtgctctggctcgggcaaggacgcttccgagagctgttggtgagcctgcgaaaggacgaaaagcgcctggcgctacggcctactaatgtaagtctgttttg

SEQ ID NO: 62731 - DNA, 590 bp, Triticum aestivum
  Clone ID: PAT_TA_62731
aacccaccacaacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttctctctcgagaaaaagttggtgttgcttgttgttcagctatccggaatatcctccgtgaataaacagctgtaatgattgtgcgtggctgccaataac

SEQ ID NO: 62732 - DNA, 701 bp, Triticum aestivum
  unsure (1)..(701): unsure at all n locations
  Clone ID: PAT_TA_62732
ttcgcccgaagaaggcctatgaatcnnnaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccccccttcccgtttcccgccgcctccgccttttgccgccgaagccgaaacatggggggggaaaaagttcgggtgggagttatggaggagaaacaaccccaacggaataaggttcgggaagggcgggctttgttggaaaaacaggaaaaagcccccaatcgtccgaataacaaggccccccccccccaaaagggaacgccgttttgttttaaaggccaaaaggggttaggggatctaccgaacccggggaaaacgggggggaagaaaccccccagggcccaagggaattgtttagggaaagcccaagccccagggaattccccaactcaggttccaaagaaacaaaaggtttgttgttgagaaaaaacttggccccaggttggggggctttcgggccctaaaccccaacggggggaaggaggacccccccaaaaagaattttgaggccaccctggtagagggggctaaaagggttgtccgaaacaatccagggataaattggttctgaaagcctgggcacaagcaccgggagctgcggggtcccccctcctgaggaaaaaaattccggg

SEQ ID NO: 62733 - DNA, 725 bp, Triticum aestivum
  Clone ID: PAT_TA_62733
accgccagcactataaaaaggcttaccctgcatgatccgagccacatccacagccatttccgagccactgaatccgcacagaattacgaattccttgttgagctcgtccgattagccgccatggtttcatcaatgaagcagtacagagatcaggccgatgcgccctcgcccctctccctctctctgtccctgggagtcgtctccgacagcagcaagaagatgcaccgcggcggcgcggacggtgagttcgtgtgcaagacgtgcagccgctccttcccgtcgttccaggctctgggaggacaccggaccagccacctccgtggccgccactgcctcgcgctcggcctcgctgcggggtccgatcagccggggaccaagaagacggtggaccagaagcaggcgcaccggtgccacgtctgcgggatcgggttcgagatggggcaggcgcttgacggccacatgcgccgccaccgcgggcaggaggccgccaccacggcgcaggcgccgcccgttctgctccagctcttcctctagcactgcaccatcgatttctctcaagttcaatagcgaggcatatctagttctagtccagatttacaggatcacctatgtgcacgatttggtttgcacatttgctgcacaatagttggtctgctcgctcatgttattaggtatatatatgtacatattttaggactcattcattcgttcattactgtttaaaa

SEQ ID NO: 62734 - DNA, 748 bp, Triticum aestivum
  Clone ID: PAT_TA_62734
actcggagactcgtttcttgtgtgtgctcgccaagcccagcaagtcacgggcagcaccaagccaatggaggaagcgagggggcaccaggggataccggcgttcggcgaatggaactacggcgacggcgacgactggcctgtgctcgcccaacgcttcgagtctgcgatgcacacccagctccccgtacacaaagcctgcaagagagcgagggcgtgtcgcaggaggcgcttcccagcgttcggagattggaacaacctcggtgatggcgacgccggtggctggacgacggccgtcgtcaaccagtacttcgagcctgtcacggcacacaaatcactcaaggaggaattcaatggttaccacagtggcgtcgtcgccatggggaagcagcagcacaaggtggcgaggcaaacctgggtggatgactcagggacccacgtggcaatgcaacctttctccttcgtggcggtcaaggctgttgacgacgacctgtatgatgtcccaccggacatgctctgtgccaagccactacggaaaggtaggacatggctgaggagaccgtgatgatcaagcgcccatctatagtcttcttgtttgcttgtgcatgccacctagggctcacattgctacatgttttgatggatcgatggatgaactgcacgatgtcgttcactgtcattgagaatgtaactgtatatgtaagatggtggtggcgggttcataacttacatgtaggttatgctttatttg

SEQ ID NO: 62735 - DNA, 847 bp, Triticum aestivum
  Clone ID: PAT_TA_62735
gacctcagcacatcaacgtcaacacccatcgaccaaatccagcatcaacccctcgatctgcttttatcacacgaacaaaagcattccgaattgctcccaagtaccgtcctctcgaaaccaattccctccaaacctgcatcatggcttccggatacgacagagctctgtcggttttcagtcccgacggtcacgttttccaagtcgaatacgccggtgaagctgtcaagcgaggaacatgtgctgtcggtgtcaaaggtaccgatgttgtcgtgctaggatgcgagaagcgctcggctatgaagttgcaagatactcgcattacgccctccaagattcaacttctcgatcaccacgtcgctctagccttcgctggcttaaacgcagacgctcgtatcctcgtcgacaaggcgcggttagaggcccagtcccatcgtctctcagtcgaagaccccgttaccatcgattacatcaccaaatatgtcgctggtgttcagcaacgatacacccaggctggtggagtccgaccattcggcattagcactctcattgtaggcttcgaccacggcagcgacgtgccccgactttaccagaccgagccttctggtatctactctgcatggaaagcgaatgctatcggacgctcaagcaagacggtccgcgagttcctcgagcgaaattacaaggaggatatgaaccgagaggcaaccattcgactggccatcaagtcgctgcttgaggtcgtccaaactggagccaagaacatcgagatctccctgatggcgcctggtgctactattgagacactgcccacatcggagatcgaggggtacgtcagggagatcgagca

SEQ ID NO: 62736 - DNA, 432 bp, Triticum aestivum
  Clone ID: PAT_TA_62736
caatggctctaccgtggcgaacaagagcgtcgacttatctttgcctgatggatacagaaacaagggtccttctgcccctaaacgcacatcctgaacagaattatggtgttgcgatgatcaaaaagaccgtgcctgctgccaaaccacaaccaacatgtacctgtgggctagactcagcatccgagcagctgccagtttcgcgcaacgtcgttgacaaaccgggcaacgttatcgaccatgattatccaatagacgcagagttcttggagataattgttcaccacatcttttcacattccatatttcgaccggttttttttattctcccaccctacctccggaaccagaccgccaccaagccaatttgtttgaatcctttactccatgctgcttatgcccctgcccctcccgctcttcagcactccacccctc

SEQ ID NO: 62737 - DNA, 698 bp, Triticum aestivum
  unsure (1)..(698): unsure at all n locations
  Clone ID: PAT_TA_62737
gcttcgatctttatattgtggtcattcctctcatcgtttctctcgtttcccatctgcctctccatcttctatccccatacttcactcatcatggaccaaattcaccagtctgcccaccaggcacccacagacaagaagagagaatcagtaccagacatgttcgacaacagtgcaggcgagatcgccgtttgcgacatggagaagcaaaaggctgccgagggcaatgctcacttccaccgtcttggatggaagcgattgacggttgttctgatcgtcgaggctatcgctcttggatgcttgtcgcttccctctgctttcgctactctcggcatgtnttcngttgttacccccactgccggtctcggttttgttgccatctacacttctcacgtcgtcggtcaagtcaagcttgcttaccccgaggtttctcactatgccgatgctggtaaactcatgtttggcaagtttggatacgagctcgtcggtgtcatgttctccctccaactcatcttcctcgtcggatcccactgcttgacaggaacaatcgccttcctcaacctcaccgataatggaacatgctccgttgtctttggtgtcgtctccgccatcattctcctcatcgtcgctatccctccctcattcgccgaggttgccatcctcggttacatcgacttcgtctccatcatcgtcgctgtcct

SEQ ID NO: 62738 - DNA, 585 bp, Triticum aestivum
  Clone ID: PAT_TA_62738
aaaattactaacaagctcaccaactttaaccaactcataacgacttgagcatcaattctacaactcccaatcaaatctctatctttcaatcttaacaaaatcaacaaaatgggtctccccactttctcagagtcaaccaccaccacaacagcatcctctcaaaccccgcaagaacaacagaccaacaacagcactggcgtcgctacaggtgcaggcgcaaacactgacgccggcgtgacgagaccaaagacggaggctgaattggaggctgatcggctttacgaggaggctatggaggaggagtatgctaagcgggatggaggttcttaaacgttggtcaagatggaacagcggatggatgaattaagatcatggagttatgcatgagggttaaacacaatggccccgaagaagtattctcaactctagatggaatggaacagaacataaaataagacggagcgaatgaaatatctgttttaacgcctatctgttgaagaccaaatgcagatacaagccaataaatagtgacataaaagggaggacaataagttgtgactagtattatattttgtcgttctgtac

SEQ ID NO: 62739 - DNA, 787 bp, Triticum aestivum
  Clone ID: PAT_TA_62739
gctgccgtggtccacttcttcactggctgcctgctacgaaccagagcgagctgcgtatggcttcggcggaggcgccggcggcaaggccgattctgtactcgtactggcgcagctcctgctcccaccgcgtccgcatcgcactcaacctcaaaggtatcgattatgagtacagggcggtgaacctcctcaagggcgagcagtctgatcccgagttcatgaagcttaatcctatgaagttcgtccctgccttggtcgacggcgacgcagtaatcggcgactcttacgcaatagcattgtatttggaggacaagtacccccaacgtcctcttttgtctttgaccttaaaaagaaggccctgaatatccagatagcaagcattgtgtgttctggtattcaacctcttcacaatctcaccttggtgagatttatcgagcaaaaggttggaacaggggagagcatcccgtgggtccaacaacagattgatagaggtttcacagctgttgagaacatgatcaaaggctgtgctgggaagtttgctatgggagatgaagtccaactggcagatgtattccttgcaccccagatttttgctgcggtgactcgttatcaaacggacatgtcgaactatcccaccctcgcgaggctccatggtcagtatatgacacaccctgcatttgaagctgcgctccctgaccggcagccggatgccccttcctctggctaagacataggcccaggggagaatcagtaggtctcactcctttgtttctacctgtgtcctgtcccg

SEQ ID NO: 62740 - DNA, 703 bp, Triticum aestivum
  Clone ID: PAT_TA_62740
agttccatactcaacaagcaatttcaacctacttactatcttcaattcttttctcttccgctggtcggctggtctactttcacatctcacatcttctttactacaaccaaccaaccaaacaaacaacctcttcttcaccttcaacaaattcaagatgcagttctctctcgccacccttgttttcggcctcgctgccattgcctctgctggcaccctggacgttgagggtgttcgcaacgctcctcgcagcgctgtcaacgtccgtcgccagaacgacaaccgacctgttcccaacggagcatgctgtgttgccaacaccagcttgaagcaggatacttgcactgctgccaacggccagaccggtcgctgcgtgcctggtggaaacaactgtaagtaacagtctaacaatatctgtcgagcatcgctaacatcatcataggcggctcttctctaagctgtgttgcgcagtccaacctcgagtgcgataacaacgtcattgagcgtggaagctccctttgccgtgccaaggctggcaacggcggtctctttgacggcgccaacattatccagaaccttggacaggccaaagtcaactaagggtctattagttgaagtgattttgggggatatgtaaagtagctgtgggatatgaaatagatctaccgggtctggatagtaggtagttgaaatatataataaccgc

SEQ ID NO: 62741 - DNA, 511 bp, Triticum aestivum
  Clone ID: PAT_TA_62741
aatgcaaaagaaaagagcatcaaccaaaatccatcagatcatcaagaggagcagcaaattcatctccatgggagcggggatgaagcgcgcgagggaggaggagccgattgtttcgctggcgctgtccctgagcacggactcctcggtgtcgaccacgactcggacgactctggcaccggtgcgccggcggcaaagaagaggacacggcgggggagggtggtggcgatgtcgggggagggggagttcgtctgcaagacgtgcggccgggccttcgagacgttccaggcgctgggcgggcgcaccggaccacccaccaccggggtcggcacggtttgtttctcggcgtccgcgccgccagggtcatccgggagtggtaaaggtgcgaggacaggcacaggcagcagcacgactggcacatctgcgggctgggcttcgagacgggcccatagttgccatgtttccggtacggtgggaacgaggaacgggaacgagggacgagagtcgctgattg

SEQ ID NO: 62742 - DNA, 487 bp, Triticum aestivum
  Clone ID: PAT_TA_62742
gccgctgagcggccgggcggatttccctcaaatcaactactataaaccctttttaacaacttccttccaaccaccaaacaatcttcacaatggctggcgactgtggctgctctggtgcctcttcttgcaactgcggctctagctgctcttgctctggctgcggcaaataaacaacttgatctttgatcattcggataccacttgttctaggcccaagcttgggtcaagatacatcctttgacgacgaatcacggacggagttatgaagggcggagttgagatcatgatgtgattgggatatgcgcttggatagttagctacagatcaagcttaaatactacccttgtgctgagtaaccccccaacacacaaaacaaaaaactcctccggcctccctgtcgctccccccccatccatccgcgcctccaaacaaaataagtgcggccacccgcaccaccgaatcctcctccgcctccaaatccgccctc

SEQ ID NO: 62743 - DNA, 337 bp, Triticum aestivum
  Clone ID: PAT_TA_62743
cctggccgctctgagtcggccgggcctccgtttactactcccaaacacaaggtcttcgacgtatgtttcagtcgcgcatcactgtgaaaggtcaactgtcttcctggatgttgtcaactcatccgtgttgatgaagctacattcggtgatgctgttcttcgcgagcgattcggttactgtcctaagcccaacgatatcatgacacagcacatcatgggtaactactctgaggacagtatccacgcgtccatcatctttagtctcttccctggctgccagaccgctcaggctcttcgcgccaaggccatgactattgtgcctcacgactgcaaggtgt

SEQ ID NO: 62744 - DNA, 624 bp, Triticum aestivum
  unsure (1)..(624): unsure at all n locations
  Clone ID: PAT_TA_62744
aataactgacagtatctaacatccaaacaaaccatcataatgtccgacgacgagggtatttccatttacgacgaggttgagatcgaggacatgacctttgatgaggccatgggagtttaccagttcccttgtccttgtggcgacaagtttcagatcaccctagaggacttgctagatgagcaggatatcgctgtctgccccagctgcagtctcatgatccgagttatctttgacttggacgatctaccaaaacctcccacttcaggcgcctctggcggacaggtccccatcactgcctgagccgaccggaaatcatgatagaaacatgatacattttgttactaccatgtgaggagaatcaacagggcagacttgtgctgctgcgccgcgccgcgactacgacaatcgtatctggtcctcaaatcatttggtgaaacctggtacaaagcgatacgacagaaaatatcggaattttcattctcgcaacgccctcgacccgacttgatcaaatgaatccttcttcagtgngacgggaaggagcctccagaatgcatttgatcctggtcgacatatgttgtatcagtcttgtgtagccaccataatcagtcgacttgcaagggtgac

SEQ ID NO: 62745 - DNA, 648 bp, Triticum aestivum
  Clone ID: PAT_TA_62745
cattcaagcgtgtcctgagcaggaggccagtcgattgaatctcatcatggctgatcttcccatcattgccgacggttctttcgaagacggcaagcctgaacgactaccgaagcagctttctcgacatcttcttccggcggctcgtaatcgcgagataaacgatgtcgtggtcgatgccatcactgggtggatcaagcgtaccgaggagaatgagtctgatctcagacggacttcgtccgaagatgtttataagtctgcgtcaaaggacgacaagggaggacggtacaggtctgacgactaccgggatcgggatcgggataccaaatatcgtctttttttctaggaccaccacccgccaccgttatctcgatccgccttcgttccccgcgtcaactcagacagcatcgtccgtcctaaagactcctctcccataccctccggttcgagtcacagatccagaagtcctatcatgtccaaccgctaccgccactccaactcatcgattgaaggcggcgctagcacggctgacaactacgacttgccttcccccagccatcgtaacggcggcagtcgacgcaaccgtgataaaaagcatccattctcctcctcaggacacgaattcaaacccccccctggaaaccacccctc

SEQ ID NO: 62746 - DNA, 511 bp, Triticum aestivum
  Clone ID: PAT_TA_62746
cggccgctcgagccggcgggcggcttctgaatgaccacgatagatccactttcgagctgaggaataagatagatcaatggcgttgacggccgcgctggggagacggggagcggagcaagatcgggacggcggcggcagcaatggtggcaatggaaatggcggcggcgaggcgaggatgatcatgcgggagcacatgttcgacaaggtggtgacaccgagcgacgtgggcaagctgaaccggctggtggtgccaaagcacttcgcggagcggcacctcctcccgcgggttcccggcggcgcggcgggggcggactgccccgaagccgtgctgcggttccaggacggtttttggtgtttttaacccccgcccccttcccattctcctactggagcagcagccagagctacgtcatcacgaaagggtggagcgccttcgtccgcgatcgtcgcctcgccgccggcgacaccgtctccttctgccgcgccggcgcgcccctcttcatctactgcc

SEQ ID NO: 62747 - DNA, 346 bp, Triticum aestivum
  Clone ID: PAT_TA_62747
gggccgggatttccagtgctaacctttgcagacaatccttctatccacagcgctatttgcaaagttagtttgtgtcgaccgatcagaattcagaatgatgatgaaatccaagtttgttgtgctggtgatcctgatgttggcgatcacggcgctcttcgtcgggtcgagctcggcgcggccgttgggcggcaatgtgcagaccggagcgtccgctgccggcgtagtcaacggcaagtccatcctccagcttctccagcgactgtatctgcataatcttcatggggcgtcgtgctagacgaacgacccctatggtgtatgcccgccgtcaccttcacgctgagttttt

SEQ ID NO: 62748 - DNA, 499 bp, Triticum aestivum
  Clone ID: PAT_TA_62748
atccttccctcttgtcactcgcttgtctgtccatcatgaagctcgctctcgttgcttacgccctctctgcttcggcatgcctcctcccctccgactcactccctcactcggagcgcagctatggcctgtcagcccgataagcccgtcctgagccagacttccccatcggcacaggcgaccgcttcaacaagggcaaggtcgttcccaagggtctgtccacctcggaccgcaacctcaagtccatcctgacccccactgaggtcaactctgcgcttgagggtctggccaagcagttcaaggaggtcgagcttatctaccctccccacaagacctatcgtggttttcaagaccccgccgcggcaagattggaaagaaccccaagttcttcatcatcagtggtgcacacgcccgtgagcgcggtggcccagacaatgtcgtctactggctcctctgatctcctgcacgctcgctaggcgggcaaggggctcaagtatggcca

SEQ ID NO: 62749 - DNA, 186 bp, Triticum aestivum
  unsure (1)..(186): unsure at all n locations
  Clone ID: PAT_TA_62749
nagtcgcgtagtggactgctggggttcacgttgtttaccctcagcagcccaactagcccaaggacaagtgtcgagttgagattcctcagatcgacttcatctcgtgatagtccactttccctcattaccccaagccttcttctctccctggtgatgacaagacctataccttcccctgtggtgaga

SEQ ID NO: 62750 - DNA, 730 bp, Triticum aestivum
  unsure (1)..(730): unsure at all n locations
  Clone ID: PAT_TA_62750
gtttcctaactttcccctcccctactctgctctgctctgttctgctcggccgggaaatggaggaggagcccccgccggcggagcctcggtcgcagcggttcgtgctgtggctgcacgggctcggggacagcgggcgcgccaacgagccggtggccgggtacgccttcgccggcgcccgctgggccttccccacggcgcccaccgcgcccgtcacatgcaaccgtggcatgctgatgccgtcgtggttcgacatccacgacacgcccatcacctccaaatctgcgagggacgaggcggacgtgctgagggcggtggagagagtgcacgccatganctgctcatgagatatccgccgcgacgaggccggaggatgtcttcatcttcgggctcagccagggaggcgcgctgagcattgccagcgtgctgctgtatcccaagacgctgggcggctgcgcggtcttcagcggattcctcccgttcggcgcctccttcgcgtccagggtgacggccgaggccaagaagacgccggtgctgtgggtgcacgggcgagcggacttcctggtcccgatcgaggcgggcaaagacgggaccaagttcctaaggcgacggctgggcatgagatgcgagctcaaggtgtacgacgggctcggccaccgagctggcgccctacgagctccaatactgcgagcagtgggccgccggcggggggtggtggcttccaacgacgacc

SEQ ID NO: 62751 - DNA, 371 bp, Triticum aestivum
  Clone ID: PAT_TA_62751
gctcgagccggccgggccggtttaccgaggttatctcctctcgccgcagttccaccgaagccaagagaggagcagggcgaaaggaggccgtcggagatgtcggagaagaagcgcgcccccggcccgcgcaaggacgaggtggtgacacgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagtggcatcaggagtgtcccgaggagagtccgtgtcaggattgcctttttttttttgccccccccccc

SEQ ID NO: 62752 - DNA, 400 bp, Triticum aestivum
  Clone ID: PAT_TA_62752
atccaccaaccagataatccaccaagcgaatcatcacctaccaactacactagatatccatcatcatgtcttcttctcaagcctcttcacaagaactctctgccatgagaacctcccagcctctggagacagaccagcccaaggcccagcattccatggaccctcaaaaggctcccgagactacagagcctagcctcgaactccgtggaggaggtgcctgcgatggcagactttgtggcattattccttgccccattccagtcaactgctggatcatcccttgcccctgctgttaagtgaacgcggtggagaatagcctttagtggccggtatatatgcaacgatatgggttttgcacatattcactgaataattaatgcgagttggtatttcgttatgt

SEQ ID NO: 62753 - DNA, 213 bp, Triticum aestivum
  Clone ID: PAT_TA_62753
acccacaacacggattaagtgcggggaaagtgtaaggcgaaaggtgtggatgccgatgccatggccatgcccgcacgtagcacgtagtacgtacggctgcgcgcaccggcacctcccctttctttgatggctcgggccaagaggtcatggacggggcgcaggcaaccgactgcggcgggagaggcatgtgatgctcttcctttcatacgggtc

SEQ ID NO: 62754 - DNA, 547 bp, Triticum aestivum
  Clone ID: PAT_TA_62754
atatcgagcaggaaaagatccatctctctgcatctgtttaccattgaaagacgctgagcgttcttcttttcctttttctgttttttctttatttccttatatattatttccttatttcctaagtcgtctatgttagtatctcaagtcttgcttttgttcgaccatctacaaacgtttctattgtttcttggggctatacttctctgtaacgacaaacgtcttgacgactggaacgatatcgatactctctatacaccttcgaactcataacaaaacacacatatacaccactttaagatgcaattatcaacattcgtcgcgtccgtcttggcagtgactgcttctgcagcacctagcttccccaagcccaccattaccgatactcgatctgccatcgacacattaggatcattgtctggttacttcaacctcgttgcggaaaaggtcaaggctgccaaggcatacgatgtagctcccgcctgtgatctctcacaagacacagaggctcttgatggacaattgcttcctccttccaagggactttacc

SEQ ID NO: 62755 - DNA, 837 bp, Triticum aestivum
  unsure (1)..(837): unsure at all n locations
  Clone ID: PAT_TA_62755
actagcacggctccaacatcgacaattcgactctcattctcccacatagatattccgtcaccacctgcactcccaaatatcagcgaatcctttatttcacgcatttttagacgacaggagacttgcggatttcatcatgccttccgcaaccggctcaaactgggagaagtaccagaagaacttcgccgacgatgaggtagaggagaagaagatcacacctctaacagacgaggatatccaggtcctcaagacctacggtgccgcgccttatggaacatctatcaagaagcttgaaaagcaaattaaagagaaacaacaaagtgtcgatgagaagattggagtcaaggaatccgacacaggacttgcgccaccacatctatgggatatcgctgccgatcgccaacgaatgtcggaagagcagccttttcaggttgctcgctgtactaagataatcgccgacgagaagggtgacgagtccaaaagcaagtatgttatcaacgtcaaacagatcgccaagttcgttgtacaacttggagaacgagtcagtcccacggatatcgaggagggcatgcgagttggtgtcgaccgcaataagtaccaaatcatgcttcccctgccgcccaagatcgatgcgagcgtaacgatgatgaccgtggaggagaagcctgacgtcacctatggcgatgttggtggctgcaaggagcaggtcgagaagctcagagaggtggtagagatgcctctgctgtcccccgagcgttttgtgaacctcggtatcgaccctcccagggcgncctgctctacggncctcccggaacggaaagacctctgtgcacgagc

SEQ ID NO: 62756 - DNA, 751 bp, Triticum aestivum
  unsure (1)..(751): unsure at all n locations
  Clone ID: PAT_TA_62756
atctctgatgttccccagtgtgtcgacattctctccgatattctccagaactccaagctcgaggagtccgccattgagcgtgagcgcgacgttatcctccgcgaatccgaggaggtcgagaagcaggtcgaggaggtcgttttcgatcacctccacgccactgctttccagcaccagccccttggccgcaccatcctcggccctcgtcagaacatccgcgacatcacccgaaccgagcttaccgactacatcaagaacaactacactgctgaccgcatggttcttgttggtgccggtggtatcccccacgagcagcttgtccagctcgctgagaagcacttcgctggtcttcccagcagcggcccccagaccggcgcctacctccgctccaagcagaaggctgactttatgggctctgacgtccgtgtccgagatgacaacatgcccactgccaacatcgctctcgccgttgagggtgttagctggaactccgaggactacttcactgctctcgttgctcaggctattgttggtaactacgacaaggctgttggtcaggctccccaccagggcagcaagctcagcggctgggtccacaagcacgatcttgccaacagcttcatgagcttctccaccagntacaacgacactggtctgtngggtatctaccttgtttcccgacagcctgaccgagttgatgacctcgtccacttcgctatccgtgagtggatgcgtctctgcacaacgtcag

SEQ ID NO: 62757 - DNA, 533 bp, Triticum aestivum
  Clone ID: PAT_TA_62757
attacactactcaagagtaagtttgatgtgcatcctcgtatgcacctttgctaacatgcccagtgtctaacaacaagatcgttcctctcacaattatcaagggcgctggccatgagcacatccctatcccagagggagagtgcgcaatcattgccgacttccactctgtcaagtcccagagctcacactctacaccttacttgacaaccggcttctacagagttgtccctggacctacacgatacggcgagtacgactatgaggagaccaaatatgtcctcaagggccgaatcgatatcaccaggatgaagctactggcaagacacaccaccttgttgccggtgactgggccttcttccatgttggatccaaagcccagttctcaaccaagactgaaggtgtcgcattctacgctgtcacccgaccaatgaacgacggccaccctaaccttgttggccgtgaggagagcacctccaagttgtaaaagccatattattatagactttaatgaattaagatacatttttaacacg

SEQ ID NO: 62758 - DNA, 391 bp, Triticum aestivum
  Clone ID: PAT_TA_62758
atatgaagatttcatgtgaaggtaattaatccacgacaaaggacaagtttagggaaatctatggaaaactacaccgagaagctttatcggttcgatagtcagaggtcaaaacaccaacaattaaatcacgccatttcgcatcaaagctgtcctgtgaaggaacatacaacgatacactaatcgactacattttcatacatcaatgagaccctttcgccagaatctaattattgatataaagccccgtccaaattacaccaactgctggaaatgcacaacatttatgacattcaaccagaggaagacgagtcagtgagggtgtctcaagaaatagagacacttgcggaccaatcgctacacgctgttgtcatcattcaatacttatcaatat

SEQ ID NO: 62759 - DNA, 458 bp, Triticum aestivum
  unsure (1)..(458): unsure at all n locations
  Clone ID: PAT_TA_62759
gatcagactcgcagtacagtagtttcttcatagttcagggcagcctacaccagcggcatcttcgattctcagcagttatacgatggcatcgtcgtcgaggcggcgcgcggcgactctggcggcagcgctcgtggtcgtccttctggtcgcccgagcgggccttgtcggcgcggcgcggccggcgccggcggggaggagtggggacggcgcgatgtactcggcggtgtacccggcagcggtgctggtggcggacacggcgagggagacggtggagatgctcatggcgaggctgccggctgggcccagccccaagggtcccggccactagctacgctgnttcggcaagggcgccgctgtcggctgatcgatcggtctgatccgcctgtgaatagttcgggttatggacacatgaaggttacgtatatactaattgcacatatagaggatgattattcttt

SEQ ID NO: 62760 - DNA, 614 bp, Triticum aestivum
  Clone ID: PAT_TA_62760
atctagccggtccgctgcttgtgtgctagcttggccggtctgttggtggcttgccggagcgtgcgcgtgctgctgctcagcaagaagacgcgtctatgtgagatgagctggccgtcgctcttggtggcaccgtcgacgacgcatgtggctcgtggcctccgtggttgttggcaccgccgctcgccggcgtgtggttggggagctgttgccttcccgccgtgtgcatgtgctgccgctgccgcttgcagctgcctcgcatcagctgcttcgctgctacgtgcatgagggagtttggtggccggccgccggcgtacgtgctgctagctgctgctactttgctgcttgagagatggaatgcgggcgagccggagaacgaacggtgcacacctgaagctggaggtgctcaagcactacgccggcaggctgctgcagctgctcgagtcctccgccggcgtgcttcgagttctccatggctgtgtgcctgtgtacgagagtgtggatgtgtgagatggtgagaaagatgagagggacagaagataaggtgtgtgtgtggctgtgcgtggcatgcatgtgtgtttgtgtttgtttgtgatagacgtttgtggttctaatgc

SEQ ID NO: 62761 - DNA, 527 bp, Triticum aestivum
  Clone ID: PAT_TA_62761
acttcctggaccagaggcagcattcgcagcagccgcagcagcacaagaagacgacgacgcagccacctccgacgcagagctcgagactcgagagaggctgacgacgagggcgacgaagccggtggccatgtcggcggagacggagcggagctccacggagtcctcggcggcgtccgggctcgacttcgaggacaccgcgctcacgctcaccctgcgcctccccggcgaccccgaccgcaagcgcggcgcctcctcctcctcctcctgctccctcgccgaccgctcctccctcctcgccgaggctccgccggcccccaaggcgcgggcggtgggctggccgccggtgaggtcgttccgcaagaacgcgctcgagaacgtcgccgccgggtccaccagggcggcctgcgcgccggccaagttcgtcaaggtggccgtcgacggcgcgccgtaccctgcgcaaggtgaacctgcgggactaccccggctacgaccagctcctccgcgcgctcccaggcaagccctgctcc

SEQ ID NO: 62762 - DNA, 423 bp, Triticum aestivum
  Clone ID: PAT_TA_62762
agtttctcaaggtgcctacactccatctctggtcacattgctattgaagagcccgacatcacaagtgttgccattgcaccgggtcgagtggacaccgagatgcagggcgttattaggtcaggaggcaaggaatctatgaaccaggcgcagtacgaatcatttgtcgacgccaaggagaagggtatcctgctcaagcctgaacaacctggcaatgtcatggccaagtttgtcgcagacccgcttaaggagctgagcggaaaattcttctcatggaactcaccagaggttaaggcgtaccaggaatagagtataccttggtagggctgggaacacgaaacacctgtatatctcaagcaatgttagcttatgtcttaacgtatatgaagatagacaaaaggtagaaagacaaatgcaagtcagtcg

SEQ ID NO: 62763 - DNA, 817 bp, Triticum aestivum
  Clone ID: PAT_TA_62763
aggaatatcaaaaaggcatggcatgaggtgaccactacagcttagcgacaacgaaacccgtcaccgcgcatcatgagtgagcactatccgacacttgcgcagactgcgcttgtcgctgctgcgttcaagatcctcttgttccccgcctacaaatccaccgactttgaagtccatcgcaattggctcgctatcacgaacagccttcctctggagaagtggtatgtcgaaaagacttcggaatggactctggattacccgcccttcttcgcttacttcgaatggatactcgcccacgttgctcgtctcgtagatcccctcatggtgaaggtctacaacctcgactacgatagctggcagaccgtctacttccaacgtacttctgtcatcgttaccgagcttgttctcgtctgggcgcttcagacctttatcgaaactgctcccctcaagtctcgccgtgctgctcagaccgtcgctctatcaatcattctctccccaggacttctcatcatcgaccatatccacttccagtacaatggcttcatgtacggtattctcgtcatgtctcttgttctcgcgcgccaaaacagtgaactgctgagcagtggactcatctttgccgccctgctctgcttcagcacatctacttgtacctggccccagcctattttgtctatcttctgcgcgcatattgcttgtcatccaagtctatctttcgcattcgatttttgaactcgatcaagctgggcttgggtattggagccatctttggtgcagcctttgggccttttgctgctatggatcagatccctcagctttt

SEQ ID NO: 62764 - DNA, 400 bp, Triticum aestivum
  Clone ID: PAT_TA_62764
acactccataccaaactcccatcaaccgttaacatgcccgaacccgacaacacgctgccgcgcaacaggctgtagatattctccatgagatatctacaattctaaactgccatcttgatcgccgtactctgtctatctgcatctctatgatcgagcgcggtgtgaacccagaggctttggcacaagttatcaaggaacttagacaagagggacagcggatggaacctcctgccgctgctgcaagaagacgttgatgcgcccaaggttaattgaaacggttgacaacggctggacacgagatttatggaaatacggttatgataggcgtttacgagatattgcatttcattttataaccaggcaagttatgtcttcagtctgaatagagagtttagtacac

SEQ ID NO: 62765 - DNA, 772 bp, Triticum aestivum
  Clone ID: PAT_TA_62765
attccttcagcttcatataaggcaatcagcctccagtactcctctgcttcggtgcttgtgtgtgtgcgttatagactgtactagctgcagtgctttggtctatctttcgtatagatcagtacaccactagtagttcgggccaactattggcatcggagccccaggttatgctgaagcatctgccgaaagaacgcatcaccggcgacgtctccaagaccgccgggcagagctcggctgaggaggcgcgtgcggcggatgcgcttgcgctgcgaggcaggctaggaggggagttgggtgcgccacgctccgtgcgagatgtgggcatgtccagcacctccttccctctcctcacgcggaccaactaccccagttggtcggtcatgatgaaagtcatcatggaggcgcggcatatgaggaaagccgtggataccggtgatgtcgagtacgaggaggaccggttggcgatggaggcgatcttgcgctccgtcccaccggagatggtgctcacccttggcgccaaggagacggccaaggaagcatgggacaccatcaagactctacgcatcggcgtggagcgcgtacgggagtcgaaggcccagaccttgtggctccagtatgaggagatccggttcaagaccggtgaacaggtcgacgacttcgccttgcggctgcaagatctcgtcaacaagctcgcaacgctcggcgatcacatcaacaacaagatggtgattctcaagttcctcccgctcgtccccaggcagtacaagcaact

SEQ ID NO: 62766 - DNA, 498 bp, Triticum aestivum
  Clone ID: PAT_TA_62766
acttcaaccacgcaccctcccccccaaaccgttaccactcagccacctgggcttcgctcgccgaccgatggggaggacgctggacgtgctgctgggccgaaccaccaagcagacggcgcgcctcaagtccctcctggggctggccacgaagcggatcgccgtggtgcgcgcccaccgggaggtgcggtgcgcgcaggcgcgggggacgtggagcagctgctgcggcagggccacccggaccgggccctcctccgcgccgagcaggtgatccgggagcgggacacgctcgacgtcctcctcctgctcgacgcctactgcgcgctcctcgccgatttttccgcgctgctcgacgcgcaccgcgactgccccgaggagctgctggaggcggcggcggggctctgctacgcggcggcgcgctgcggggatctgcccgagctgcacgaggcccgcgccctcctcgacgccaagttccgccgcggcttcccgcccgccgccgcc

SEQ ID NO: 62767 - DNA, 708 bp, Triticum aestivum
  Clone ID: PAT_TA_62767
cgttctggatacttagcatgggataacatcatatccaccagagcccaaaaccccacaccacaaacacacggaaacgcacgccgcacggaacccacctagctcgatcgatcaccatgggtcaagctgtctccgccgcttcttcccccttccgccgcaaatcgcagccgccgccggttcctcaggctaccgcccctccagcagcaaaggaccacgacacggagctcgtccgcatcttccgccgctacgacaccgacggggacggccgcatctcggccgcggagatacgcgagatttggggctgcacggacgcggaggcgcaggagatggtcgcctctttctgacagcgacggcgacgggttgatcagcatcgaggagctcggggcgctgctgaagggcgggggctcggaggacttgccggcggcgttcgccaagtttgacgagaacggcgacggggtgatcacccccgatgagctgcgccgagcgtttctccagccgctgctcggccgggagaagcacacgctggaggagtgcaccaggatggtcgccgcgtttgaccaagacggcgacggcgtcctctccttcgacgagttcaagaccatgatggcgcccaagagtgcgtgatctgttcgcgttgcgatctgtctatgcttctccttcgttcatcgatgcgcgtagttaccggcaagtgtatagttggaccagtttttc

SEQ ID NO: 62768 - DNA, 401 bp, Triticum aestivum
  Clone ID: PAT_TA_62768
catctcccaagcaagcacaccagcctcctcagtcctcacagcatcctctcagtccttagcttccttccctcgccgccacccaccaaggaaaggaggatgtcttgctgcggcggcaactgcgggtgccgcgccgagctgcaagtgcgcgcaacggcttgcggacgggtgcaagatgttccccgacgtggaggccaccgccggcgccgccgccatggtcatgcccaccgcctcccacaaggggagctccggcgggttcgagacggccggcgagaccggtggctgcgactgcaccacctgcaattgccgaactgcaagcggatgctccagctgcacttgcaactgacctgccgcccagaatgctcggcgcctgagaccatgacacaggacgaggaggacaggca

SEQ ID NO: 62769 - DNA, 373 bp, Triticum aestivum
  Clone ID: PAT_TA_62769
actcccaaaacactcccggcctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttccacgaggacttcagcctcttcgacacgacggacatgcttgaatcatcactaaagagctgggaacagccatgcgatcaatgaggcaaaacacaacggaggatgaaatccagaacatgatcaatgaagaccacgatgatggacacggaaaccatagacctcccatagttaccccaactgatggaccgcaagacgaaagacactgac

SEQ ID NO: 62770 - DNA, 513 bp, Triticum aestivum
  Clone ID: PAT_TA_62770
agatacaatacgcaatcaccagaccagcagtgttccctctctgtacagtccccgaatcgtctcctcaccaccagcgagagaagtcgatgtggaccccttccacacgaacgcaccgaagaacggcaacatggccgccgccgaccgccatgtgggcaatcacaggaagaattccgtatggcgtggcgacaacggcaggtctccaccaccaccgcatcctcatcgagaacttccatcccaaggactgctacaaggacagcatgagctactgccaccacgtctacctcagggtcgacctcgagaccctcaacgccgagatgctgtgagctcgtggtcccctccgacaaggacaacaagaacagccgcatacataccccgccgagtgctgctcgccgtcgggagactactatgaggtggtcaggcatgctcatcgcggtcaccaacgtccatcggtcgtcaagatccaagatctctaccccgatcctgctacccaagaagaaggcccgacaattcccc

SEQ ID NO: 62771 - DNA, 430 bp, Triticum aestivum
  Clone ID: PAT_TA_62771
agactgcaccacacaagctaatcaagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggtatcaccatgggtaacgccgccaacatccccggcaaatgcggcgtctccgtctctttccccatcaacaccaaagacaactgtaaccaccttca

SEQ ID NO: 62772 - DNA, 327 bp, Triticum aestivum
  Clone ID: PAT_TA_62772
cacttcaatatgcaatcccctctcctccttcattcctccagcgaaaccccaccccgacccaccccaccgtcagcatccatggcgccctttgccgagaagaagccggcggcgaacaagcccgtggaggaggagtccgcggcggagaaggccgagaagaccccggccggcgaagaagcccatggccgagaagcggctgccggcgggcaagttgacggcggcggccaaggagggcggcacggcgaaaaagaatgtcacgaagagcgtggagacgcacaagatctacatcttctcggcgctgaagcctgtgcaactacgacgtcggaatct

SEQ ID NO: 62773 - DNA, 578 bp, Triticum aestivum
  unsure (1)..(578): unsure at all n locations
  Clone ID: PAT_TA_62773
tttcgacggccgctcgagacggncgggccgggaaatcaaaaagggnggggcgncgcctcctttctcctacatagtgcttcgagactcagccatgggtaaggagaagactcacatcaacttcgtgcccattggccatgtcgactccggcaagtcgaccaccactggacatccgatcgacaagcttggaggcattgacaagcgtgtgatcgagaggttcgagaaggaagccgctgagatgaacaagcggtcgttcaagtacgcctgggtgcttgacaagctgaaggtctagcgtgagaggggtatcaccattgatattgccctgtggaagctcgagaccatcaagtactactgcaccgtcatctgatgcccctggtcaccgagacttcatcaagaacatgattactggtacctcccaggttgactgtgctgcgctcatcattgactccacaactgttggatatgacgatgacatctccaaggatggacaaacccgagagcacgccctccttgctttcattcttggagtgaaacagatgatctgctgctgccacaggatggatgccaccactcctaaagta

SEQ ID NO: 62774 - DNA, 378 bp, Triticum aestivum
  Clone ID: PAT_TA_62774
gcggccgccgcttgttccgatgtctgggttcctctccaagccacgtgagaccgcatctgcggacatgggcgttacgatacagtacgtccaggcccgccagaacttcgcacagccgacggctacctcaccgctcgaggttgatgtgtgctgctcaaatggaatcttctcccgggccgctgttcccatcggggcatgaactggggtgtatgacactttggagctgtcggacggaggatctgactattcgtgcccgggtgtttccaaagctgcgatcaacgtgaagtccattattggaaccggttcgtgatgcaaagaccctactactgaaactgagactcacacctttatgcctccgaaaattgatggaacaccgaatga

SEQ ID NO: 62775 - DNA, 643 bp, Triticum aestivum
  Clone ID: PAT_TA_62775
atcctcgaaacatttccaaggacaacattctctcctgatccggatccgccggccgatcgacctttctatggggcgccgctctggaggaggaggaggcggcggcggcttccgcagcgcgccacggcccgcagcccctgcacccaagccggcggccaagcagtcgtccgccccggcgccggccaagaccgacagcagcagcgccccgacctccatcttcggatccatcggctctgccgtcgccgacggggtcgggtggggcgtcgggaccagcatggcgcaccgggccatggattccataatgggcccgcgcaccgtcagggtcgtcgaggagccggcgcccgccgcggacgcgtgcggcatccagaaccaggccttcagcaactgcatctacggcaacgagagcgacatcagcaggtgccagaactacttcgacctgctctgccagtgccgccgcggaggaggagcaggaggagcggccaccatcgcataaaccctacggttatttctagaatatatatcatccagtcagtcgtccgtccttgaataatggagtgaacaagatatctctcatccttgtaacagaacattttatatatcttgtctctgtttccgaattaacaaatttagcattgtttgatgcaac

SEQ ID NO: 62776 - DNA, 561 bp, Triticum aestivum
  Clone ID: PAT_TA_62776
actacaaacaatcctttgttctctaacgctgcgcgcctttgtcttaaaaggcagtattccaagtatccagctatggcagcaagaagcaagaccaagttccttggtgaactactcattctatcccgatttcacaaatacaaccctgtattcaccaccttcgctggaggtacgtacatcctatatcgagatgtgcccagtgcttatggagtatgaggatagcatggtctgcgttgctggctggggctgccgaactttctgatcaagatcggaccatctcaactgcctttgtctttcaacaaacggcattatgtgttctggccgcgtatttgttttgcggcgcaggcatggtctggaacgattggattgatcgcgatattgatgccaaggttgcccgaaccaagcatcgtcccctggccatgggctcggttactacgactgaggccatggtgtggatgaccttgcaggtcatcatgtcttggggtgtgctccgcgtcatgcttgataacaaggatgtgtaagctagcttatcctcgcatccatgctcacagttattatctaagc

SEQ ID NO: 62777 - DNA, 542 bp, Triticum aestivum
  Clone ID: PAT_TA_62777
tgactccactcacacttattgaactataaagatcgtccactcaaccagcagcttatgagaccgcggtcgatggcgaagaccaagggatcgccacgtcgctctcgctgcaagcgcaaccgtcggcgcaacaagagagcgcggcggccgtcgagggaagcagagcctaccccgacgggtccaacaggcgtgcaccacatccccgaccacctcctcgagctcgtgctcctgcgcgtggccacgcccctcgccctcctccgcgccgcgtccacgtgcaagcgctggtgccgcctcatcttcacggacgacgccacgtccccggaccaccggttccgccgctccctccgcgcggcccgcgtccccggccactaccacgtcgacgggaacaaccacgtcttcgtaccggaccccttggcggccgacggcttcgacagacgccaattctccctcgactttctcccggccgtccctcacggctcgctgccctgggagatcgccgatcagccgcggcgggcctcctcctctcctatacgaggcaccccgcc

SEQ ID NO: 62778 - DNA, 541 bp, Triticum aestivum
  Clone ID: PAT_TA_62778
ggtttcgaaaccagagcttcaggcgctggtcttcagtcgcggccaagtgccgttcaagctggtgatcctgtacccgttcgcgcaaagcgtcgctatcgtcctggcactgtcgcccttcgcgaaattcgacattatcaaagcggcactaaactcctccttcgaaagctcccatttgcacgactggtccgagaaatcgcactatcgatgcgtcccgccgacgcgggtttgcgctggcaaagtcaagcgattatggctcttcaagaagccgccgaagcattcatggatcacttattcgaggataccaacctttgcgccatccacgccaagcgcgtcacaattatgcagaaggatattcaattagcaagacggatacgcggtatgtggggtggattgggttaggggaacgcaatatggaaaaagaaaagagcgaaaggaacctggatgggaattggtaagaatttggctttggagtgcgaacggcgttgggcgcttcgagatatacctgctgtcgtattgtttttattcatatattttgcttcgc

SEQ ID NO: 62779 - DNA, 295 bp, Triticum aestivum
  Clone ID: PAT_TA_62779
agtactacataggggccataccacctaatgatcgcgatggtgaatgaagtcggggcgaaaagaaactatagccccgttgggtataacaacgtatcgtctacacgacgccattctttactagggtactgttataggtgctggtattgcatcacagaaaagtgttcattcaactggactacgcaaaggaattggaagggatgttacgaatgggttgtatttggagatcgattggaccggccttgtcgccataacaaataccaaagaatactcactaaatatacataccattgcgccc

SEQ ID NO: 62780 - DNA, 179 bp, Triticum aestivum
  Clone ID: PAT_TA_62780
aattccaaaacagcgtaacctttgtacgatttttctaagctagcgacgcatagcgctatttgcaaagcttgtttgtgtgaaccgaccataatttagaatatgatgatgatgagatcgaagctcgttgcctcggcgatcgcgatgatggcgatcatggcgctcctcgtcgggtagagatt

SEQ ID NO: 62781 - DNA, 215 bp, Triticum aestivum
  Clone ID: PAT_TA_62781
ggttccaccgcgatgctcatcggcgccttcaagaacgagattgtcggcgtctccctctccaccagcgacctctgctccatccggctgcacggcgcaacacgcgccaccgcctgcgatagcgacacatcagatcgttgacgacctccagcatgggctgctcagcacgtgcgggattgacgaggtggtcctgtccccctacccgaccatgccgtatt

SEQ ID NO: 62782 - DNA, 441 bp, Triticum aestivum
  Clone ID: PAT_TA_62782
ggccgggccgggcctcacgtctcctctttcttgctccgctccttctcgaacccaccgcataccggagccacgctggtctgccgccgccctgaatccccccctccttccctccaagcctctaggccataaccagtcgcgccgccgccgcggtcgaggggctagtctgcgccggcgaccaccggagaggaggagggacgttctcgagccgtacgccgacgccggtggccactccgtattataagctcaagtgcatgatttgcatacacatctttggagaacctgttgctgtcatgcagattgaatgacaaacttcactcctgccgcagcagccccgctgaaccaaaaatggcggccctgccactggccacggcggaggcgtgcgacgcgtacgcgcgtatgatcaccagcggcgagctccgcgcgctgcagcccgtctcccgc

SEQ ID NO: 62783 - DNA, 650 bp, Triticum aestivum
  Clone ID: PAT_TA_62783
atttcactacaccgagttggctatacgatcgatgcaccatgaacccgtccatcgtcaccgtcgccgccgccctcgtcgccatggtgcgggtcgggccggaggagctggccagccggctctcggaggtccggccggtgcacctcttcttggcctgcttccttccggccgcggcgaccgtcgtgtacctcatgctgcgtccccgcgcggtgtacctcgtcgactacgctggcttccgcaccccgcacacctgccgcatccccttcgccagcttcctggagcacgccaagctggtgccccagctaaacgagcgcagcatccggttcatgacgcggctgctggagcgctccgggctcggggaggagacctgcctgccgccggcgcaccactacatcggcacgcacaagtactgcaccgtcgacgccgcccgcgccgagttcgagctcgtcgccttctcggccatcgacgacctgctcgccaagaccggcatcgcccccgaggccatcgacatactcatcgtcaactgcagcctgttctgccccacgccgtccctggtcgacatgatccgtgaacaagtacaagctgcggagcgacaatccgcagcatgcacctctccggcatggggtgcagcgcgggcgttcccgccctggggt

SEQ ID NO: 62784 - DNA, 673 bp, Triticum aestivum
  Clone ID: PAT_TA_62784
cggccgctcaggcggcgggcgggattcagaagcatcttggtctgttggttgtcttggtaggtcctcatcccagcaatgctggttcgaatcccgtccccgttgatttacgtatcaacgcaaggaacgcacttggcccgttctcagccgccgccacgtgctgcgctttggacactccctttgattttatctcttgttcttttccctccttcacgacaaacgtcttttcacgatactcaagatacccccaagaaccttccttcacaatgtctgacactgtctaccccgaagtcctctgggctcagagatcttccgacgctgatgtttccaagaacttcatctacctcaccatctccgtccctgatgtgtccaaggacaacattagcctcgaccttcagcctaccaagctcaacttcactggtacctcatccactctcaagaagaagtaccatgccgagcttgagctctggggcgagatcgaccccgcagagagcaagatcaaccacacttccaagaacgatgaaataaagctacagaagaaggagctcaaggaagagtactagcccagactactcaaggactccaagcgcgtccacttcctcaagacagacttcgacaagtgggccgatgaggatgagcagaacgaggcccctgaggacgacttctctcagttcgg

SEQ ID NO: 62785 - DNA, 493 bp, Triticum aestivum
  Clone ID: PAT_TA_62785
cacaagaagcgcacttttacctccggaggcagcccgagctctttctcttctcagctgaagctgtccgcctctgccgtgcgcgagataccacgtcgggacgacaatggcggccgcgacggcgaacgtggcagtgctgctcctgttggtcatccatgtcctcggcgtcgtcgtcggcgcagcgaggccattggagagagatcacgggtggaccgggaacgggatcgaaatggtgacggagatgctcagcgccgctaagtcacggtccagcacccgcacgcactgctgctgacgtgcatgcacaagttactcctgtaaaactgctctttggctcaatatatataccgcggatcacaggtcaaaagaacaggatgcatcaaaccttgaaaatggaaacatgatcgagcttctgctcttctcgcattcctatcgcgattcgtggaacgcatagctaagcctatccccttttgtaatattaaaaccagaagtgtgaata

SEQ ID NO: 62786 - DNA, 434 bp, Triticum aestivum
  Clone ID: PAT_TA_62786
cggccgctcaggcggcgggcgggattccatcgacggccccaagcaacacacgaaattaagcaagcgcacacacacgccagcatggctgccaccatgaagctgacaatcaccttcctcctcctcgtctccgggctggtggtgttcggcgacgccaagaaggcgccgtgcgccgtggtgtgcgtccagggagggcacatcacctgcgacaactaccccgggcagaagctcgacgggtgcgactgccagtgcgcgcccaaggacggcaagggctgcgtgctccacctcaacagcggctccaccaaccagtgcaccaccacgccggagtactgagatgaattacatgcgttcgtcattgctggcttgagaccgttcaatgaagctgcaagtgtgtcgtggaataagtaaagtataatgtaagcttgtgtcagtggaat

SEQ ID NO: 62787 - DNA, 597 bp, Triticum aestivum
  unsure (1)..(597): unsure at all n locations
  Clone ID: PAT_TA_62787
atttccaaaatgaagacgacctacctcaacagactcgtgcatacatactactcctatacatcaattcaacacaattggatatgtatgtcaaccatcgtggagtcccatccactgttgatcctcaagcaaaaacggntactagacgactaacgcctaccccgtcttaatagcgcagaccaaccactgataaccagcgtcgctacccttaaaaactctgatgccaaaggtgctgactccaacgactttaacgagacagctgcctatgccgacgtcggtcacatccacgacaagtccgagatcgtcagagtggccatgaacgagctctatctcaacgaggacatcatcaagaactagctgaagtacgaatgggacaagcccactcttatcgatgtatacatcatagagcccaggctaccatcttctatgtaccaatggtatcatccacaccatccatgccaacgtatcacaagaggacagcgnaaaagcatgggtcgtactacctcaatgtctccaaccctaaggagatcctaatatggtaatatgaggtaaccaccaataacagcgcctccttttccaaccttaatattgatcctgact

SEQ ID NO: 62788 - DNA, 320 bp, Triticum aestivum
  Clone ID: PAT_TA_62788
agtccagaaagaggccgctccgaagaattacccccacctttctccgcccttctcccccgtgacaccacaccagagagagagagagagagagatggcgatgcgggtgccggcggcggtggcggcgctgctgctggcgcccagcgcgctggcggcgggcgcggcgcgcactcgccgcgtacgtcggcgtgcgcgtacaacctgacgggctgcgccggctacatgcacggaacggacgcgcccaagccgccgcagacctgctgcggcccgatcccgaaccccgtgaacaaccaaacggactgcctccgcgcgcccccacgcct

SEQ ID NO: 62789 - DNA, 429 bp, Triticum aestivum
  unsure (1)..(429): unsure at all n locations
  Clone ID: PAT_TA_62789
aatgcatcaagattttntgggtcctcatggcagtctttacgaagaacagcgttgttgccgtgtgcttgggggctctcatgctcatgaccacccttctctcctcggaaggttcagagcttgttggatgtttggagccccaccagaactgcttcccagatgactgccagaggacatgcgcggacaatattattggaaaaaatgtgacaggttcctgcgaaccggagcatggcccgctaaaaccgtatcccgcgctagtgtgttgttgctatagagacggtctccgatcatgataaacatggcgcttaattagtccacttcgggagtgagaccatcagttcgatccacctgttgtattgaatatctttgaggaaaatgagattagcaaagtcgtgagccacgacaaaaagtatatgttataattattgagag

SEQ ID NO: 62790 - DNA, 189 bp, Triticum aestivum
  Clone ID: PAT_TA_62790
ccgtactacaaccggcgcaaccgctgtggcgctggccagctgccgtacgagctcatggcgccgccgcccgggccgggcatcacctcgccgaggtgtcccgaacagcgtcaccatctagtccgcagagaggaaatacacgggaccgtgggaatttttccgcctcgatatactttgcacagacaactgctc

SEQ ID NO: 62791 - DNA, 440 bp, Triticum aestivum
  Clone ID: PAT_TA_62791
ttttcgtcagtcacctccttcctggccttctcgtccccaatcaccttgcaagctgactcatcggtgtctttcttgagatacagaaacgcgaatccaccggatgacgcagccgcggatacagcggcgccaccgacggcgaggttcctccaggagtggagaaagcgtgccggcctccccgcagccgatcctcgggtccccagcgcttgtgcgtgcgcgcgtggcgagaacctccgtgtgaggagcgaaccgagggcccggagagacatggttgcgaccgccccactcttcgatttccgtttccctcgtctccgccgcggcagccgcctcgcctcgattctaaggcttggcggaccttcgctcgtgtctaagttttgtagtactattgcattgcggtgcatgtcaacgtcaggtgagggccttgtttcaaggtactttgggct

SEQ ID NO: 62792 - DNA, 176 bp, Triticum aestivum
  Clone ID: PAT_TA_62792
ccgctcgcagccggccgggccgggcaatacaacacagggaactcaccaccccacgcctaccgaccaagaccgccaaaacgggccgcgtccggaccaagaccgtcaagaagaccgccaagggcatccttgagcgataccaccccagacggaccccggactccgagacgaacacgggc

SEQ ID NO: 62793 - DNA, 643 bp, Triticum aestivum
  unsure (1)..(643): unsure at all n locations
  Clone ID: PAT_TA_62793
aaatccaaatcagttcnaatcaagcactcacatgtccaacaccaaaataacatcatcatgcactttcccaccatcttcgccggcgtcgctgccttctcctcggccgtcatggctgctcctcccaagcagaagccttacgtcggagtcgccatcatgactgtcaacgcacccatcagcggtgaagagagcactcttccccagaacgtcccacttggcgtcctcacccaccaggacggtgtccaagtcaccgagctccagatcgccaatgttttctcgactgttaagggtgtcaaggccccggccgcggatcaggtcgtttgtcagatgtacaaggaccagtatgccactcttcccggcagggcggagtttactgtcaagaaggacgcaaagatcagcacaaactcggttcccctcggctggattctttgccgtgtcaaggcttcttcttaaattggaggagcgtagtgacatatgatgaatatggagggttgcttcgacggatggataaggtggatgaaaggcttctagggccgggttttccccaagtgttcacttcgaccattcaggctatacaacaagcaatgatgtacatacaataacacacatttattctcttggaaaaaaaaaanaaanannanaagaa

SEQ ID NO: 62794 - DNA, 583 bp, Triticum aestivum
  Clone ID: PAT_TA_62794
aattcatcaaatgtgctcatcatcatccccgattccaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggtt

SEQ ID NO: 62795 - DNA, 466 bp, Triticum aestivum
  unsure (1)..(466): unsure at all n locations
  Clone ID: PAT_TA_62795
acgtcgtaaacagangtccaacctggacgatttctcattnggacctgggacaagtgggaaaaagtccatttcgacctttcccaccaccatcagccctagtgacatccagacttgtaggtgaggggtaaccagactacgcatgctgctattttcaacccagttctggtggtgtttcaaccagttcctaaataatcctgcattcctactgggccaagacctgttgaagctaagagaatcacgaccagtagctttgttttctcaccactcgaccaattgttcacaaggaattcccccccaacagacggattcgagtccaaccggacgtcatcgcgagtgttgactttgagaagtctcaaggggtccgaccgccagatgcatgcacgtaaagggaggtggaattgtgatttctcctggctttattgtaattatgttgttatttatttaacaaagacatttcttctttttc

SEQ ID NO: 62796 - DNA, 379 bp, Triticum aestivum
  Clone ID: PAT_TA_62796
aaattcactagaagtgtctcaaagaatcttatttgaaccattataaactccaacaattactcttccaaagcaatacaatggctcccaactccaagcgtcgcttttctctcagcgccctctctcccgcaagcaagagatacaacaaagtcatgaatgaacgatcggataatcgtcgatctgtcgacagtacagcaagtcgctctacactgggtgggatgccagtggttgacgttgagaatcacctcattgatcctgcgtatcgctggactactgcgaatcgcaactgaagaaaagagaattgtattatatgtaaattaccgattataccaagggtggaaagttctgtatattagtctgttagggcaatttatacatcatt

SEQ ID NO: 62797 - DNA, 647 bp, Triticum aestivum
  unsure (1)..(647): unsure at all n locations
  Clone ID: PAT_TA_62797
ccgcccgccttttcccccgcacagccgcaggnagagaaggcaaggaggaagggaagatgccggcggggcacgggctgcggncgcggacgcgcgacctggtcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggtgcgtggtgaggtcatcagcaccaagaggcagccagcaggccccaagtctgggttcatggtggagggcaccaccatcgagacggacacccccatcccgtacgacgtcgtcaacgatctcaagggtggttactagagcgcttgttgtttccctgagccaagcttgaagccagttcctagcatctatgcttgttcccaatgcttctggtactgagaaggtccctttttgctc

SEQ ID NO: 62798 - DNA, 703 bp, Triticum aestivum
  Clone ID: PAT_TA_62798
gcctacaattaaaggcgcgggcgaaaccgacgctcgactgaagagccttccgtgagactatgtccatttttccgcgatctagcgctatggccacgattggtgcgcgagatggtgttaaatggcttagcggtcggggtcgttccaatttcccgggaatggctcatttcaccgggccgaagcagggggccagacaaatctcaacccaaatttgctccgataggccaactcgccaaggaaacctagctttgttctatccccattcccttctctccctcccatccgaaaagattgtggcagctcggcggcttggcacagctgtgctcggcgggccggcggttgtttcgcagcaagccgaaggcagcgacgggcgaagcggcaagacggcgaccagggccccgggcagcaggctgcgacccacaaccaggggcctctgcaccacgatgtcgtctcagccggttccaactcccagtctatcaacagcaggtagaacacgtacctccatggccgacaacatggtctccggtgagagcgaggtggtgtgcgtcgacttctgggccaacctgttcggcatgcgggttctgatcgcgctgcgcgagctgggcgtgtcgttcgagtacatcgaggaggacctcggcacccgcgagaggagcgacctggtgctgcgcatgaacccggtgcaccggatggtgcccatcctcatcca

SEQ ID NO: 62799 - DNA, 334 bp, Triticum aestivum
  Clone ID: PAT_TA_62799
ctgaacaaccgatcaaccgatcacgatgagaccgccggaggagaagacgacgaggccggaggaggcggggctgcccgccgaggaggccaaggcgatcatcctccgcgacaagcctggcgctgacatcatcgtccttcccgacggctccagcagcgacacgcaattcatcgccaaccgcgtccgcatcttcgtcaacggcaccaccgccgccgagactcccattgctggctagctctagatcataactagccttgcttgtcgctgatggatcgatgcaagtatgcatatgttaccggctcgacaagtccaataaataaccatgggaattagcacc

SEQ ID NO: 62800 - DNA, 707 bp, Triticum aestivum
  unsure (1)..(707): unsure at all n locations
  Clone ID: PAT_TA_62800
cggccggggcgggcggtgccatacttgctccacctccttcaggctttgaccagatcacagctctccagttactaccagccatggctgccaagaccacctcatgcttcaccttcctcaaggaagcgctggtcctccccacgcgaaaccccaagctcttcgcccccatcctcatctttgtggccgccatcgccttcctcatccccgcggtcaacgtggtcttcatccagccgctcaccgccgagatgctgcaccacgtcgccgagatgcagaccaccgacccctcgagcgccgagtacgccaaacaaagcatcagaatacctactgctcgcacatagacgacacacgttacacgtacgtgcgaagctgcggcgtatttcttctttacctgcttcccagtcaaaagagagaaagaatggcggccaggctcaaagcgggagcaccggcgggcgctctcctcgtggtggcgtgcctggttctcgcgacggcggcggccgtgagtggcgcgaggccgctcgcggcgcgggaggaaggcggcactgcgcgtgcggtgatggtggaatcgccggcgggcgatgcaatccagacggtggcgagggccgtcgagcgcaggttaatgttcgacgtcggcatgctcctcgggatcaaggactcagggcccagccccggcgncgggcattaagcgccggacatgccatgccatgccacgg

SEQ ID NO: 62801 - DNA, 571 bp, Triticum aestivum
  Clone ID: PAT_TA_62801
atttcttatcggccttttggctaagatcaagtgtagtatctgttcttatcagtttaatatctgatattgggccatgtgtccataacgatattaaatttattttttgtgggggagggtccaccacagtggcttgccactggggccctcaggtgtcgcccagtgcgttgcactgctgcctgggctggcgtaccccaaccaaattaattaaacttttttgttaaattcagccggaattaagtgttaattgaagctgctgacagccgagtacgcggagcggcttgatcttcctcattgccgtgtcgatctgctcgtccgcgtcgtacaggttggtcaccagcgcctgagcgacactgctcgtccgcgtcgtacaggttggtcaccagcgcctgagtcgagaaacaggctggtgttggtgctcctcggagaagtccgtgccggggtggtgtatttgaagaactgagtaggttgataggctaattcctaaagctgagtggtgtatccccctattttctcattatattttgatccatcaaactgatgaatcataaaaaaaaaaaaaaaaaaggcccct

SEQ ID NO: 62802 - DNA, 517 bp, Triticum aestivum
  Clone ID: PAT_TA_62802
caggattcacaagagcggtcggtggtggtcttgtaacgtcgctggtaccgttgagtctctagacaccctcgtggccaagatcaccggcggtgctaccatcgctgagattgccgccgaggtcaagaaggaggtcgaaggcctcactgatgctgctcagaagacctacgccgagtactatgttcgtgtctttgacaagctgagctccaacaacgactgggtctccaaggagcttggtcgcctggatggtattcttgccaagggcggtttggctccttcaaagcgcgaccagatccagcagaagaccaatgtccttcgcaagtttgtgctgaagaaggccgatgagaaagtcgagcaggttaaggagaaggtcgaggaagtcaaggacgagttgtaaagcatcaagtataacaacacgacgacataacaaatatagcaagtacagaaccacagatctcgtatgtagttgattcttgggttacttgaagtaacgatataatgaaaataccgtaacaagcag

SEQ ID NO: 62803 - DNA, 412 bp, Triticum aestivum
  Clone ID: PAT_TA_62803
ttgactttacctgcatgtcagaaatctgcgctcccattacgccccccccccccccaccctcaacgactctgcgacggtataccctgttatgctgaaggaccaggggacccctgctataacaatctccggcgcctgctctctatctgtgccgtgactgatcgatccgatgagggtgatccccttaggctggagattaaccacgtgatacgacaatgaccgcgacaagtcggataccacggaccgcacctggacgcgctacctcgacctgttcatggagactactcgcctccgaggacaattgaaaatgtccactgcatctagaaagatgtactgttcacatctgccaacgtccgattcacctcgtccgcgtgaagtgtaaccacacatcctgaaggcatggtaaactgcattc

SEQ ID NO: 62804 - DNA, 594 bp, Triticum aestivum
  Clone ID: PAT_TA_62804
cggccgctcaggcggcgggcgggatttctcgataagacctttgccctccgccatgaaagtgcagagtcccagcgcatccaaagactaccctcggcacgcgctaggccggcagcacggacgcctcagccacattagaccggttccagacgacagcctgcacggcgtggagactggagcggacctccgtcgtggcacaggcacgcggcgcccgagcactcttggtcggcatcaaggaggcgacgggaggcacggcgccctccggcatggctgctagtagacacgaccactcccgcggcatcaggccctcagccacggcacacggcaggcgacacgctccaacggcgccctccggcgcgcagtaatggccgacgcggcaggccctccggccggtggcggtgtaaaatccctagccacacggcagaaattggggatttcttatctctttgatgaatttgtaattgaacccccaggttatgtgataatcccatataagtcgttatgttctatgttcagccatcaggttaacaaaactttgtggtttaaccctcagttcatcccaaattacatacaacataattatacaccattttacag

SEQ ID NO: 62805 - DNA, 560 bp, Triticum aestivum
  unsure (1)..(560): unsure at all n locations
  Clone ID: PAT_TA_62805
ccgctcgaggcncggcgggccgggaactactacaagaggacgaacgtttggccgtctactctctccatctgcctcttattgtataagtcttgttactcataaccctcgcttcaaaccgacactatggctcgtggaaaccagcgcgaaaaggctcgtgaaaagaaccttaagaagacagagaagaccaagactaccatgagcggtacccagatgcaacacgccaaggagtccaacgccgatataatgcgaaagaagcaagctgctgctgaggctcgcaaggccgctgatggcaagaaataaacgctgcaatctcttgtacgaacactgtcctctctggcttgacaaacaacatcgattacatgtacgaactgccacaatttgaagagatggaataagggccaccgaggaaccggaaacgttcgataccatacattcctttcagcggcgcaacgaaacgatttttgggtagcacaagcgaagcggtgcaataatatgggttgtctttcagaaacgattactatgactatagcctcatcaatacatctttgtgatgatgttcg

SEQ ID NO: 62806 - DNA, 526 bp, Triticum aestivum
  unsure (1)..(526): unsure at all n locations
  Clone ID: PAT_TA_62806
cccccccgcggcgcagcaacagagaganggcggcggaggcgacgacgacggcgcaccgcgggagccaggcggagggcgcgcaggccgacgccgcgcagaggcagccgagacaccacgcgcgcgcgacggaagcgggaaacaacggagcagaaacccaccccgaggaccagcaagaaaaaaccaagcaagccgcgcgggaacaaacccgacaccgcccccgagaacaaggacgcagggaccagaggacgacgacgacgatgacgaggacgaggacgaagaaaccggagacgctgacgaagacgacgccgacgccggggaggacttcacggcagaagaaggcgaggacgacgacgaggacgaggaccccgaggcgaacggcgacgacgccggcgcggggagcgacgacgacgacggcgaagacgacgacgaagacggcgaagacggcgaggcaccacgacgacgacgccgaggacgacgacgaggaggaagaggaaaaagaggaccagcccccgggcaagaagaagaa

SEQ ID NO: 62807 - DNA, 750 bp, Triticum aestivum
  unsure (1)..(750): unsure at all n locations
  Clone ID: PAT_TA_62807
gcatgcacacagagnccgtgcagaaagctcagttacatctacagggcggcagccatggcgtccagagcagcagcggccgtcctcgtccttgcagccttgatctgcgccgcacattcgtcggcggcggcagaggggctttcgcggagcttccacgcggcgtcgtgcccggagctggaggagatcgcgggaacgctcgtggcggagaccttccggcgcgacgtcggcgtcgccccggccctcatccgcatcctcttccacgactgcttcccgcagggctgcgacgcctcggtgctcctcaccgggaacaacactgagctgaatgcggtgcccaaccagacgctccgccccgttgctcttgacctcatcgagcgcatccgcgccgcggtccaccgcgcctgcggcccgaccgtctcctgcgccgacatcaccatcctcgccacccgtgacgccctcgtgcaggctggcgggccccacttcgacgtcgccttcggccgacgcgacgcgctcgccccggcatcgcaggacctcgtggacaccctgccggcgccctccttcgacgtgccgaccctcatctcctccttcggcaaccggagcctcgacgtggcggaccttgtcgccctctccggcgcgcacacatttggcgtcgcccactgtccctccttctccgaccgcttcactccgaacatcgacttcaacccgctcatcgacccgttattcgccaggaggctgcgggtcaagtgcgccaaggat

SEQ ID NO: 62808 - DNA, 127 bp, Triticum aestivum
  Clone ID: PAT_TA_62808
agatcaaagaagtgcgcttgacgccactcctatcctgctcactgcttggttagcacacgtcctagcttcggttgtaattctgcatgcataaataggcacccgatcaatggaaaagttgtgttcaacc

SEQ ID NO: 62809 - DNA, 530 bp, Triticum aestivum
  unsure (1)..(530): unsure at all n locations
  Clone ID: PAT_TA_62809
cggccgctcaggcggcgggcgggaatcggatgagagggcgtcttcgnactcgtctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattagcaaggagattgctgatcatctgcctagaccgtatcaggaagctttcagaccactgcactgg

SEQ ID NO: 62810 - DNA, 815 bp, Triticum aestivum
  Clone ID: PAT_TA_62810
ggccgggccgggcctccatatacgggctctacggcctcggcgatctcccccagggttttgcccgcctgtctgccatctacggtggcacttacatgcttaacaccaacatcgacgagatccagtacgatggcgacaaggctgttggcatcaaggctaccatgaccggtgtcgaggagatgaagttcgagaccaaggccaagatgatcctcggtgacccctcttacttccccaacaaggccaaggttgttggacacgttctccgagccatctgcatcctcaagcaccctctcgctggcaccaacgatgccgactctgcccagctcatcattccccaatctcaagttggcagaaagaacgacatatacatcgcctgtgtttcttccgctcacaacgtctgccctaagggttactggatcgctatcgtctcaaccattgctgagaccacagctaaccaccatgtcgagctccaggctggtctggagcgccttggcaagatcgaggagcagttcatgggccctcccattcccgtctacgaacctcttgaggatggttccaaggacaacatcttcatctccaagagctacgatgctaccagtcactttgagacaaacacagacgatgtcaaggatatctaccgccgcgccactggcgaggagctcaaggttgagggtttgagggaaggtatctaggttgctgaggagcagtaagagtctcgcgaccaggaagcagggtaaagaggaataaggtcacaccactgctgcagagccagtagggtcggaggattgctttgatattttttgattgacccattgtta

SEQ ID NO: 62811 - DNA, 621 bp, Triticum aestivum
  Clone ID: PAT_TA_62811
gattcaaaagagagggagacgctgggcgggttcctggcggcgtcggcgttcgtcgtcttcgtgacctccgtcgggtccatcgtcttctccgccctcgcggccggcgccgcgctcgcctgcgcgcacggcgcgttccgggtgcccgaggaacagctcttcctcgacgacgacctgcagcctggcgctggcggaagagcgggctcctccgtcgacctgctctccttcttcaccaacgccgccggaggaggaggcgggcgcggctgaggcgccccacgtcattccgtcgactgattcattcttgagaaatacttcatcggttctaaattacttgtcgaaggaattgatgtatctagacgtattttaattctagatacatctaactttatccttttgcgacaactaattccgaaccgagcgagcatacgggacaccatatgtgttgctagttagctacacctacgtacactaaatgaattttttaattacatttaggattttatacgattcaaaagatttttataggaaatttggagaaacaaaatatttatgaattatttctctgtggattgtttgatacctagaattgaattatatatgatatttttctaagaatttatttgt

SEQ ID NO: 62812 - DNA, 735 bp, Triticum aestivum
  Clone ID: PAT_TA_62812
ccatcccattatccgtctcctagtccacacacttgccacagagcagctagctgctttgttttttcatcgtgcgcgacgtcggcgatggaggctggtggtgctgccggtggccgtcaacccctcgttgttattgttgttgccggagcaggtgcggcgacggtgcagatccgtgcggtggcgtgtgtgcatctcgtcctcggcttggcaggggcgaccttcgccctctgtgtcaccaccctccacccccagataaagcagcagggggctgcctgcgctgccaccgaggacgaggagaacgcggtggccatgcgcacccacgggctgctgctgctgctctccgccggcacccaggcagcagcggccacggtagctgctttggcgccggtctcctggaggccttcgcccaggatttttgcggccttcgcccacgccgtcagcatcctcacctacttccacttcattaacgccttcgtcgccggcgccttcggcagctaccctgtgcgcgtgcaagccgacagtgccgagttcatcgcccactacggcctgctcatcgtgcctctctgcgtcttctttggcatcggcgtccgcgcactcgtcgagccttgatgccatccctgatccatgccgagcgagcatgaccgcgacctatatatgctatggagtcacgtactctagtcttgccatcttaatatctattggctagtggttgattaatgtggcacctattatggttat

SEQ ID NO: 62813 - DNA, 565 bp, Triticum aestivum
  Clone ID: PAT_TA_62813
gctacaaagagaggagatttgtccctacgtacgcacgcacacaaagcatccattcgtccctcggttcctaagacagcagagtttgttcgtgttagttgatcgatcgacggttgttcctttcgtcgccgacatgcagcggagcaactcgttcgggacgtcgtgggcggaccagtgggacaccggcgccgacccgagcccgcgggcgcgcggcggcaacggcgacggccagaagggcggcgtagagaagaccaaggcggccgcggccaccgggctgaggaaggtcaaggccggcaccgcgcaggggttccagtggatcaaggacaagtaccagaagaagagcgccggcaagaacggcaagcaggggggcggctccgaggtggcggccgggtactgaccgatgatccgagacgtttccttcgtgcgtgtggatatatatggagtactagtcatggaccgatgatgttcttgttttagtgttgcggctacggactgcttagcttgctctgtttttagcctttctcatcatgtacataaatgaaggatttgatttttgttctggttcttc

SEQ ID NO: 62814 - DNA, 593 bp, Triticum aestivum
  Clone ID: PAT_TA_62814
tcaatctccatctccttttcgtagcagcagcagcacccctccttgccgacgaccccccagccccgatggcccgcacgaagcagacggcgcgcaagtccaccggcggcaaggcaccgaggaagcagctggcgaccaaggcggcgcgcaagtccgccccggccaccggcggcgtgaagaagccccaccgcttccgcccgggcaccgtcgccctccgtgagatccgcaagtaccagaagagcacggagctgctcatccgcaagctccccttccagcgcctcgtccgggaggtcgctcaggacttcaagaccgacctccgcttccagtcctccgccgtctccgccctgcaggaggccgccgaggcgtacctcgtcgggctcttcgaggacaccaacctctgcgccatccacgccaagcgcgtcaccatcatgcccaaggacatccagctcgcgcgccgcatccgcggagagcgcgcctaggctctgcacgcgccccgtccgccgcgcttggttgctagctgctttatgactctgtagttgcttgccctccttgtatgtcctgtggatgccatcgaatgttcaaatctctgggttgat

SEQ ID NO: 62815 - DNA, 586 bp, Triticum aestivum
  unsure (1)..(586): unsure at all n locations
  Clone ID: PAT_TA_62815
tgtcggccgctcgagccggccggccggngactccacaaagtgctcatctcatcccctttccaagcccatcttcttctccttgaaatctttttgggttcacagatttggaggatgtcttgcaactgtggatccggttgcagctgcggctcagactgcaagtgcgggaagatgtaccctgatctgacagagcaaggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgcctgtgcgcatgtctccctgtaattgcttcatctatctccactatggatggagtgatgaatatgtaagaatgaaagatttacctaattaact

SEQ ID NO: 62816 - DNA, 466 bp, Triticum aestivum
  Clone ID: PAT_TA_62816
cggccgctcaggcggcgggcggattcagcgggcggctctctcaccacttgtcagagagttcaagtcgcagaagctcaacccaattcgcagcaatggttaggatgctggatcttgccgcggccaagggcttcgccgcgcccggcaatgtcatcggcctcgccttcgtcttcgtggccgtcgtcgccgtggtggccatcgccgtgttcagctgctccgacggggcggacgagtcagacgccaggcgcaaaaagaaacgcagggcccaacccgtcgttattgtttacggtggtggaggctgctaaggaagcgcgtcgtgcacactagccctcctcgcgtgggggcaaatgcgttgcagagtattcttaccattacgttctttaatattacagcaatgtaatgcagcctgttgggacccggtgttttggctcctaggcacagatgcatccattgtcgaaatacacatttc

SEQ ID NO: 62817 - DNA, 186 bp, Triticum aestivum
  Clone ID: PAT_TA_62817
agattcaataacgagatgtaacaaataggctttcgcaaaggagaggaatggtcgggagaaaataaattatataaaatactttgcaagtgccaatggtacttggtgcatcagaccttaaacctaggactgaatctagaatgagaaacacacagtgacgcacatgcgttctaaaatcaccatctctac

SEQ ID NO: 62818 - DNA, 237 bp, Triticum aestivum
  Clone ID: PAT_TA_62818
aattcttgagtgctcatctcctcgacacctagctcatcttcttctccttgaaatctttttgggttctcagatttggaggatgtcttgcaactgtcggatccggtctgcagctgcggctcatactgcaagtgctgcggaaggtgtaccctgatctgacgcgagcagggtggtgccgctgcccgtgcttcccgcgtggtcgtcctcggcgtggcgcctgagaacaaggtaggtcagctc

SEQ ID NO: 62819 - DNA, 842 bp, Triticum aestivum
  Clone ID: PAT_TA_62819
ggccgggccgggagttcaccaacaagcacaaccaacaacaactcttcaacttcactttcaagcctcttcatcttcaagccggcgtttcagcacttaatcaatcaattcatctttactcgactcatctacataagaagtcgattgcctgcaattcaactcatccaaactacttacacattcaatcaaccacacaaacaacaccttcatcatgcccgctcgatctgactacggctccgtctccatgtccatgtccatgtctcccactcctcccaccaacctctcaagctacgctcgcttcatgcacgaccacaccaagcgacagatggaggcttctggcgctagcccttctccctccaacgctactgctcagcgtgcccgttcatccatgaccaacggcaacaccagccccaactactcataagatctcttcacatgagacaaacaaactcaataacgtcaccacataattagagaattcatcatgacttctactattttttgtcgttctgccttggctgatggggcttggagatggcatgacatcaaatgcgacgtcaatggtggcgaagctcatcaacccagcctcctgtccttacacagccaaggtactctcatgaaacagcaacatttacggagtatgggtgcctaaaaaagttcattctcatatgatcttacggcctgcttttttaccaagttctattttctttacaaacacgaaatgcaaggcgtttttgggcctgggatttttgaagctgctaaagcaactttgtacaactagcgagagaaagacataggcacaccagcatcagaggaggaaagacatagctttagctataactgca

SEQ ID NO: 62820 - DNA, 359 bp, Triticum aestivum
  Clone ID: PAT_TA_62820
aacctcataaccgtgccaaagtcattcgttcttctgtgcggcagccagcaagaaacgagtcggcgaccgatcgagtgatagaagaggagggaaaggcaagctagcttgaattaatagtgatgacgggaaggtttgctgccgtgccggtaatgttcctgatgatcttggtgttctttgccgtgtccggcgcggctcgccacctcggcgccgacgtgtgggcgccagccggggaggtcgtccccggcaacggtgtggcggcgcagattctccggcaaatttacttgcagcggctgggggcgggggcctcgtgcggtacccacagcgcaaacgttgtctgcccaccctgacccgagaccccc

SEQ ID NO: 62821 - DNA, 812 bp, Triticum aestivum
  Clone ID: PAT_TA_62821
atttcaatatagctcaccctgagcattctattccactttcatcatcgccatactcgtctcctaccctcacagttcgttgctccgcacatcagcatgacttgcaatggcggtagacggcgagctgaagctgctgggtgtgtggacgagaccgttcgtcatcagggtgcgcgtggtgctcaacctcaagtctctgccgtactattacgtggaggagaacctgggcagcaagagcgcgctcctcctgggttcctaccctgtgcaccagagtgtgcccgtcctcctccacgttggccgacccgtgaacgagtaccagggcatcgtgcagtacatcgacgaggtctgggtgggggccggcccgatcgtgctcgcggacgacccctacgagatgcgtcgcaggcatatttctgctctatggtatccgtagtgatctcatggattcgaggtgcaagacgatcctcttaatgtggacaccaggagcacgcttagcaaatagaaagacccactacttagtgtcgatgacatgttggtggacttcactctctagtgacatatagtgtgtatttctacatgagtttatatgtatactatactctatagataatttctgaaaataatccaactgagaaggaaatgtcttaagtggaaactgggtctaagggggattcagtatttccagactattgagtagtgtaagtgtcatgacaattattggtcatgatgcagtaattgttggttctagtcaagcaacaattgcactccctatgggtactatgtgggtaatctttgctggatgtatctatattctacccata

SEQ ID NO: 62822 - DNA, 749 bp, Triticum aestivum
  Clone ID: PAT_TA_62822
acttctcgtgagatcaagaatactccgtataaccataaatccggagtctctctgtgtcgacccgcgtgcgacatcaagatcgattaaggcttgtgtcagctggcgtgagaaatcgatccagcaggccgttagcttgcttcctggtcgtacgtgtgctccgccgctagcatgtacgagcccaccatcggaaagtactccacggctgcctcgtcaaggtcgaggcttcgccaacaggcgatcggtggcagcggggccgcgatggcagcagcagccggccccgactccaccgacgagctcatggcagacatcacgaagcgcctcatccgcaccctccagcgcggcggggtcggggtgccttacacgctatttcccgacgaagacttcatgtcacagtcagccaaatacttcggacatgtcatgccgatcaccagcgctcctactacgccagcagtgcaggcattccagcagggagaccccaagaccgagttggagctgcgccacatcgaccgaccagccaaatacaagaccgtcgtcccctgcccgtatggccctgctgcatgcccctcgggtcgccaatgctattggaagcattagagggcgcacgcaactagtttttgttaggtattccaaaccgttgtcctatgcatttttggtgtcgttggatagtctaagtcaggtcatgttgggctaggtcggcaagtattagtagtgtttgatgcttcccatggaggctatgtaatcctatgcca

SEQ ID NO: 62823 - DNA, 740 bp, Triticum aestivum
  Clone ID: PAT_TA_62823
atatgcatccgccagcctcatcaaggtcaattgacgaggttggtctcgacatcagcacggagaataatgtacggagcgtggtcaattgattgaatgatttttgattgactgcagcacacagagtacaccattacgggaacggcgtatccgtcaatagccactgtgggccaagacacgattgcaaggacgactatcgtcatggccacatcacagcctacatgacatccatacaaattggacatccaaatgtgcataaaggaatgcgcaagcaccgttggtggtgactcgatgattactctgcagaattacgcttatcagtcaatttccttcacaacggctgagatggcaacacgttgatcgatatcacgataagcggaggttggctgagttgtggcttggcctcttctctgattgactttcacatgccctcaccaacaccaattcgaagcagagcacagacgaggctgctacagattcgtcgatcaacgcctggtctggaatgccgctaattgtcttactattccaagagacaggcaaagtagtcgacgcgtggtgatagagttgagatatatgcatcggctgcatgtctcacacatacactgtgcggcgcgcatcgcgtctttgaatcctaccaagtactctttacctgtcgtcaagttggtgtttcggaggggggagcaggttagcgtatcggggatagatcgaggaggagctgattccagaatcaccaggccacgcaa

SEQ ID NO: 62824 - DNA, 565 bp, Triticum aestivum
  Clone ID: PAT_TA_62824
acctgcacaacaggctcctcactcctcacagtatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggcgcacaggaggccggccggcagaggcgagcacgaggatgaggaggagaagcaagcaatcatcatcaccaccaccaccacccagcgtatcagtaccactagccgccgcatgcgctcgcgcgcgcgctaaataaaataaaaccgtcatgtgttccttagttctgtacgaccagtgtccctcctcatgcctccacttctaatgaatatatggcgcctcaactttgaacgatcc

SEQ ID NO: 62825 - DNA, 574 bp, Triticum aestivum
  Clone ID: PAT_TA_62825
gacggacctgctgttggcgacgccgtcggcgaagctggaggtgtggctggaggtggagtcgcaccacttctacccggccgtggccgacctggtgtacgagctccgcgtcagaccccggctgccgggcggcgcgccgcccgacccggccgtcgtggacgggctcgcccgcaaggtggccgacgtgctcgacgtctacgacgcgcacctcgccgccgggaacaggtacctcgccggcgacgcgttcacgctcgccgatgtgaaccacatggcgcagctgttcgtcatgagccggacgccccgggcggcggagctggtcgcggccaggccgcacgtgcaggcgtggtgggacgacatctccgcccgccccgcctggaagaagaccgtggccgcgctccccctgccgccggcttgagggcgccggtggcagccccagaaataaaggtctataatgtttttagcaggagcagatgatcgaattccccaggaatgttgtcgatgtgagtgacatactggtctgacatgaacaactgatcatggccggctatgaacgagtaattcaaatcctttgtttggc

SEQ ID NO: 62826 - DNA, 160 bp, Triticum aestivum
  unsure (1)..(160): unsure at all n locations
  Clone ID: PAT_TA_62826
gccgctcgaggcggcncgggccgggagttcctaatcccaaatcaccaaccaaatcccctcccctcctctcccgcggtacgacgagcaccagccaccggacatggacgcctcagccaccggagacggagtgaaggtgaataagggcgcggacgggtgcaag

SEQ ID NO: 62827 - DNA, 678 bp, Triticum aestivum
  Clone ID: PAT_TA_62827
actctcctctgctattctctctttactcatatcgcttcccagaggatcaaaaagaatatatcactgtgtcatttcatatctcgaggcttaccatatatcaagaagccactatgcctcttgttccaagctccgcaccgctgcccggcagtatgactacatttgcttacttgcgtgagcaaaaaatactcaacatcgtctacgtcggccttctcgtggtggaagtccttatggttctgggcgtcatctctgtcgccctcgtcaagagagtcaaagcccaccgacgacccaaagcgattcgaccagtcacacctttaacaaactatccgcctcaccaatatatgcacttcggaaacgagaagccaaccaaatcatgacgacttgaaagaatatgcgacaaggagagaaagacgcccaaaaagttggcggttgatcaaactcaaacaacgacatcactacattttattcctttgttcacgacaccacattcagtttgaaaggagcctcattcactgttttccagccagaaacaaaagggggacggacgttcggttgttcatgatttacgcatggtttcagtatgcacaatgcgtttgttcacttggagcgggatatgatgatttacgactatatatacccagatcttttttttagctaatgcaatttactttttattttttc

SEQ ID NO: 62828 - DNA, 578 bp, Triticum aestivum
  Clone ID: PAT_TA_62828
aactccaacaacagcctcctcactcctcacattatcctctcagtccttagcttccttccctcgccaccacccacagccaaggaggatgtcttgctgcggcggcaactgcgggtgcggcgccggctgcaagtgcggcaatggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggcgcacaggaggccggccggcagaggcgagcacgaggatgaggaggagaagcaagcaatcatcatcaccaccaccaccacccagcgtatcagtaccactagccgccgcatgcgctcgcgcgcgcgctaaataaaataaaaccgtcatgtgttccttagttctgtacgaccagtgtccctcctcatgcctccacttctaatgaatatatggcgcctccactttgaacaacaaaaaaaaaataaa

SEQ ID NO: 62829 - DNA, 586 bp, Triticum aestivum
  Clone ID: PAT_TA_62829
acttcccataatagcttttccccacggatacttctcgtcttcatctagattctagcaggctcgcatctctccgtcagccctgacatggactcacgtaggctgctgcacggaaccccgcaactgcttgctgctcagcatgaaggacagcaacatggaaacgctgctaagcctgctaataccgggagccttactctcccgaagaacagcctgcgagagaatatctgacaaccgcacacgactgtaggctggattccagaggaagctcaccgagaccaccgatgactgtgatgcaaactccacccgccttgacaagaacactaacgtctagattgagcacatccagcagcgcgcagcacacatctctccagaggcgattgctatgcttcctgacgcacgtcaccactgtgatgaactaaatgttgatgagccaaccctgcctatgatggcaactccgtactatctgctccttcctttggaaggtatcatagtaaatggcttttgccacttcaacctgtaattccttgtcgtcttggaaataagctgctaccgttcagcagaaggcatggatgatactacttgctaaacc

SEQ ID NO: 62830 - DNA, 570 bp, Triticum aestivum
  Clone ID: PAT_TA_62830
aaattctcacatccgacgaattgtagcccatgttccggctgtctggtctttggagaacttcgcgtccaagctatcgcaacatgcctggtcgcttccccgatgaagagtccggctcgggcgagtccgagtcactccttggccgaggtcacaagagagttaagcgcttctgggatggattcgtcgactttgctttccaggatgacattctcaagattgccgttggtttgattcttgcggctgccttcaccgacttggtaaagtcatttgtgagcgatgtgctcatgccgcccatttcaattatcttgccattgaacaagaacatagaggagaagtttgccgttctgcaaaggggacccaattacaacacaaccacaggctacaacacattgcaccaagcacaagatgacggtgctgttgtcctagcttatggatcgtttgtcagtcaaatgatatccttccttgtactgggtatcgccttgtatggactcgcccacttgtggcagcttgcctcgtccgagtccatcgtcaagcatactaagaagcgcaagcattgcagacaacctatcaacg

SEQ ID NO: 62831 - DNA, 424 bp, Triticum aestivum
  unsure (1)..(424): unsure at all n locations
  Clone ID: PAT_TA_62831
ccggtccgctcgaagccggnctggacggggcctacacaaacggggcaccccaactccaacctttacctcaaccaaatccaaactcccaacaaccatgagcgacgacgagcgatcccgtgtcgtgaccctagaacacggtgccacagagatgaccgagtgctggcgcttacggcaccgagctgcctcgacgcagtgccacgcctgactctgccgtgacactcattcgtgacactgccgataccgcactctggcataccgctcactctcgtacacgtgccgcccactgtacgcgcacggcagcctggcccgtgcggcgcacgccgatccgccgaggcccgtaccgcctcagagcgccgcgcgaggcatctccctcgcagcgcaggaccatccttcgatcaccctccaacgctcggcgagtccccac

SEQ ID NO: 62832 - DNA, 511 bp, Triticum aestivum
  Clone ID: PAT_TA_62832
aatttcggaaagcagcctcaagtagtactccgttctgagtaaatgtgtgtgtgcgttttatagactgcactagctgcagtgcttcagtcaatccaatatggtttgtactataaatcagtacaccactagtagtttgggctaacaaatagcttacaaactgtgtgatcccctgtaacttgtcatgcctgttggagttaaacacgaatacgtaaaaaaaaaaaaaaaaaaaaaaaaaaaaaaaaaaaaaaaaaaaaaaaacaaatcacaaaataaccaaggaaaaccaaaaagaaaaaaaaattccattctcagtttccagggtaaaccaggagtgcacaccaaggcagactacgagggggtcgtcggggggcctgcccacttcctcaactttacgggtgagctctccgggggggcccacccctccctaaaatttggggtgagattccaggatggccccccccgaaaaaaaaaaaaggggttccacccccctttgttgccccccgagggggaa

SEQ ID NO: 62833 - DNA, 226 bp, Triticum aestivum
  Clone ID: PAT_TA_62833
caatcccaaagagatcagcgcgcagccacctaacctcctcgtcgctcgccgcttcccccgcggtgccgttcgggtctgtcccgctcgacctccgcctccctgccgccggcctcgcctcgggctgccgtgcctgctgccaccctggctcgaccttcactcgggcgcccgcacgccccagccaccgagcgggctgatgcccgcacccgtttgtgagagcccgattgga

SEQ ID NO: 62834 - DNA, 592 bp, Triticum aestivum
  Clone ID: PAT_TA_62834
ggcgggccgtgatttcacaccctgctagatccatcacactcttcgctacccaaaacctggtgaagatgtcgagcagcggtgaggtcggcaacagccgttgacgtggggtggctcaggcgaggtcctgccccttgtcgctgacgctggaccaggcagaatatctggcgcggtacaacgtcctcatgccgcccgcatgccgtcgggctggcacattaacagcggcggctacgcggtcgagggccccgtcgtcccccgcgacgagcagcaatagcgtcacgatggccggtgcaacgcacatggccatcacgaattctgggtggggaagaactttgacgaggtcgtcgtggaggctcgtcgacgggaacttgcccaccgccgggcttgcgtggcgcgatatgtccatcctcccctgccccgcctcatgtggtcgccccagccttcggctgcgcccgcggatgttgcgaacccaagttggcagcgctcagagaggcaagcgaccccgacgacatttccgacctcttctgggcgatctgcgatccgcgacggctcagggatggtttctgactcccgcacctggcgacccagatgacca

SEQ ID NO: 62835 - DNA, 185 bp, Triticum aestivum
  Clone ID: PAT_TA_62835
ctcccattttcctctctccgatcgccatccccgatcatatgggaccgagacctccgccgttcacatcctgtacccgcagtcgtagaggatccgtgtcgcgcaccggagacccagttaacccgggagcgccaggaggtctcctcctccatcgcgcttcacgaccggccggagaccccatgggccgg

SEQ ID NO: 62836 - DNA, 370 bp, Triticum aestivum
  Clone ID: PAT_TA_62836
agaggagagctttagccatcgacgagacggcaagatgcagatcttcgtgaagacgctgaccgggaagaccatcacgctggaggtggagtcctcggacaccatcgacaacgtcaaggtcaagatccaggacaaggaaggtatcccgccggaccagcagcgcctcatcttcgcggggaagcagctggaggatggccgcactctggtcgactacaacatccaaaaggagtcgacgcttcacctggtgctgcgcctccgcggcggaagcagaggtcaataccccaagaacctctagcccaacctccgcatccttgttctaaagtaccatgacacctccctactcctgccgctggtgcctatgcacgccctaccc

SEQ ID NO: 62837 - DNA, 811 bp, Triticum aestivum
  Clone ID: PAT_TA_62837
tccgtgccgcttcgagccggccgggccgggaatttctttagtgccatacaggattccaaaatgtccgacaacactgcttcttcccctaaacaatcaccccggtctcccacctcacaaaagtcgaatgcgagtcgcgaggcagcggaagcagcgggtcctcacggtgctgaccattgggcaaatctagctcaagaatctcatgatgaggatactgattcatcgcttggcagcgatgctggatcgtcgacggcatctatgaactctagtatccttaactaccgtactatcaaagggaggacttaccattcggaaagaggtaacgcggaatattgggcatccaatgacgatcagcaaaacgaggccattgacattatccaccactacctcctgttggccctcgatggaaaacttcacttggctccagtgggggatgatgccaagtctgtactcgatgtaggcactggaacaggaatctgggcaatcgactttgcggatgagcatccgaacgccgaacaagttatagggactgacatttctcctattcaacctagttgggtacccccaaatgtcaagtttgagattgaggactgtactcaaccatggaccttctctcccaacacctttgactttatccatatgcgatatctatatggttcgatcggtgactggggagctttattccaagaagcataccgcgtttgcaagccaggtggctgggtccgaagctttgaggcatcccctcgatttagagagcgaccatggtactgttcaagaaggcagtgccatgaacgaatggggcaacgtctttatt

SEQ ID NO: 62838 - DNA, 840 bp, Triticum aestivum
  unsure (1)..(840): unsure at all n locations
  Clone ID: PAT_TA_62838
aaatctacttggtccttcaccgcaaactcacccagtcgcttaaccttgaacaaagaaatcccgccgaaaatgcctgttggaaccgttctcgttaccggtggtaccggatacattggctctttcacctcgctcactctccttgagcacggttacgatgtcgttattgtcgattccctctacaactcctcagaggtcgccctcgaccgcattgagctgatctgcggtcgccgccctgccttttataagctcgatatcacagacgaaaaggccatcgatgaggtctttgccaagcgccctgctattgacagcgtcattcactttgctgccctcaaggctgtcggcgagtctggcgaaatccctctcgagtactaccgcgtcaatgttggtggcagcatctctctcctccgttccatggagcgcaacaacgtcaacaacattgttttctcctcctccgctaccgtctacggcgatgctacccgattccccaacatgattcccattcccgagcactgccctattggacctaccaacacctacggccgcaccaagtccatgattgaggacgttattaccgactttgtcaatgctcagcgcaacaacttggaaaaggccggcaaggagtacaagcaatggaacggtgctcttctgcgatactttaacccttgcggtgctcaccccactggtatcatgggtgaggaccctcagggtattcctttcaaccttttgcctctccttggacaggttgccactggcgagcgtgagaagctccttgttttcggtgacgactactcctctcgcgacggcactgccattcgagactacattcacgntgtcgacctt

SEQ ID NO: 62839 - DNA, 314 bp, Triticum aestivum
  Clone ID: PAT_TA_62839
cggcctggccgggaaatacaaaaaaagggaaaaaaaaaaaaaaattacccccttctctgaactactctctctcccgctctcttctcagacaaatttacgaaaaattatctcgttattcttaactcgattacatgctctttcactcacaagcagacatctagctagatcttaactagccatcatcctcacctcccgtcggcgtttttcatctgagcgcgctctgcacagcccacttctccatcaccatcctcctcaccattctgggttaaatttccggcattatcctccctctttacttcctcctgaaccactaa

SEQ ID NO: 62840 - DNA, 669 bp, Triticum aestivum
  Clone ID: PAT_TA_62840
acttccaaagaaacagatacggataaacaccattcgccatgtctttctcatttggcttcgcaggcgatgatatttctgaggatgagcagaactcctcgactgtcaagccaacagccccagctcctgcggctaccaacagcgcatttcctgtcgcaggaaaacctcagcttccaccaactctccaccaactgtctgatcttctcgcccagcaaccgtccaagatcgcctacagtcttctttatgttgagcttgacgatggaactactgtacagttgccgcggagagagttgtgggatgtgagggtgcagctgatggctgaggaggagaatctcgctggagcgcagtccgagggcctgggtagtcatgatgtgaaaacgggggtttatgagggcggtttcaagagttgggagagcagtgttgaccttgtcaaggttctggctgcgaacaaggctatctcaacgttggaacagaagccttttcgagttatggagcttgggtgcggaactgcgttgccatctctggccgtctttcaatgggccatgacttcaaaatcagaaaggaagcctctgtctctcatcttggcagactacaacccttcagtcctccaactggtcactcctaccaatttcattctctcctgggctcttaataacactcagctacctgctc

SEQ ID NO: 62841 - DNA, 847 bp, Triticum aestivum
  unsure (1)..(847): unsure at all n locations
  Clone ID: PAT_TA_62841
acttccatccccagccaaccaagtaccgaaacctagcaagtgccggccaggaagccattgttgccatcgaccgatcttgatcagctcgaagcacacggagggtaagaagaagtcatctgcagaagagatgggctcgatgggacctgccgccgggaagccgcacgcggtgtgcctgccgtacccggcgcaggggcacatcaccccgatgctcaacgtggccaagctgctccacgcccggggcttcgacgtcaccttcgtcaacaccgagtacaaccacgcgcgcctcgtccgctcccgcggcgctgccgtcgtggccggcctcccgggcttccgcttcgccaccatccccgacggcctgccgccgtccgacgacaacgacgtcacccaggacatccccgcgctctgcaagtccaccacggagacctgcctgaggccgttccgcggccttctcgcccggctcaacgaccccgccaccggccacccgcccgtcacctgcgtcgtctcggacgtggtcatgggcttctccatggaggccgccaacgagctcggcctcccctacgtccagctctggaccgccagcgccatcagctacctcgggtaccgccactatcgcctcctcatcggccgtggcctcgccccactcgaagacgccgagcagctgacgaacggataccttgacacgccggtggacgatgtgccggggttgcggagcatgaggctcagggacttcccgtccttcatacgcaccacggacccggacgagtacacggtgcactacgtcctcagggagacgnagcgcacggccggcgcgtcggncgtcatcctcacagcttcggcgacttggagg

SEQ ID NO: 62842 - DNA, 261 bp, Triticum aestivum
  unsure (1)..(261): unsure at all n locations
  Clone ID: PAT_TA_62842
cacgaaccactttcccgcgcaagagagggaaaagagggaaggncgcggagcatccacgnaggggcgcgcaatgtaccaagcaatcccctacagcagcacccggacctgggcccgcccgtcgccggcggcggagccggccgtggccgtcaaggcggagaccgcggaggcgacggcgtcccgggaggacgcggcgggggttgatagggcggtgtctgagagcccggtcgtggaggtggggaggcgttcctgctgtctcaccca

SEQ ID NO: 62843 - DNA, 838 bp, Triticum aestivum
  Clone ID: PAT_TA_62843
gccgggccggggaatgcttaacacgaactcaatccgcctctattgacgctggctgtctagttccgccggtcctaaagcttctcgatcatcttattccaactactccccgctgtggctcactgctgtcgcacttggtgtcgccgctcccttagcctacaagatgtctgatatcgaacctatcaatgccgatccttcaaccctggccgaccgcgatgcccagaagaagcgcgagtcgggcgttaacgaggactcgccatgcgactgcgaatggaaaagtttattcgggagcaacaagcccagatcgtagccgagcttgagagacttgacggcaaaaagttccgtaaggacgagtgggagcgccccaacggtggaggcggcacgacctgcgttctccaagaaggaaatgtcttcgagaaggctggccttggtgttagtgttgtctacggctcgcttcccaagcctgccattgagaagatgcgagccaaccacaagacaatggatcccaacatggaatcaattgacttctttgccgcaggactcagcatggttcttcacccttataaccctatggccccaaccgtgcatcttaactaccgatacttcgaaacggcgaaccctgatggtacatctcaagcttggtggttcggcggcggttgcgatttgacaccatcatacctcttcgatgaggacgctattcactttcacaagacgatcaagaccgcttgcgatgctcacgaacaggaatactacccccgatttcagaagtggtgtgatgagtactttttcaacagcaccgtggcgaggcacgtggtattggcgccatcttctttgatgactt

SEQ ID NO: 62844 - DNA, 685 bp, Triticum aestivum
  unsure (1)..(685): unsure at all n locations
  Clone ID: PAT_TA_62844
agttctgatttgttatatctcatcctccatatctctctgaaccttttcttctctcatcaacaaccccgcttcaaaatgtctgataccaaggtctaccgcgccagcaccactgcgcccgtcaacatcgctgttgtcaagtactggggcaagcgcgacgcaaagctcaacctcccaaccaacagctctctctccgtcaccctctcgcaagacgacctccgaaccctcacaactgcctcatgctcgagcacctttaccgatggcgacagcctcactctcaacggagagtcctccgacatctctggcgcccgaacccaggcttgcttccgtgagcttcgatctcgccgtgccgctctcgagcaggccgattcttccctccccaagctttcttcctaccccctgaagatcgtctccgagaacaacttccccactgccgccggccttgcttcttccgctgccggtttcgccgctctggttcaggccatcgcctttctctacgagctccctgactcgccttccgacctttcactcatcgcccgtcaaggttccggatcggcttgccgaagtctctttggcggntacgtcgcttggagaatgggcgagaaggaggatggtagcgattccaaggctgaccttgtcgctcccgcttcacactggcccgagatgcgagctctgatcctcgttgcca

SEQ ID NO: 62845 - DNA, 308 bp, Triticum aestivum
  unsure (1)..(308): unsure at all n locations
  Clone ID: PAT_TA_62845
ccgcgccgccacccggaccacgaccnctctggccaccaagcgaggcaaccagaccacccgcgcncgcaggcccncgccggaccaccacccagagggcgccaacagcaacancccccacaacccccgcagcaagaggnccggcgacggccacaggaccaccagggccaccggaaccaacgccccccacggcacagccgacaggcagacccacaagccccagcacaaccgacgcacacgaaccgggacagacgcccgcgccgaaagaacgggagcccggcggcggcggaaagcggcgcaccaaaccgaaa

SEQ ID NO: 62846 - DNA, 788 bp, Triticum aestivum
  unsure (1)..(788): unsure at all n locations
  Clone ID: PAT_TA_62846
aaatccctgacactttgcatctgtcaccccgattttcgctttcaaaaatttccacgcttctctggattaccgattatcgtcgaaatgaacactgtcaaatccttctggttgggctggggctctctctgcgttgccggtggcggtgcctactacttcgctaagaagcaaatcaatgccgaccgtcaagccaagatggacgcccaccgcaggaagatacagatgatcaacaacttggaggccgaagagggcggcggtcctccccgcgacgaccatacctactccccaagcaccgagattgctcaagatcccgctcctacacgacatgcgccagcgaccgaggatcaacgcatcaacgagaagagcaagtacgagagcagttcggtgtaccggagtcccaagggtgataggttctcctagatcaatggaggacggaaggagtaagctcttggatggagctgtgtacaacaattaccatgcggaacgccttatcgtcatgaattaacctcggagaaaactgcaaaaggaagggcgcggatgacctgttggttgcaatatcaaccatcaacacaaaattgcttaatactatggcctattctgctcatgagttggatgcaacatgtacggacaagaccggttagagtggatccttgaaccctgtgcagacctcgcttgcagctctggtacggaaagaatcgctttctggtccattctggcattggtctttctttgtttgctacattgacgngtctacttattgacatcngaaaaatttgaactgtattcgtctc

SEQ ID NO: 62847 - DNA, 728 bp, Triticum aestivum
  Clone ID: PAT_TA_62847
gcctacatacttgtcatccgaccttgcgtcctatctccttcggtaaaatgttatctgtaggattgaaagcagtagcgcttacgttgctgctcggctctcgagcgaatgcttccccaaacacccccacggcctcggcatgtcgtcaaatcgccaaggccctaggggaaggcgtattcttccccgacgacactgattactccgagttgagcacgataaactggtctcagacggcatgggctcaaccagcctgcattgtttcaccttcaaatgccagtgaagtgtccaaagtggtaaaaattgctgttgcccagaaagccaggtttgccattcggtccggcggccattcggccaatccaggctatgccaatatcaacgatgggatcttgatttcactggaccgtctaactaagaccgtattcgacccgtccacttcattggtttcaatcggacctggaaatagatggggtgaagtttacgagcaccttgaacagttcaaccgaaccatggttggcggacgagttccgaccgtcggtgtgggcggcttgacactaggaagtgggctttcctatctgacggatttgcatggccttgcatgcgataatgttgtcagctacgaggttgtcctctcccatggaagcattgttgaagcgagcgctacctccaacaaggatctgttctggggtctcaaaggaggcatcaacaatttcggggtcgtaaacgagttcaat

SEQ ID NO: 62848 - DNA, 578 bp, Triticum aestivum
  Clone ID: PAT_TA_62848
tcgtcccttaccaagtgcccaagagctcgggcgagtcgaccgatatctcctcgacaatgtccaccacacttccaatggcggctatgttcacgcgcaacaagcttgtgggatgggcctctgttgttttctccatccagagctggctcggtgagagcgaggattccaagaagaactccaccactcctggatacttttcagtcggcatgtcaatcatggctcttgtcgtcacttacctacctatcttcctgcctcctgttggtggaaagcaggcttctggcaccgaggcccctgctcctgttcccctagcataattaagcagtgcgctgctggaggataaatgtataatagcgaatagcggatgatacgtacaagaacggatgaaggtcatgttatctaggattaattgtcatgagcgttatcttttgaaaaaccacataacaaaaacaaaaatataaaagtgataggtgatcctttgacccaaaaggtttcttgcaattgtggaatgttcattatgacaggaatactgtgtggacatgatctaaaagctcttgactttcatgaaacataaaaaccttgcc

SEQ ID NO: 62849 - DNA, 757 bp, Triticum aestivum
  Clone ID: PAT_TA_62849
acttcaataaagcgatttcaacccaaaacaacttcctcaaattcacacaagacatcgttgcccagcatgtcgatggatttggatgaccagcctatctctatagcccctaccactcagcagacgggtgctgcaactattctctgctgcaactgtggtgcccccatcgacggaaccgcatcaactggagctctctgctatgactgcatcaagctcactgtcgacatctcacagggcgtccagcgagaggcgaccctcaacttctgccgagactgcgaccgatggctcatgccccaccagctggattgtcgcctctcccgaatcccgcgaactgttggccctgtgcctcaagaaacttcgaggtctaaataaagtccgtattgtcgacgctagtttcatttggaccgagcctcactcgcgaagaatcagggtcaagatcactatccaagatgaagtccaggatggcatgctgctccagcagactttcgaggtcatttatgttgtggcgtaccaacagtgccctgagtgtgccaaatcatacactgccaacgtttggcgagctgctgtccaggtccgccaaaaggttctccacaagcgaactttcctgttcctcgagcaactcattatgaagcacggcgcccataaggatacccttaacatcagagaagccaggatggtatcgactttttcttctcacaaggaaccaggccgagaagtttattgacttcctcaactccgtggtgcctgtcaagaccaaggc

SEQ ID NO: 62850 - DNA, 491 bp, Triticum aestivum
  Clone ID: PAT_TA_62850
caccatccggcgagagatttagcaaaggcgagagcgagcagcctccaaccggcggcaaggatgcagatcttcgtgaagacgccgacggggaagaccatcacggtgctaggtggagagcgccggtgccgtcgacagcctcaaggccaagatccacgagaaggaaggtatccagtcggaccaccagcgcctcatcttcgcgcggaagcagctcggcgacggtcgcaccctggccgactacaacgtcaagaaggagtccacgcttcacctcgtgctgggcctcgccggcggcgacaaggcctcctgctacccgccccagatggagcctaacctgctcgcgctcgcgctcaagtacaggcagcacaggcttgtgcgcctgaagtgttatgcacgcctgcccctcaggtctgccaactgccgcaagaagaagtgcggcccacagcaacgatatccggccccaagagaagctgcgctaccactgaagcattgcaaac

SEQ ID NO: 62851 - DNA, 395 bp, Triticum aestivum
  unsure (1)..(395): unsure at all n locations
  Clone ID: PAT_TA_62851
cgctacaacacaggnggaagcatccgatctgctaccctcacgatcatcacaaacgtacacacaaaccatccacaaccgacaaaatgggtaaggaggagaagactcaccttaacgtcgtcggcattggccacgtcgactctggnaagtcgaccactaccggtgacttgatctaccagagcggtggtatcgacaagcgaaccatcgagaagatcgagaaggaagccgccgagctcggtaagggttccttcaaggacgcctgggttcttgacaagctcacagccgagcgtgagcgtggcattaccattgatatcgtcctctggaagttcgagactcctcgctactatgtatacgatattgaagataatgtacaacgtgattttatcaagaatatgatt

SEQ ID NO: 62852 - DNA, 596 bp, Triticum aestivum
  Clone ID: PAT_TA_62852
gccggccgggccgggtctccgcaacccagcgccctcacctgctctagatcccggccatctctccgccgacaaccgcacctgcgcgtccaccctccgccccgaaccagaagatggctattgccggcagtgggaggggcaaggcgaagcccgccgccagcgccaagtccgtgtcacggtcgtccaaggccggcctgcagttccccgtcggccgcgtcgcccggtacctcaaggtcggcaagtacgcgcagcgcgtcggcgccggcgcccccgtctacctcgccgccgtcctcgagtacctcgctgccgagaccctggagctcgccgggaacgcggcgcgcgacaataagaagaaccggatcgtgccgcgccacatccagctggcggtgcgcaacgacgaggagctaagccgtctgctgggctcggtcaccatcgccgccggcggggttctgcccagcatccacaccacgctgctccccaagaaggccggcaagggcaagggcgacatcggctccgcttcccaggagttctagattagattaagtgtcgttatgaatgtttgggttggtaacttggaatgcatctcgcaatcttgttct

SEQ ID NO: 62853 - DNA, 491 bp, Triticum aestivum
  Clone ID: PAT_TA_62853
cttctttcgaaaagcccttgccggccattttttttaattcaattcttattctcttgtgtttcagctggttctgtaacttcaagcgtctttctctatctcttattccccacaatatcttgtctcttgagtatctcttcaagcatcacgccactgcgtattaaacctcgtcacaatgaagactacaatctttgtcacgcttctttctgctgctgcgtctatcgtcagcgccggcatcgtcgttacgcctgtgttttttgaccagattgttgagaagctctctggcgattgtccctttggcgctgtcacacctcagggctgcgctcgtcagcgtggttagagggtcaggtcacggagtggaaaagaagtattttgttacgggatagacccaggtctaaggaactgttcaacttgggcgtgccattctttgatggacgaacaaataataccattcaagcgtgaaaaaacaacatctacctccataaaacataaaa

SEQ ID NO: 62854 - DNA, 789 bp, Triticum aestivum
  unsure (1)..(789): unsure at all n locations
  Clone ID: PAT_TA_62854
ccttcctcatcccacgccgccgccagattccggcgatccccgcggttccccaccacctagctctcctccccgaggtcacctctccccgctcaccagctccactgaccggtttctctcctcgcccaggagagccacgcccaggcactggtggtggtgcaccgcgaggaggccccagcggcgtcgagctcctgttgctgcgggcacagcgacgtcggcgtggtcaggatggtcgcagcccttcaagattctcaatggctgcgtcccggcgctgatggcggagtcgacggcgagcatcggcgggtacatggcgtcggggtaccggagggtggctggcgtgcagctctacatcaaccacctcaagcccgcccgcctcggcgaccgcatcgaggccaaggcgaaccccatccggtacctcgaccccgacgcgtacttggacaagctgctggacgcagtgcattggatccggcaggcggtggggctcgcctgcggcctgctctggggcgccgtccccctcgtcggcgccttctggatcgccctgacagtccctccctccctccatcctcaaagccccaaccttcttctttcccttcagacataggcatagattcaggttcattgttaactgaattcgtaagctcatctcacactgaatttgggacctctttcccatcgtgtagtatagtactagcaagtcagtcacacatgaattagtagatgagtctagcgattctgttaactgaattattttagaaacccgcttttgtttggctttanaaaaaaaaaaacaaa

SEQ ID NO: 62855 - DNA, 674 bp, Triticum aestivum
  Clone ID: PAT_TA_62855
tttttccactaagtggaaaaatttggctgtttccgtatgtactaggtcccacgctcaggacgcgtacaaatccgtactcgagtgccttgcgatagactcaaccctgtcgagcgaggaccaagtcaaagcattgatcgccacctctgccgaggatatcctttccaaggtttctctttccatcattatgacgccggtgaaagataaggatgatgaaataccctcctttggaagcatgaaggcgtatttggcctcgcgtcaatacaaaacacctttaatggctggttcgactgattttgatgcggtcatctttcaagctttgggagtttttggaggccgagagcaaggtgctttagctcgggactttgtcaaatatttgactgataacgttccttcgatgcatcgcgcaaaactagagagccttgcctctttatacgatatctcggcaacagacaacaacgatgaagagaccgtcaccaagattgtgcaagtcgccacagatctcacgttttacgccacgacaaaagtaccacgttttcctactggcctactcagtcgtggatgtactacctcaacgaatccaacccgagggaaggtccttaacaaggacgctcctctccctgacttgataccgggtatctcttcctgaaattaaggggcgttatggagtgaatcgc

SEQ ID NO: 62856 - DNA, 663 bp, Triticum aestivum
  Clone ID: PAT_TA_62856
aagatccgtgcctacctcaactttgacatgattgccagccccaactacgtctacggtatctatgatggtgatggtgatgctttcaacctgaccggccccgctggttccgacgccatcgagaaggactttgagaagttcttcaagaccaagcgtctcgcttctgtcccctccgagttcagcggccgttctgactacgccgctttcatcgagaacggtattccctccggtggtctcttcaccggcgctgagcagctcaagaccgaggaggaggccaagaagtttggcggtgaggctggtgttgcttacgacatcaactaccacaaggctggcgacaccatcgacaacctcaacaaggaggctttcctcgtcaacacccaggccattgccaactctgttgccaagtacgcgaagagcttcaagggtattccccaggtaaaccacctcacccgacgaagggacgccgaccacgctcagatcttcaagcgtaccagcgctcacacccacgcccacagtggaccttgcggtgccgttgaggtttaaaatgttatataattacatgtactatgagagatgagcagttgtatttcgatttcttgaacatattatgtagagtatgcaaaagcagaagatgagttatgaagaatataataccatttacctacg

SEQ ID NO: 62857 - DNA, 621 bp, Triticum aestivum
  Clone ID: PAT_TA_62857
atttccactaagtctcaacatgacttctgattccgccgctcctgataactctaccattgcgtcaccccccgccacacgagtcaagactaccacaatggagagctcccccgacgctccagatacacgaacgtctaccggtaagggcgcgcctccctactgctccgcagccaattcgctgatggctacgacatctactctgatcacgacacaaccatcccagctcgccgttaagggttgtggacgagactgatatcagacatgagatgttcctgatgtaaccgatgcccgtgtcgatccccgattaggcttcgactccatggacttcaacgacacaggcgatgacgacgttgatgccgattacggcgctgagatccaggaccttctcttcaacgactaccactgcctactttcagatcaatggagggcgaccgcattgacctactcatcctcaagggcgtctacacacccgaggatcgccgacgtccatcgagcttgagaacagtgatcggagagccgacggctatgaaagcactgcctcaataaagtcagaagatatagaatgccaacatcttcttccatgtaagatagaaattaagattagagtgttcggctatgtactac

SEQ ID NO: 62858 - DNA, 836 bp, Triticum aestivum
  Clone ID: PAT_TA_62858
aatctctcaagtgttcttgttctgcagtctcaagttgccttccaacaacacaacgaacaagatggtgcaaatcactcaactcctgtcgggtattgctctcgcttcaggcgtattcgggtcgcccattgagcgacgtgcggttatcaaccacgatgccgtcgttgggtttccagagactgtcccatctggcactgctggatcactatacctgaagtacaagcctttcgtcaagacattcaatggatgtgtctcgttccctgcggtcgacgctcaaggcaatacaagcggaggacttgccacaagtggctcatctgagagtggctgcagcaagagcactggtcaggtctatgcccgaggcggcacctacaacggccgatacgccatcatgtactcgtggtacatgccaaaggattcaccctcgccaggcttgggacatcgccatgactgggagaacgccgtgatctggttgtccagccaaagcacaagtgccagtgttgttggcatggccgtttcccaacacggcggatatggcaggaggagttcaggcactttctcaggcaacagtcccttggtgggctataccgccatctggccgaccaaccatcaaatgaccttcactgacaccaagggtggtcaacagcccttgatcgcctgggagagcctgcccgctgcggctcgcacggcgttgacgaacactgattttggcagcgccaacgttcctttcaaggacggtacctttgagtcgaacctgggcaaggcggctatctgagcagacatgtatagctcttcagggccagcggcatggtgatggcttcatgataggtgtgctttgtacc

SEQ ID NO: 62859 - DNA, 682 bp, Triticum aestivum
  Clone ID: PAT_TA_62859
aactcctccggcgcttgactgcatgcccagcagctcattgaccggccgaacctcagctccagaccgatcggccgcgccacgcacctcctccttcggatcaatggagaatgatcaccaccggcagggaccggcgacgtctacgccggcgacgaggagcaggacacggcgcgaccctgcccaggacaacgtctaccgggtgccgccgcaggacttcgcgctcaccgtgcagaggctcaccggcgccgcccctccgcgcacgcctccgcctcctcctcctgacgatcgggatgatcggcggccatctccggcacggccaccgccgccgccagcattgtccatgcaggaggcctacctggactggtgcgcctccaactgcgtcgttctcagccccgggacgatggccgagattgaccgcgccgcccgatttaactcagggataaataatggcaataataattagctaatagtactggtagcttactgcatattcgtatatagagatatacgcaagctatgtgctatttagcctcgatctcagcctcttgtaatttgacgtgctgaaggtttccgtacagcaacgaaacccgcgcaaattgctaggttcgacagagtcgctatttataaatccagcctgatgtgtgtcattgcgcaaactaaaaaggttattggatcccttttccgg

SEQ ID NO: 62860 - DNA, 628 bp, Triticum aestivum
  unsure (1)..(628): unsure at all n locations
  Clone ID: PAT_TA_62860
tcctacacacagtaacggacacatctcactgtctcaatggacgcaactacggcttcaggcctcccacccaacgtggtcatcttctctccccaaaactctccatccgtcaagtcgctcctcgaagcaggccttttcacccgcctcgttaccagcgcaagcacaacacctgagaaactcgctgccctgaaaaaccacgctgaagtgaaagacgacttctgcttgttccaccgatacgctatccttgttttcgacgcgggtgagaacgcagatgcgcaccatgagcacttccggactatctgtcttgcgctgaaggagctggatattggattggacgttgcaggttgcataaacgatgcgacggattctcttgcagctggatttcagcttgacaaggtgaatgacaagtcagcactggttatagatcttatcgagcaggaggaggacagtgacgaggaggaagagatgtttgttatgtgaggatttagggtgactaaggaatggagtgattcacaacagcaactccaatctataaacaagctaggttggatagaaaagacagcttattgccgtctanagatgaatggaccgaggctggctctgaaaataatatgaactgttagactgtcac

SEQ ID NO: 62861 - DNA, 198 bp, Triticum aestivum
  Clone ID: PAT_TA_62861
tatacaatcctgtaaataccacatcccccctttactctccgactcgcgccttcatcctttttcttttcctgtactctatacccatatttccataatcaagatgttggacatggtgttcctccccgccggcgccgtgctgatccatgtggtgcccttcggcggcctgcagtgcctcaccgccgtgaccttccacaaccc

SEQ ID NO: 62862 - DNA, 256 bp, Triticum aestivum
  Clone ID: PAT_TA_62862
tacgcaagataaggcgcgtccgaatatggtgtcgcggctgatgcacgccgagaggcccggctgcgagtcgacggccatctgacagtacctcgacgaggggttcgccggagacggccgccccgccctcctcccggacgacccctactagcgcgccggcttccgcttctgatgcgcattcaccgacgacacgctgctagaaggtcatgtaccaagcgtctaggagcatgactgaggaggagacagagtaggccaacaa

SEQ ID NO: 62863 - DNA, 352 bp, Triticum aestivum
  Clone ID: PAT_TA_62863
cccttaaaaattattgactcgattcgcgcgtccttcttccccagcttttacacccaacgtgaacctatgtctttccatctcgatctccatcgccgtctttaatcgccttgttcgatggtcaggaattgatgggctcttactggtgaaactgaaattaattgtcgacgatcgcatagctctgcgcaatgtagaattcgatcccatcacgatctattgggatcggagtcatggtcgacgacgcagacatctacccccccacggtagcgtactacctgagctagatggtcatcactgtcgtgtcgcgacaagataatgcgagtcttctagtagtttgtcggtttctacgcctggt

SEQ ID NO: 62864 - DNA, 730 bp, Triticum aestivum
  Clone ID: PAT_TA_62864
ccgttcccacctgcacctccatcagggactattataaactacctctcaaagacttctattcttggaatccgagtgtaggcacttcctgtcaagctctcatagtagactactgggtttgtgtgtctgtgatcggatggagtcccccaattagttcccctactccctctcctacaaaacccatcaacggcatttcgactccttctccgatccaagccggattacacaagaactgcaacaagtttcacaagatctcgtcaacaaccacttgtacctcgattcagaagtactataaccttccgctcaaggactttcactcttggaacccaagtgttggaacgtcttgccaggcccttctggtcaactattgggtctgtgtttctattgtcggctggaaaccacccgtgagctcacctactccttcaccaacccaacctgccaatggtatcaagacaccctcacccattcaatccaagatgacgaagaattgcaacaagttccacacagtcatgtctactaccacttgtacttcaatacaggactactacaagatctctatgtcgcagctggctcaatggaaccctgatgttggctcaagttgctcagcattgttgggagggtataatgtctgtgttggtgtcatcgggcaacaaccgtctcctacacccccttctcctgtccagcctggcgtcgtgaagaactgcaagaagtttcacctcgtaaggtcaacaac

SEQ ID NO: 62865 - DNA, 618 bp, Triticum aestivum
  unsure (1)..(618): unsure at all n locations
  Clone ID: PAT_TA_62865
ggccgctcgaggccnggccggggcccgggatgtccatggctacccaagatcatcgaccaatcttatcagtcttcacgtaaggcctgtcatatgcagtcccaacatccaacggtgctagaactcatctctaggtttagttcaccataatgtcacacctcacatattacaactatgaaggagtaggcaaaaccaacaacaaggaatactcctactcccaagccgtacgcgtgggcaacacaatcaagtgctctggccaaggtggctgggatgaccaaggcaatattgacaaggaagatctcaagggtcaaatcgatctcgcctttaagaatgtcgaaaagaacctcaaagatgccggcgcaagaggctgggcagatgtccactcggtcagaagttaccacatttcgctctctggttctttcgacttgatggtggaggagtttcgcaagtggatgcctgaccatcagcctacatggacctgtgtaggtgtcaccgagctgggcatccctggtatgatcgttgagatcgaggtggaagccaacattgcacaatagtggtattatacgacggaatatttgagcgttgtcactatttcacaaattccatggttttcttgtctcc

SEQ ID NO: 62866 - DNA, 570 bp, Triticum aestivum
  Clone ID: PAT_TA_62866
cggttacaaaaaagtacaacacaaagctctctattacgaattcgatcaggatcatcgtcgtccatcagtcgagacgtacgtggttcagttcaacaggtaagtactcaccatgcatgtctcaaattttgtgaatctttagctggctattttgatctctacaatctataggtcctcagtacgagaatgagctcctcggacgacacctgcggcaagaaggcgtcgtggccggagctggttgggaagtccatcgaggaggccaagaagatcatcatgaaggacaggccggatgtgaagatcatcgaggtcttcccggtcggcaccgccgtgaccggggacttcaggcccgaccgtgtccgcatcttcgtcgacaccgttgcggagatcccccgcattggctagcttttgttgatgccccaccgttttatgtgtgtgtgtctgtatgtgttatgctcctgaataaaccatagctagtgagtagtgaccctgtatgcatactactcctagctatgtccgtcgctctgtaagaattaaaataatcattaaacttttttatgggaaataattaaagtt

SEQ ID NO: 62867 - DNA, 732 bp, Triticum aestivum
  Clone ID: PAT_TA_62867
tctttccagctctaccctgccccttcggcatcggcatcttctcctgcccgcatcctcctcggaaaccctggtcacatctacgttgccgactttactcccaagacgggcaagtttgagattagcatcaacgagaccattgagggtggaaactcgtggatggcctttgccaagcccaacttgctctatgccgtcgatgagaactcgaacgagctgcgtctgtttaacctggacctcaagactaatgaactcaaccttacaactaagaagaccgccagcactggtgttgttcatctcgagttcaactctgacaagagtcgcatggtcggtgctgcttacggaaacggtactattgatgtctggaacacgaaggacggtggtctggaactcatcaagactatcaagtctcccggcaagcttggtcccaacaaggagcgccaggatgcttcccaccctcaccaggccaacctcgatccttcaggccgctacttcgccgtcaacgatctcggtaccgattctgtcgtcctcatcgactccaagaacgacgcttttacagataagaacatccctatcgaggctggctgtggtcctcgccacggtgtcttttaccctcgtggtcaggacaaggccacccattacattatcgcctgcgagctgagcaccaggccctcgtctactcggtcacctacgagggcaacactcttgctttcaagcactaccagtccatctctacct

SEQ ID NO: 62868 - DNA, 791 bp, Triticum aestivum
  Clone ID: PAT_TA_62868
cggccgggccggggtttccatacctatcaacctcaacaacacagtttgatcgcgccccttttagcagaatcactttgcaaaacacgacttcagcagtgatacaaggcgacttcacatctacacattcgtatttagaatttacaagactcttgtctcacctacccgccctcagcatcgcatcgacctcgttgaaacctcgtcgaatatcgtccttcaccatgggtcaagccttcttaaccactgttaaccagcgaacgagaaaccagtttcgcccgcgcgtgggcaagggaggatcggccagttatcaactgcgacagtatgctgaggtgaccctgggcggtggcagcctgcgcaaggttgtcaagctcccagagggcgaagacgagaacgagtggttagctgtcaacatggtggatttctacaaccagatcaaccttctctacggagccatcaccgagttttgctcaccgatttcatgccctgagatgaaagccaccgacgagttcgagtatctgtggcaagacaacgagaacttcaaacgaccaaccaagatgcctgcgccagcatacattgaacaactcatgacgtgggtgcaggccaacatcgacaacgaacaagtactgcccagcaaaattggcgtccccttccccaaatctttcccagcgctggtccgccaaatcttcaagcgcatgtaccgtgtctacgcccacatttactgccaccactaccccgtgatccgcgagctcggtctcgagccgcatctgaatacaagcttcaggcagtacgtcctg

SEQ ID NO: 62869 - DNA, 526 bp, Triticum aestivum
  Clone ID: PAT_TA_62869
cgctcgatggccgacgtcgagaaccctgacgtcggggaggcggagcccaacgagtgtagcaggcgtatgttgacttccctgatgggttttgccttcgtcgcgttcatgttggtcttcgcgcacactgcggcgctgctggaagagtcccatccggcgtcgacgagcgccgccctgatcgccctgtcgctgctgggcctcttcttcgggtgctggtttggcggcatcttcgtgatcctcgtggcggagtggcaccacggcggggtagagggacatgctaggtttgctgatgatttgatccagtccgatagatttattcttcctgaatcaatccatcagtttctaattcgcgtcgatcagcatgtagatgcatagtcttctcttatcgattttttactatgccgtcttccaccgccgccggctcccctggcctcccgcgtggtgctgtttggggtggttgtgtaatcccctattgctggatggccttatcggcaacaagaaataatatgtttccgtcttgttgacattg

SEQ ID NO: 62870 - DNA, 787 bp, Triticum aestivum
  unsure (1)..(787): unsure at all n locations
  Clone ID: PAT_TA_62870
accttccagcagagttgaagaccatcagttttcttcaattcgcactcacaaagtgaaggcgatagcaacgatgtcaagcacagcaaaggccgtggccttgtccccggctccctaccatatcatcacctacggaacacttctaggaacgacctttttccactccttcgtcaatggcatcgtagcgttcagggcggtcgatcgtgccagcttctctgctatccagcaaaagctcttccctatctacttcggccttcaaactgtcctacccggtgttctcgccctgactttccccggaaactctctgattggtcttgccaatggtcccgccggtctggtgtcggaatttgcccgctggcactccttgttgcctatcagtgtcatgggtatcactggtgctatcaatctgcttgttctcctaccaatgacagttgacattatcaagaagcgacgtggacaagtcaagcgggatggtaaggagtactacgctgagggtcctcactcagaccagatgaaggctctcaacaagaagttcggcatgctccacggcatctcatctcttctcaaccttgctacctttgtggctgctgtcggatacggcttcactctaggcggtcgggttctgtccgtcgcggaccttgcttggacgattcaatgataaagatgcaattcttattcatgctctaaaatgctagtggtgcaaagaatcttcctgatagcctagcgtctactttccatcgtacaatagcgaaaatctctagtatgtctanacaaaaaaaaaaaaaanaag

SEQ ID NO: 62871 - DNA, 408 bp, Triticum aestivum
  Clone ID: PAT_TA_62871
cggccgctcgaggcggcgggcgggatttctctgcaaaccacggtctcactcaagataccggcaaagtcatccaagtcaccggctccatccaagggaagcgacgaccaggatgaagatagtgatagtgatagtgacgatgataatgacgacaaagacaaagacgaaggcgtctgggactggttcactcacaaggtggagaaggtctggcacaagattactggcgacgactagatgtttcagtgcatggtgtgcattattggctttctttgtgggatttccatggcgtttgagacggatggtgagtccaagactggctcggggcgtttaacatcatgcatcgtttggatggctttgtgaatgattaggcagaatgggtaggtacaaatatgatatcgtattctttttctc

SEQ ID NO: 62872 - DNA, 609 bp, Triticum aestivum
  Clone ID: PAT_TA_62872
acatctcgcagctaccatcttctctcctctccaagcattcgctcgccgtcctctcctctctgaatcttctcgggcaagtctttcaccgtcgacaacaaccagatggctcgcttcgccgtggtcgccgccatcctcgccctcctcgcagtcgccgccgccgcgcagggccccatgccggcgccccggatggccccgcttccggcgccaccggcgaggtccccggtcgccacccctccaaccgccgcgtcgccgtccccgatggcatctccccctgccccgacgaccgacgcgccgaccgacgctccctccgcgatgacgccgtccgcggtctccgccacaccctccggcgcccccatcggcgccccgaacggcacccccgcgagctccgccgtgtactcatccgccgccagcttcgtcgcggtcgccggagcggtggacgccgccatcgtgttctagatgcagcgacgactctccttgctgttgtctatacagtttcatcgtttctgagattctttgctacaagtattatagatcgaggaaaggttacacgacattgcgaatgaaacttgttgtgagattataatgaatataaaattcgttcatttgtga

SEQ ID NO: 62873 - DNA, 154 bp, Triticum aestivum
  Clone ID: PAT_TA_62873
attcaacctcaactacctactttgataccaatcactcaatatgaaggcctctttcgtcgtctctcttcttctctccctcggagtctcagctactccagctgatcgaactaacaccattgaaagacggcgtgcttcacctacactgtgtatcgac

SEQ ID NO: 62874 - DNA, 658 bp, Triticum aestivum
  Clone ID: PAT_TA_62874
atcttccaccaccatcctccgttcttagggaatagtaaaggtgagaatgaggagagcaacctccatgcgtgggcaaggacttatatcattttggaagacgctgacggcgaataccatcacgaggtaggtggagagtgtctgcgacgacctaagactcaagggcacacatccacgacaaggaaggtattctgacggaccagcagagcctcatcttcacagggacagcatcttgtggacttgcgcaccctgacacgactacaacgtacagaacgaatccacacttcaactcgtgatggcgctcaccgtcgcgacacaagggatcgagctacccgactaacatggagactaacctgctctagatcgcgttctagtataggtagctgacgcttgcgtgacggaagtgctatgcacgcctgaccctcaggactgccaactgccgcaacaagaattgcttcccatcatgcaatgagatcacgcccaaggagaagatgcgctaccactgacacattggaaacttgaccctgggtatacatggcatacctggattaactgggtagctgagagtgtgtatcgagcaatcttagtttacttgtgatatgaagtttcatcctagctatatgctgcttctggaatctagaacgccatacagatgctaact

SEQ ID NO: 62875 - DNA, 417 bp, Triticum aestivum
  Clone ID: PAT_TA_62875
agcccaccggcgacctgacgatcgaccggcaccgatggccggcgggaggaagcgggagtggatacgtaagaagatgacggcggcagccgggagcgggtcgctgcgcatgcgcgcgctgtccacggcgctgcggcagcggaggaaacggctgccgcgcgtcgacctactccggttcttctacgagagcatcgtgttccggctgctgtgggtgctcgagtccatcgtcgtcctcgccaggctctgcttcttcttcctccgcttcggcttccggctgtaaataaaccgagctgtattttgcttgacggtagtaaccgagccgtgttcatgtgccgtgtcttgaaatcttctttggtttgctccaaaacattgtaaacaattcacaaattcagcaattataatctactctggcttcctacg

SEQ ID NO: 62876 - DNA, 831 bp, Triticum aestivum
  Clone ID: PAT_TA_62876
aaattcctgaaggggatcgagatgcgggatgtttcaaatcgccagatcatgtcttccattgtgattcaagtttcccaagatttttgcaagaagccaatatccatagaagttgtccaattcgaacctcaagagggcgatgtgacagctcggtactggactgaatgtcactctggaaggacaacacgcaagaagaaggagttgccaacatattgtctaaaaagcatttatgcgacggccaaagaagtcagacgatacactatagagaatgcgcttcctgcatatctccacacaatccaagaggaattaagctcgggacgcgaaggcgggccagttgttttcaggacctattacatgatattgacacgctatatggaactcattaaagaacacaagtctgggaacgcaatgtctccggaggatgagaaagaggcgaagatttatggaaacctttttattctgtggtgcgccatgcaacacactgtaggatctctctacatacaaggcgacgagacactaggcatacggcccgaaaatcaagataaatcctacccactctacggcaagatatcgccaccgcgcatgatcgttgctcagttcgataacctcgtgtacaacgcggttctcgagacatataaggaaaaggtactcaaggatgttgattggctcttcaatcaagataaaaatcggtggtggttcactgtgtacaacatcctttttatctttctgcgcgaagtgagccgcatgactgcagatagatatcgacatgcccagcaaaatttttggacctaagccacgatatttcatacccggattcgttgagcgtctccatga

SEQ ID NO: 62877 - DNA, 757 bp, Triticum aestivum
  Clone ID: PAT_TA_62877
atctccctatagtgttgcctatatccgtctcctccttcgattatccatcccatcatcaccatgcctgcttctctggactcttcccggcccatcatggccccttctaaccgcggctctgttcgcttcagcacctacagcatggctccctcactgtctcccaccgtcggaaccaccgactctgcccacgccgagatccgcgatatcgctaccggcctcgaccgcatggagaataaggccctctcttcccagcgcgtcatcctcaccgacgagaagacagacaccatgagcaagctcgccctcggcgcaaagcttgagcgtgctctcgacaggagaatgagtggccaggacgctgtcatgcgacctcgcggccagagcctcaacgagaagctcagcgagaaggagtagaacaaagtcccaaaggaaaccaccaaaacaaacaacaaacgcaacaaagcacattgtcttgcgaacaagatacccctcgcaaacgagaattttgttttcggcctggtcttgactctcctgagcagcgcacgcatcgcatggcatcttgctcctgtcgcaaatttttattattcgcaaacggaatgacgcatcacgccaatgatcaaccaagggggaaattacgtgggaatatgagccacaactcatccagcctctgatttatgctcgcaaagctcacaatcatggatcttgttcaacgacttcaaacgcatgcgaatagggatctggacggctacttgttgatatccacttc

SEQ ID NO: 62878 - DNA, 838 bp, Triticum aestivum
  Clone ID: PAT_TA_62878
aattcccaggagcaaagcaaagcaaacaccacttccacctcactcatctcagctcacctcatttcgaagaagaaaagaaagaagatctaaatcgcgtcatgttgccaggaaggtttcttggtcagaagaaggcaaggtcaccggcgggtctgcccacaaccccaagaacaccaacgccggcgactacaccgtcatcaagaacagtggctccgctggtggcctcagcaacttcaccaagggtggctatacctgcagcctcaagatcgtcaacaagggtggcttcttccaccacgtcaagaacatcagcaacgtcggctcaacccgctaattcaagacccgctaactcaagaccgccaacaacggcaaatccacaggtgacctcaagaacttcaacgacggcaaattcgtatgcggcctcaagaacttcaacaactgcaaatccgtatgcaacctcaagaacgtcaacgaagacaaatctgcccgcaacctcaagaacgtcaacaacggcaaatccatacgcggcctcaagaatgtcagcagcatcagcagcggtggctccttctgcgacctcaagaatgtcaacaagagtcgctccatccacgacctccagaacgtcaactagagcaacgatggcctcaaaccagtcgacgacactgcagcctggtgcgccgacctcaagaacggctaggacgagggccccacccttgtccgcaacgacaagtcgtagtcatgccgctcccacacgtccaattgcttcaagcacacgccgatgatctccatccatgtacgtcgtccatcttcatgaagttaagtgcgttgagaccaaattagttatgtc

SEQ ID NO: 62879 - DNA, 626 bp, Triticum aestivum
  Clone ID: PAT_TA_62879
cggccgggccgggatttcacaaaacgacatgaagctgcctgattgcccggctatcgagacacttgaatccagacaattgccgctctcgacgacaaccctgcaccagccccacatgacgcaccattactcaaggacgacaaccccttcgagattggcaacgatgacgccgagcgcatacggcatagatagcgatgatcgcattcccgatatccgacaaaaggactagatgagtgatcttgccaccatcaccaaaagtaattacctcacccctgtgtgatctgaccgatctacagcgcgcttactccatccgaaaacgaataaagctgtcacccaagaaaggcatcatcatcctcatcgtccagggtctacctgccgaacagctgcccggatgaacagcctgtatggggacctccacgaaggcgaccgatccctctacctatgctactccattcagaacactcgtgtctcctcgacagggcaccgatgtcacatcagccatatcttctaaagaccatgtgccctaaggcgttacggtcgtatttttgggtggaccctatgtgctgcgaacgtgcgatattcttatcacatcactatgatcagacaccgtactccaatagagtggtcac

SEQ ID NO: 62880 - DNA, 414 bp, Triticum aestivum
  Clone ID: PAT_TA_62880
gattccagttcgcttactgctctggtatccgatactacatggtcaacaagcgtgagtacgttaacaccactgtcggcaaccccgatggcgaggacaagcccaacaagaagtacttcgacccccgtgtctgggttcgtgagggtgagaagaccatgtctaagcgtgttgctgaggctctcgaggacttcaacaccgccaaccagctataaatgtcaccgaagacactcaatggctttaatgatatcccaattgtgcgacaaaattcatgaaatatcgtttggaaaaaatgagggacaaaagaaaaaggcccctccccttggttcggatacgacgttgcagttcatagttgcaagggacgttatgaggcgatgaaagtagtatattaattaaaaacaaaattgatgaagtatgagg

SEQ ID NO: 62881 - DNA, 733 bp, Triticum aestivum
  Clone ID: PAT_TA_62881
gaattccgagacgtacaacaagctagctagcaatgatggccatggccaggagctccagcctagtgctcgtcgccttcgccttgctctgctgctacgcctccaccgtctcctcccagggtaattcgtctgatggtttcctctcgtgtctgacggcgagcatcccccgccagctcgtgttcacgccgagctcgccctcgttcacgccgctgctcaagtcctccatcaggaaccccaagttcttcacgcccagcaccgtgaggccgctgtatattatcacgccgacgaacgcgtcgcacgtgcaggctgccgtgctgtgcggccgtcggagcgggctgcgcatccgcgtgcgcagcggcgggcacgactacgagggcctgtcgtaccggtccgtgcgcgccgagtcgttcgccgtgcttgacctgtcgagcctccgtgccgtgcgggtcgacgcgcaggcggcgaccgcgtgggtggactccggcgcccagctcggcgagctctattatgcgatcgggaaggcgagcggcgtgctcgggttccccggcggcctgtgccccaccgtcggcgtcggaggccatttcagcggcggcggcttcggcatgctgctgcgcaagtacggcatggccatcgacaacgtcatcgacgccgtgctggtggacgccaaggcgaggctccctgaacagaacaccatggggagcgacgtcttctggggcctccgaaggcgccggcggcg

SEQ ID NO: 62882 - DNA, 366 bp, Triticum aestivum
  Clone ID: PAT_TA_62882
gagagatactagctgtagtgagagatcgtgccacatagcccgcaacggcaaccagtgctgcctaccaaaacaactacgaggtctggattccagcatcgaggacgacgacggcagacaactgctaccctctgaaaggcatcgaccatatggatgcgcagggtgacaatgacatgaaatgctacgactgcgacgagtatgatgactactcccgggactgtcacaatgagtccgttgctcgtgataacagctgctataagagccagaatggtgagcactgccagccttaacgccgccccgactataaacccggctcggtttcctcgcgaggagaatgaggacacaaggactcgcagaccagctgatccc

SEQ ID NO: 62883 - DNA, 754 bp, Triticum aestivum
  Clone ID: PAT_TA_62883
aaactgcaataagcggcgccgccagcacctcaattgcacacctctttccgacacacacacatattcgcaaaaatgttccgatccgccgtcctccgatccctccgcgtcgccgcccgaccggccgccgtccgctccttcgctgctccccgcgtcgcttccgtagccgtccccaagatccagagcttccaggccgtgcggttctacagcgccggaggtgcgctcaacaaggatgaggtcgagggccgaattatgagcttgttgcagggctttgataaggtcaacgatgtttctaacatcaagtcctccgctcacttcgccaacgacctcggtctcgactctcttgacaccgtcgaggtcgtcatggccatcgaggaggaattcagcattgagatccccgacaaggacgccgactccatccactccgttaaccaggctgttgagtacatcctgaaccagcccgacgccgcctaaacggtttaatctcccatataccaccaccgccgccgccatctacctacctctttttttttcctgttctgtctccccttcgattcttgtacaattatctcaaacctctccatccaatcccagtaacgccgaaccccctcggagggggaaacacaagaaaagaagaagatatggagggcgacaagtggtggggggaaatggtagataagagaaacaaaatccgccaatataaacgcatccaattcttctttttatctcggcgcaccataagaaggagctatttata

SEQ ID NO: 62884 - DNA, 825 bp, Triticum aestivum
  Clone ID: PAT_TA_62884
attctcacactcaattgctcagaattatctgtcgctcaccttgaccaactttgttaaacacgatatcttcacctttcggtacgatgtgacaacacatgaataaggagccatggctcccttcgcaattattaccaagtatcaaggtaacgtttaaaaagaacgcatccgggtgttcaactgcctctatgctctgtgccacaacctcagctatcaaaagcttgaggacgaccagagcagggcggttgatctgagaaataccggcgaacttgatctggataataccagcgaaaggacatgcttcttgacatcccctccctcttcttccgggtgaccggggaactaaccatagcagtataccacttgatctttcaacatgtcgactgacaagatcaccttcctcaccaactggcacgctacgccttaccacgccccgctgtacctggcccaagccaagggatacttcaaggaggagggaatcaaggttgctcttcttgagcccaacgatcctagtgatgtcactgagattatcggaactggcaaggtcgaccttggtttcaaggccatgattcacactctggctgccaaggctcgaaacttccctgtccaatccatcggcagtcttctcgacgagcccttcacgggagtcgtctacctcaaggactcgggcatcaccaccgacttccgcaccctcaagggtaagcgcatcggctatgtcggcgagtttggcaagatccagattgacgaactcacctcgcactacggcatgacccccgaggactacaccgctgtgcgctgcggtatgaatgtctccaaggccatcatcaa

SEQ ID NO: 62885 - DNA, 766 bp, Triticum aestivum
  Clone ID: PAT_TA_62885
gccgctacgagccggacgggccgggatctccttgacaaccccacgaattgataaacgaccatagttcagccatcaccacatccatatcgagtttatcaacccacaaatttgaactatggcggatcgttactccttctccctcacaaccttctcccccagcggaaagctggtacagattgagtatgccctcaacgctgtaaaccagggtatcactgcccttggcatcaaagcgaccaacggtatcgttatcgccaccgaaaagaagtcatcatctcctctcgccgaccagagctccctctccaagatcagcgacatcacccccaacatcggcatggtatactccggcatgggccccgactatcgagtattggtggaccgagcccgtaaggtttcgcataccgagtacaagcgcatctacaacgagtacccccctaccagaatattggtgcaggacgtcgcccgagttatgcaggaggccacccagtcagccggtgttcgaccttatggtgtgagtctcttgattgctggttgggacgagggcattgagcctgaggatgaggaggacgacaagtcccaagaggatagcgaggagaagaaggtcaacagaaagactggaggcatccaccaagggaggtcctatgttgtacccaggttgacccctctggaagttactacccatggaaggctacagccatccggcaagagtgcaaccaaggccaagacattcttggagaaaggatactctgaagagctggagcttgaggat

SEQ ID NO: 62886 - DNA, 707 bp, Triticum aestivum
  unsure (1)..(707): unsure at all n locations
  Clone ID: PAT_TA_62886
aatttcctaaactcctacttcaccaccaccaccaacatattccacgagcattttaaagcgcataattcttcccaagtcgccaacatgaagctcgtcagattcctcatgaaatgcgccaacgagacggtgacaattgagttgaaaaatggaaccatcatccacggcacaatctcctccgtctccccccagatgaacacggctcttcgcaacgtcaagatgaccatcaagggtcaggagcccatctccctcgagaccatgaacatccgaggttctacaatccgatactttatccttcccgactcactacctctcgacacactactcattgacgacgcgcccaagcccaagaacaaggcccgcaaggaggcggcagaccgtggtgcccgaggtggacgaggcagaggcggtcccaggggacgtggacgcggcggcggtggtggtcgcggccgcggaggacgaccttagaaagaacaacgcaggaagagataggaggccaggcgagaaaggagagaaggaggatggaagcgtaaaggcgcatcattcgtggagtggctatgatatcgagatgatatcacattttaaatggaacttggcgttcgggttgtttagccataaaaactgtatgaatctgaatcctcttggggtgggtatcgccttttggtaggtatggaaagatatctgaatacatgcatgctcttacnagcctc

SEQ ID NO: 62887 - DNA, 515 bp, Triticum aestivum
  unsure (1)..(515): unsure at all n locations
  Clone ID: PAT_TA_62887
ngaatttcaaaaaaaagagaaaaaaaaaaaaaaaaaaattaaaaaaaaaaaaaaaaaaaaaaaaaaaatccgcccctttcaggcagggatttcttaatcccgccccggattaacaacaggtggtccaccggaacccccggaacgggggggtccgaaaacaaaaactccaataaggacccctatttggccaccaaggggaaggcggggggggtggcccgggttgtggtccaagggttcaaccgggtcctgggggggaaggttctccaaggaaaacggggttggcttccccgggaacttgggcccccccgggggcttattatggaaaacctggccggccccccccccggaagaagaagaaccaacccctggaccccagaaccccgtaaaaaaaacccccctgggggggtattccccgggggttaaccccccggaaaattcccctaagcaattggctggctacctggctaaaagaaagaaattggccccggttcattgaatttcctccgtccattggt

SEQ ID NO: 62888 - DNA, 844 bp, Triticum aestivum
  unsure (1)..(844): unsure at all n locations
  Clone ID: PAT_TA_62888
actgtctttcttgacgcttacatattcaactatccagcaaacctccttccatcaataaccagatacgactttgtctcctggtttactacatctcaagacgatctctatagttaccaacgatcgcgatagctcgcagcacctatcttagatacccccttctacacatcaaaaatggctcttaagcgtatcaacaaggagttgactgatctcggccgagaccctccttcatcctgctccgccggccctgttggcgaggatttgtttcactggcaagctacgatcatgggtccttctgactccccttactctggcggtgtcttcttccttgcgatccacttccctaccgactaccccttcaagcctcccaaggtcaacttcactacacgcatctaccaccccaacatcaactctaacggaagcatctgcttggatattctccgtgaccagtggagccctgctttgaccatctctaaagttcttctgtccatctgctcaatgctaacggatcccaaccctgacgatcctttggtacccgagatcgcccatgtctacaagctggccgaccccgatacgaggccacagcccgagagtggactcgaaagtacgccatttaaatgacgatatggacgaaggcggttggaccttgggtcgatttgttttccctatcatgagcgacgtgaaacgatcgagtggaagcttcgcacggcgttgcgatatggctttagtcggcgtgacctagaaagatgtttttgcctgtatcgaggcttcaactacggttgacgagacagcaagcgacgctgaagggaggnaagacaccagacaaacagactagntattaagggat

SEQ ID NO: 62889 - DNA, 773 bp, Triticum aestivum
  unsure (1)..(773): unsure at all n locations
  Clone ID: PAT_TA_62889
atttctccatccttcttcactaccgtatatccatatctcaatactccaattcgtactgcattcgtcatcttgatcttgcagatactcatctcatccatcctgtctcagcacccataccacccacacgtctccaacgccagctccagattggccctgttcagccttgagcaaccacgacgtatcatccgacgatcgacatacagtacctacatcttggatattgcggctgcatttcgatacacaaggaattgaataagatagtcacaagaacctttttattcttctataaaccggacgacccgacttggaactctactcttgcctggctcgcgacagtattgtaaatcgcgactcccattctcccttggaatcttcccacataccacagaatcgcttcgatggtctcgtcattagacgttcgaccccatttcttctccgggcacaaccgatcaacatcagtatcatccacgaatagctctctatccacaccagcttcatattcatctttaccattatcaaagatggcatccgtcggcgcacaaacatataccatggctctccagaagtacatgcttctcacagagcaacaccaagatctttgcgatcgcctcgaccagatccgtcccgagttccactcatcaagccgctcccaattctcctcgccatctacatcaccaacccgatcctcatcctcatctctctctctgccgccttcgncgaagcgccactcccgaagcggacgtcaccactcgcgctcccaacgccgtttcagc

SEQ ID NO: 62890 - DNA, 518 bp, Triticum aestivum
  Clone ID: PAT_TA_62890
aggaactgccgtcagagccaggacacgatccatcaaaaccaacatatagctaactagaatgtcctccgtcaaggtggttgtcatggccgccgtgctggtgctggtggtgctgtcttcttccccatggcaggcgaggcgcagatgcgctgcagcaggtgcacccaagactgcaactcttcgtgtgatggctccagtagcagcgtgagatgcagtaggacctgcgccggcaccccgaccttggagtgcgccaactgccagagatgcatgaactcttgcttaagctactgccaatccacctgcgttaattagctgcggaactagtattcctaccgaagtactcggaaatttcaataacaggttgcaaaatgcgcttatatatgtattatcttcgtgtgtgaaatttgcatctgtgtctactagtacaacctactgttctccggtttccattagccttgaagcaatttacttcacgaataaagaaattcgacggtagcaatggattcatatgctccgctccc

SEQ ID NO: 62891 - DNA, 517 bp, Triticum aestivum
  Clone ID: PAT_TA_62891
ccggccgggccggcaatttacatcccctcgtcacatcattcacaatgatttcaactacacaaatctcattacctaatggcaagaagtacgaccaaccaactggtctcttcatcaacaatgagtttatcgcagctacaggcgacgaatttgtcgtgacgaacccgcacacagaggaagaagtcatcaagctcaagggcgcatcaaaagaagatgtcgacaaagccgtccaggctgctcgtaaagcctttgagggcgagtggtcggagcttgctgctgttgaccgcggcgcttttctttacaagattgccgatctgattgatcgcgaccgtgagctcattgccgctattgatgcttttgacaatggcaagcccttcagcgcctgtctcgctggtgatctcgacgagtcttacaacgccttccgctactacgccggtgccgccgacaagatcagcggcaaaaccatcgagacttctccccgccaagctcccatacgttctacaggaacctctgggtgtct

SEQ ID NO: 62892 - DNA, 709 bp, Triticum aestivum
  Clone ID: PAT_TA_62892
tgggtttcccaccaatggactgtgagagatcctgttactcgctggtcgtgctcagtctggcgtctgagcctcatgatgcgcaaagagacgaagggactcacgctacaccatgcatggcgcgatcggaatcgccatcttctgcctcgacaaggtcgaggtgttcgctgatcttatgtccgcatccgtagcaagaagaactcacgtaccgccgtcgtagctgccaactgtcttacctaccacatccgttcgagatacgtcccgcatcgccactcagcatgcgcccagatcttgcacgactctcgacatcctgctggacaccaaccccatgctagacaagctacgtgtgcatgctctccacgctcggcgtgatggtgctcctcatctagggcatgacctgaagagccccgctgcggagacgaccgtgaaaacgctgccaggcaggcgcttgagataccgcgtggcagatgtgatcgttgacgcgatgccaggatctcagctcgatgcaattatggatgctgttgccatgtgcatgtgagattccgtgatgataaactactgtagtgaatacataccattttctgcttcttctcatccaacttcattgctggccctctatatgaattcattcatttgttctcatatgacgcatgactaccttcatttgtatctctaacgtatgttgcctggccggttcactcgtgtcaccata

SEQ ID NO: 62893 - DNA, 627 bp, Triticum aestivum
  Clone ID: PAT_TA_62893
tattccttcatcatcgcagacaagatggacgtcgctacgatagaagagacgaaccgaatccgtatctccctgggcatgaagcctttgcccgtgccaggagataacaccacccaaaatgaatcaatgtatgccgatggcgacgcgccaagcaccctcgagagccgacaggctcaggcctacgacaattacaacaaagtgatggaagccgaaaaggccaagaagaagcgtgaagagaaagctgcagccgttcgaaaagcgcgagagcaggcgcaacgcaatgcagtactggaaggcaagggcttcggagaggccgaagaaggtggtgatctcagcgccaaagattggctcattagtcaaaagaagcgacagaagaacatcgccaaagtcagaaagttggaggaagagctcgccactgctgaggctgaagctgctgctgccgctcagtatacttccaaggaccttgcaggtatcaaagttggacacgacactgcgggtttccttgatggcgacgaacagattctcactctcaaagatacaaccatagatgaaaacgaggccgaaggagatgagttggagaacctcgacatgcgcgaggccgagaaactcgccgacagactcgacaccatg

SEQ ID NO: 62894 - DNA, 375 bp, Triticum aestivum
  Clone ID: PAT_TA_62894
caatccccgtcaccgtcacagaaatcagtcaagatgcagattttcgtgaagaccctgacgggcaagaccatcaccctcgaggtcgagtcttcggacaccatcgacaatgtcaagtccaagatccaggacaaggagggcatcccgccggatcagcagcgattgatcttcgccggcaagcagctcgaggatggccgaaccctctccgactacaacatccagaaggagtctaccctccacctggacctccgtctccgtgatggcatcattgcacctccgctaaaggctcttgcctcccagttccactgcgaccagatgatctgccgaaagtgctacgcacgtctccctccccgtgccatctactgccttaaccccaag

SEQ ID NO: 62895 - DNA, 663 bp, Triticum aestivum
  Clone ID: PAT_TA_62895
aaattccaaaagaggcacacccgacccgagaccagaacacgagcaagaaacaagcaacgaagtttctgtttcgagcaaggagtggtagagatttcaaaccagaggttgttagttaacccgagagttgaggagctggagcagtgctgaaagaaatggcgacgaccaagttgtccccgctctcgcctgtgcggccggacgataggcggcgcgcgccggcggcgtcggtggtgctgaaggtgcaggacagcacggcggccgaggcgtacgagcagtacctgcggctgccggagctgtcgagggtgtggaagaccgcgtgctgcccgggctggcccgacgagggcctggtcaagcccgcgctgcaggcgctggagatcaccttccgcttcgtgtccgtcgcgctctccgacccgcggggctacgccagccgccgcgagctggcgcggcggctcgagtcgctcaccgcgcgggaggtggaggtggtggccgcgctctgcgagggggaccggggtgcgccgctggccgagctgagcgcgtccgagggcgtgctcccgcgggagaggagcgcctcagaggtgtggcagctgccggggagcgccgccgcagtggtgtgtcatgccagtgaggccagcttgctcccgcgcctcgccgcgtgggacaagtccg

SEQ ID NO: 62896 - DNA, 667 bp, Triticum aestivum
  Clone ID: PAT_TA_62896
atcttcttatcatcggccatttcttgcctccctcattccttttcctctctccctttcctttctctttggttctccctcgcgtttcgcattacactctttctttctttcttacttacggtgcacctcgacctcttctccaatcttgcctttcatttactttcatctcactcacttgcgctctgaatatcttgactgtacttcatttgcaatactcaccgcgttttgtttccaatgatggcctgcatattcttccccacgcctcgtggtctatctgctccactctctcgttgacattatcttttgaatcacgcttcgcttgccacatacctgcatgaattatctagacagacttataccgcttcactcggtccgatgtcctttcctcattcacctccaaaattcgctctcttgacaccaatcgtttacgcctatgctacgattaaccgcccatcctttatccaaacggactcacctcagattcagcatgcatctttaacactcgaattctccttaatgtgacgaacatcaacaaaacaaccgtttcgacgcgaaacaagatcagccctacatcatccccatgtgatcgggcgtcaagatcgcgccagcagctcctacgcgtatgacctcgccatgcttggctgcgctatcaagcaatatcgtttttttt

SEQ ID NO: 62897 - DNA, 220 bp, Triticum aestivum
  Clone ID: PAT_TA_62897
cggccgctcgaggcggcaggccaaggtttcgagcatgacgttcgttaattaggctgtggcatgagctaggattttcttttcggacatccgtacatactccaaataaaatctgcagtgagtattcgtactccaaataaaatctgcggtgagtatcgtttacttacaagtcatgtaaaagaaaaatctatgaataatagatatatctaaatgatatgtgtcc

SEQ ID NO: 62898 - DNA, 815 bp, Triticum aestivum
  Clone ID: PAT_TA_62898
actgcttcagacttttgcacaagcaactaagtcttctcttctttctttcaggtcctggtgatcgtcttctttgtactttctttatctccttctttgaatcttttatatcattgtgccggcacatttcttcttcttatccaagatgcattccttcaacattcttctttcttcttctctcttcgccttgacccaggctcactctgtcatcctcggtgctcagggtctcgattcctcccccaacagtgtgggattccaagtcgatcccgagattgctcgcaactgcatcaccatcaacccctgccaacaagatgctaccatcatccgcgatgccgagatcactgccaacattgtgaaccagtgtggccgtactgagatctctggaaacatcgatgtcggcgagaacactgagaacgccatcgctgccaagcaggtcactcaggttgaggctggtggtgagcttactgtcactatccaccaagtcaacgccgatggtgctggtccttatgtctgtgatctcgacgagagcagcaacacaaacaccaacatccagaacttgaccgtcactaacaatatccccggaacaaatggtctctctcaagccaagacacaggctttcaacatcaccgtcaagatgcccgatgacctcaactgcttcggtgcctctaccggaaacatctgcactgtccgatgccgcaacaacgctcttgctggcccctttggtggctgtttcgccgtccagcagggcgacaccgacaagaagaaccacactccccagaaacatcagaccactcagaccctgaatggcatcaacgctc

SEQ ID NO: 62899 - DNA, 707 bp, Triticum aestivum
  Clone ID: PAT_TA_62899
ttttcaaataagaaacaaacattgtctcctaatcacatcacatcacatacgccacacggaatgattgtcgtacggagacggaacaaaaaagtcatttatgaagaatagtcgtgcaggatgggatatgcagactatatatggctttgccggcgtctcggtgtgactggaagttacaggcaagcgtttttctccgccatgctttgagccaagtcacgcctgacggcctgttggtctcatccttatctgtcacacgaaaatacctcttggagagaagaacggcagggccacggacgaaagacgattataatatctaagcgcctctttttgtgagagacgtgaacgatgcaaatatttgtgttgtcattcgccatattcttgtccggagtgtgacataccggctccccaaaccctcacctactctgcttggttgccttgctcacttgctgtacctttgaaaacctgttcctttatcgctaaggggttgaatgctggttcgctcatggataatattagataagattaaatgggtggttttaccaaggaagtttgtcgagtagcaacttgttgtattttagtcatacgtttgttgagaacaggtggttataatgtctcaacacgcgatactccttagacagtgacgcgttgtctctttggtttgtttcttagctggcttgatcttggtttccttaacactgttttatttgtcc

SEQ ID NO: 62900 - DNA, 759 bp, Triticum aestivum
  Clone ID: PAT_TA_62900
gtctacaatacacgtcaccaccgaccaaccaatttaccgacacgatggaccgaggaatcaagaagcacgaaaagcgcctcaacgacccctcgaaatggagggattgacaaaactgtacgggagctacaagtttcaaagcagtctgacgggggtctctgagtgtcggcgactgcaatgccccggagctccctcagaccaactcgttggcttcatggtcctcgccgcccggaaaagatggcaatgatggcgcaaagaataagcaaggtcaagcgcgcaaagaaggaagggaaagagaagaccaggagcgaatctaggcagggccgcaacggtgacaacccggctccccattcattatcgcacccgacctaatgtaatagagattgccgattttcagaacaatagagcatacagcctacaatcatgtaggctctcttattagcgtacgcccgggactaactcggatgattcgctggaaatttcatttgtactgtgcccacgggaactgtaatattctgtggacggtcgggctgatccgaatgaaggggcccatgcaaccttactagcagacattacattccttggccattctgataaacatctgtttctccacctcgtagaaccacacaagagaaaaaggcccctagggtcctcgcagcgggcggcattacctggaacgatcactcctaatccaagattttttgggggtcgcaggtgcccgacaacgtcacaatatacggaacacctaaaggggaggccccc

SEQ ID NO: 62901 - DNA, 779 bp, Triticum aestivum
  Clone ID: PAT_TA_62901
ggccgggccggggtgcatgacaagcaccgcacccaacaactactcaaccaatccctccctctcggagttgcctcccacaccgtccccctcgtctctcctcatctcgcctgtgctctccacacgaccacaccaaaaatccagacctgcccgcccgcctcgcctcctcgtctgcctcctctcctgcgcttcagtttccaggctaggttgctgctgttgttcacatggattcctttttccaaagagctttcggcgacccaatgtgctcggaagacagtaatgttgtccaacaaggaattgagaaatgcccattcctgaggaacatcaacgagcctacgagtttttccttgacatccgttaattttcccgctccggcaaccggagccaagggtccaatttttgaagacgggcccaactttgacacggcatttcgagttttccacggcagagacggggttgttccactttcagaaggagcctttgcacatattgagaagcctctgccaaagtccactcctgaatttaaccccttggcagccaaagcagctaccatcagtctctcgggaattcgaggcttttttcagcttcggcgatttctcaaacaaacgcaataagcagaactccaacaagaagaatcccaacaacctcccccaggaataaaggtcagtctaaataactatcctgaagcgatgagcaatgaccggctcgaaaatggaccatgccctcttgcaaagtctatatagcaatcggtggaatcgtgcctcttgtccaaagctgctgaa

SEQ ID NO: 62902 - DNA, 538 bp, Triticum aestivum
  Clone ID: PAT_TA_62902
tttactgaggccaacgagaagcctacccactcagctcctactcctgagaagcccactggtgacaagcccgttctccctcctgtcgccactgtcccttaccctcctcacggtaacggaactgtccctactcctactcctgtggttcctgttgtccctagctcctatgtccctcctgttgtcagcacccctgttgcccagccccctcactctgttgttcctcctcccgtctacgctcctccttctgagattccccctgtggcctctcacccagttagccaacccccggctgttgttcctccccctgctgctggaactcctcccgccactgcccccacccctgtccctgtcagcggtggtagcgtcgtccgaactggccttatgctggctgtccccgcagtcatcgctgtctttatgtagattctggattgaacgatcgattgatatacttgatacatatcgaccatgggcaacattggttaggaattctcaatagttagttcatggttattattaatttataataccttcccatgatttt

SEQ ID NO: 62903 - DNA, 756 bp, Triticum aestivum
  Clone ID: PAT_TA_62903
cttctgacacattcagtagtggacgagccatagaacgtgctatccgcaaacccttcactcctctactaggcgagacctttgagcttgtgcgcagcgataaagaagttcctggaggcttcagacttttggtcgagaaggtccagcatcgacctcttctcttggcaatgcaggctgattcagccaactggtcattctctcagtcacctgcacctggacagaaattctggggtaaaagtgctgaaatcactacagatggccgcgtgagaatcgttttgcggctgtccaatggctccgaagagcgttattcatggaatattgctaccatgttcctgcgtaatgtggtgatgggtgagaagtacgtggagcctgtgggtacgatgcatgtcgtcaacgatagcactggtcacaaagctgcggttgagttcaagagcaagggcatgtggggtggaaggattgaggatgtcggtgtagagatcttcaatcctgaaggagccaacacaggaagtggcctggtaggcacatggaccaacagcttgaagacaactggaaaagggggcggccaggagatttggcgggttggacccctagtagaaaacgctgctaacactttcggcctcaccacttttgctgcgaccttgaacgaggttaccgagatcgagaagggcaaactcccaccaacagactggcgtctgcgacctgaccagcgtgcatacgagcaaggcgcaattgacgatgccgaggatatgaaacaaaagc

SEQ ID NO: 62904 - DNA, 706 bp, Triticum aestivum
  Clone ID: PAT_TA_62904
gaccccctttctattgcttgcagcctcctccttcctccgtccaggccgcggctacgagttcttccgactggccggccggagagtttctcatctcatcgtctaatcgtcggagagagtggtccatcagttgccttcccgcgtctgaatttctcgtacaatccctgtggcctgtgcctacaagatggagaggagagcggcgaggagaagctccgcccaccacagccgaatgcagatgccgccggcgccggtggggcagaagcagcaccagcagacgcagacgcagcgccgcggggggtcgaagagctgccagagaacgccgccgccgccgggctgcttcaccatccagctgctcatggtgttcctctgggtggccgcgtcgctcgccttcctgccgctcgtgctgccgccgctacccccgccgccgctctcgctgctgctgctgcccgtgtgcctgctcgccgtcctcgccgcgctggccttcgtcccgctcgacgcccacagcaacgtcgtcggcggcggctcgtcttgtttgtagagaggctgcattttcttttccgtgtcggtcagagctagttgtttcagatctagcctgtagtacaaactgtgaacctttttttaagattaggattaggattaattaacagaggactactttttggctttgtaatcacttgaattccggcaatgtcaattgagatctcacggc

SEQ ID NO: 62905 - DNA, 647 bp, Triticum aestivum
  Clone ID: PAT_TA_62905
actccaaactcgagcgagataatcccgtctacgccgccaagcctccaacagagccctccaactttcctcgccagcctctccgcttagcaagggtgtgatggctccccgcgccgccgtgctgctcctggccatggccgtggcctccgtcttcctcgcatccgcgtcggcgcagggcgtcatggcgccttcctcggctccttcgtcggcgccgacgtggttacgaggcagctgagctacccgagacagcgtcgcttgaccgcatcggcatctacgatcccaagtctgagaaatggattgctggaaccactgctgcttcgacggagaactttgatcgcggttacgcccctacactattgctctctgtggatgagagcggtgatgtgcgcagtgtgacgctgaagggcattagagtcgatgctgggcagacgagagattttggaccaaaggcgattgtgatcgcagataagaagggcagccaacctgagctgaacaagccggttatactgtcacctggaggtaaaaaggctgaggaggaggaacccaagtcatttttgcaaaagtactggtggctcatcgccattatggtggttatgtctctggccggaggcgagaaatagagtcttaaatatatgcaataaaggacacat

SEQ ID NO: 62906 - DNA, 860 bp, Triticum aestivum
  unsure (1)..(860): unsure at all n locations
  Clone ID: PAT_TA_62906
atctctcaagcagctcaatcattcagaaaacagcagcaacagaactcttcagtaccaattcaacaaactaagaacaatcatgaagttctccgccattctctcattccttgctgcttcgtcggctgccctacccacttccaactctttcgttgcctttgaaggtcgtcaagctggaagcatcactcgcaatgatctttccagcggagcttcttctgcctgtcctcctgtgatcttcatctatgctcgcggttcaacggaacttggaaacttgggcacacttggtcccagagttgcctctgctctcgagagttactatggcagagacaaggtctggattcagggtgtcggtggagcttatgatgctaccatcggagataaccttctccctcgaggaacatccgcagctgccatcagggagatgattgctcttttcaacctggccaacagcaagtgtccttctgcaaaggttgtcgccggaggatatagtcaaggcgccgctctggctgcagccagtatcgaggatctctctaccagtgtccgtgacaaggtcgtcggtactgtcttgtttggttacaccaagaacttgcagaatcttggccgcatccccaactacccacgtgagcgaaccaaggttttctgcaacattggcgatttggtctgcactggttctctaattgttgctgctccccatcttgcttatcagtctgatgcttctggtccggctcctgagttcctcatccaacgcgtcgctgcctctaactaagctggnatgttacagttggaccaagcttctgtaaaagacatgtcagggctggtggaagtggannggacccgggtttcgctttttttttttttttttt

SEQ ID NO: 62907 - DNA, 806 bp, Triticum aestivum
  unsure (1)..(806): unsure at all n locations
  Clone ID: PAT_TA_62907
atttctgacttggttgacatcagcagtcatccagctgcaacctaggctgcaagcttcactggctagaatgacctctcttcacaatctgttgaccgattatcagatcggacacacataaaagccgtgaaagttggtacgacggtaataagtacactgaagatgtgctgctattgagatgaactcagtagcaaacttaccctagagcatcagcaagacatactgaaaaacatctaacccaagtttacttggaataactgcgtgtcagtaataatcaaatgtttttgagtcagttgagaagttgcttgattgtgccaagtaattaagcagatgatttgagcagcacagctgaattaattgaagctgttgatgctgaaataactcttcagaactgcctaaaaagtgggacactgacgacgtctgtcaaagctggctcgcgacgtcgctatcaagctcaagcttcttcaaacatcaaaattatcaatctttgaacatagtctgatctctgcgcaaacaaaagcgtcgcaatactcgctattaacgaagcgaaaaccgaaaactacaaacttgcgcaattcagagactttctataatcccataatcaccgtcgcaagcgcagcccatcacagcacagccatgacagactcgccaccacccacagagcctcgagttcgctcaaagtcacccgcttccagagacagagatgaccgaaagggtcgcaacgacttattccgcngaaacagcgaccgtcgccagcgcagagaacgcagtcggtcgcgcgatcgcaaccagacccgcgacgcagagat

SEQ ID NO: 62908 - DNA, 725 bp, Triticum aestivum
  Clone ID: PAT_TA_62908
actgcctaaaccgatccaatcctctctccgctatctcatcgtcaaattcctcgatcgattgaaagccaaagccctctcgtcctccttcatatatgcagatgcttcgacgaagaccctcaccgccccagaccatcaccctcgatgtcgagtcttctgacactatccataatgtccagatcaacattcacgacgatgacgaaatccctccgaacctctatcgcctcatctttgccgtgaccgagtgctacgatgaccgtaccctggttgactacaacattcagaatgagtccaccctccacctggagatcaggcttcatgaaggctatgcagattttcttcagactctctccgacaagaccatcatcttgtacgtgaaatcctcgaacaccatcaactacgtgaaggcaaagatccactacaatgacgacatccctccgaaccatcagcgcctcatcttctgtgcttagcaccttgacgatgaccgcaccctggatgactacgacatacataacgacttcaccctccacctgatgctcaagcttctgggaggcatgcagatttttgtcaagacgatcaccggtgagaacatcaccctgtaagcggattcctcgtacaccatgtactatgtgaacgtcaagatccatgataaagagggtattcccccggaccatcatcgtctcatcttcgctgtcaagcagctgtgggatggccgcaccctggcagac

SEQ ID NO: 62909 - DNA, 602 bp, Triticum aestivum
  Clone ID: PAT_TA_62909
ttccttatcgccattttgacaatattccaccgcccctttcctttacctcctctgctttgcctctctctgtaactgcctctgcaatgacggcatctactgagttagacccctactcgctcggtgctgcttactaccactgggaccactgccaacctacaaccgcttccacctactctctcgttgctcgcgccccgaatgccaagctctccatgaacggccccaactagacctactccgatgccatcggctcttactgctcacattgcccaccgccatcgttctgctccgagagcgggtctccctatcgacctcctgcccctatgactgcccctgagatcctctccctgcaggctgcgactcttgccccctcaatcccaacgaaccccgatactgactccgagatctggatggtcactgagctgcctttctgccaggcacaccgcaccaagtctttcaagcccatgcccgatcctcgtcttgctatcgtcaccctatggcttacgatgatgcatgcgagccagctactctgacgcggagcgcaccctccatcactatagtagctacaatacgagtaccccaaagatttgaactcaaacaggcct

SEQ ID NO: 62910 - DNA, 560 bp, Triticum aestivum
  Clone ID: PAT_TA_62910
tgtcgccgccagatttgtcgagtcatcactccgtgcactggctggtgatccagatgtttacgagtgcacgtatgtccagtccgagctaactgagctgccattctttgcgtccagagttaagattgggaagaatggtgtcgagtccatcatctcttccgacctggagggagtgaccgattacgaggccaaggcactcgaggcgttgaagcctgagctaaaggccagcatcgagaagggcatcgagtttgtgcacaagcatcagggagctgccgcgtctgtttgaggtaaaggaggagtttaactcctccgtacgaagagaataaaggcaaaatgattgtccctgtcttaagttttgcagcctagagtgttgacatcatgtaggaagggggggtatgccctggagcagctatatttgtcagttgttggtcggtttcttatatgattctagattgctccctgttctggggtcttattttgtttgacgacacattacgcctgctgttcttgtagcctccgaagttgacaaaccgtggaataataataaagcatttctttgatat

SEQ ID NO: 62911 - DNA, 310 bp, Triticum aestivum
  Clone ID: PAT_TA_62911
cttccgctgctgagcatctcttcatcagacctcggacctggagcggaagcttctcagatgatgcgagtatccggctgcaaggggcctctgcgtctgcgtctgagaattggatacacacacccaactgctggacaggttatggatcaagacaactggacagagtcttagatgtgcttgcttgacaaatgtatgagtcagatagggcaggttatgccttagagatagtaatgtaactcgcgattgtggactataggggtggacttgaagaagatagaatcccaaaacggatgtttaagcatggcttgcaacg

SEQ ID NO: 62912 - DNA, 687 bp, Triticum aestivum
  unsure (1)..(687): unsure at all n locations
  Clone ID: PAT_TA_62912
gttcactacccggagccccgccgccgtcgtctctccctctcgctgtttagagccgtagcgccgccagcagaggagggggtgaagaaggccagcgtcaccatggcggacgaggagcagatgatggagaggaaggaggaggccaccgagattgcaccttttgatccaaccaagaagaagaagaagaagaaggtcgtcatccaagatcctgttgatgaggttgataagctggcagagaagaaagccagtatttgtttgcgaggttgacacacaaacgctggctattcctgcaacactaaagcagatgtacatcaaggttcctgttacgcataaagaacactacctccataccttcctactcaccgaggccaatgtcgacaagactgttatcctattctgcaaccgaacttcgactgccgattaccttcaccatctacttcgaatgctggaacatcgagtcacgtctctacactccaaactgccccaaaggcaacgaatcgacaacctggcccgcttccgtgcttcagcagctcgtattctcgtagcaaccgacgtcgctgccagaggtctcgatatccctgaagtcagcctcgttatcaattacgatctccctcgtgaccccgacgactacattcaccgtgttggttcgaacagcccgtgcggggncgcaagggtgaggctgtcagcttt

SEQ ID NO: 62913 - DNA, 829 bp, Triticum aestivum
  unsure (1)..(829): unsure at all n locations
  Clone ID: PAT_TA_62913
atctcctctcacgtacgaaccaaaaccctcgctgccgccgccggagaagaggaggagaagatgggccgcgtgatcagggcgcagcgcaagggcgccggctcggtgttcaagtcgcacacgcaccaccgccagggcccggcgcggttccgggcgctggactacggcgagcggaacgggtacctcaagggcgtggtgacggacatcgtgcacgaccccggccgcggcgcgccgctggcccgcctcgacttccgcgaccccgtccgctacaagcaccgcaaggagctcttcgtcgccgccgagggcatgtacacgggccagtccgtctactgcggccgccgcgccgtcgtcgccatcggcaacgtgctcccgctcgcgtccctcccggagggcgccgtcgtctgcaacgtcgagcagcacgtcggcgaccgcggcgcgctcgcccgcgcctcgggcgactacgccatcgtcatcagccacaactccgacgggcagggcgatggtggggcaggtggccggcggcgggaggacggagaagccgctgctcaaggcgggcagggcgtaccacaagttcagggtgaagaggaacagctggcccagggtgcgcggcgtcgccatgaaccccgtcgaccacccgcacggaggaggcaaccaccagcacatcgggcacgcgtccacggtccgccgcgacgcgcctcccgggcagaaagttggacagatcggggcgcggaggaccggcaggctcagggggcaggccgccgtcaacgcatccaaggacagcagggccgcttagnttcagttagagatcttcatacatatcatcatcgatcag

SEQ ID NO: 62914 - DNA, 649 bp, Triticum aestivum
  unsure (1)..(649): unsure at all n locations
  Clone ID: PAT_TA_62914
attccctaataaacatctgtatcttaacaccttgccaaaccctgaggcttgaagaactcgaaacgtcatatgtaggctatcccgacgtggatcgacatggccgaccatggcggacgagatgacgactgacatgaaggggtggctgaggtggtacgtgacaggctacccgacggcgcgagacgtggactcgcgcgccacctcccacgtcgggctgcgtgtgcgagatgattcgacgggcgccgggtggcaccagagtctgtacctatcttgcgacccgtgcttaccactgacgcagcgagcagatgaagagaacgcggaacgcgcgatgaggagacgaggacgtgtggtgtcttgggagaggcctatggtgaattataactggtcttacatttgccgctgcatgtcagacgcgnacactgtacatgcacactcccgtgcggacgctgcaagctgcagccgattgaagtgaggtgtgaatggagatagcatccgtcatacgcctgcaaacaggaaggggcgtgtggcacagaatccgaccaacccccggagctgggctcctcgtctcacctgatgcagagtagataagaggantttgtaattcggcttcactgccgtactgactgattctctcgggattgtgccgaccctt

SEQ ID NO: 62915 - DNA, 845 bp, Triticum aestivum
  unsure (1)..(845): unsure at all n locations
  Clone ID: PAT_TA_62915
aatccaggatatcccaggccagcttcagtattcagtatcctttctgagggagttcccatcttgtcacagcttgtctatctaccactcacttatacccttggatcccgtcccttgtctgtcaagatgcgtctcctgtcactcctctcagttgtcacccttgcagtagccagccctctgagcgttgaagaatacgccaaggctctcgatgaacgagctgtctctgtctccaccaccgactttggcaacttcaagttctacatccagcacggcgccgcagcatactgcaactccgaagccccggccggtgcaaaggtcacctgcagcggaaacggctgtccaactgttcagtccaacggtgctaccatcgtggcatccttcactggatccaagactggaattggcggctacgtcgctacagaccctacacgcaaggagatcgtcgtctcgttccgtggtagcatcaacatccgcaactggcttaccaacctcgacttcgaccaggacgactgcagcctgacctcgggctgtggtgttcactcaggcttccagaatgcctggaacgagatctcagccgcagcaaccgccgctgtcgcaaaggcccgcaaggcaaacccttcgttcaaggtcgtctccgtaggtcactccctgggtggtgctgtagctacactggcaggcgcgaatctgcgagttggtggaacaccccttgacatctacacctacggttcaccccgagttggaaacacacagctcgctgcctttgtctcgaaccangctggtggagagttccgcgttacgaacgccaaggancccgtgctcgtctcccccctctgatctttggataccga

SEQ ID NO: 62916 - DNA, 520 bp, Triticum aestivum
  Clone ID: PAT_TA_62916
aattccaccgaagcccatctggtttagcgccagaactgctgacatttgaaatactacgagacaagtctctctccgtctctctctgggatacacagcgatgactatggcgaggattgcggaggtgatgttgctgctcatgttcttgatgctgatcttcagcgtccacctcgcttcggctgcgaggctgttggagggtgaaggatggagggagggcgggatcgggacggtgacacggtagctcggcggcatcaagcagtcagggtctagccccccgacgcactgctgctagtttcaccatgcattcattccatagcggctaagctagcaactctgacgacttcgttcgttcattcatcattttggagagcatgatacagaccaccagtgtttgattcatgctgatctattcattgcttctttaattatattgtcctttttccctctttctttgggataacagtgaaggtgtaaattatgataccatttagcagtatatatgatttttttggtttagtcggtc

SEQ ID NO: 62917 - DNA, 563 bp, Triticum aestivum
  Clone ID: PAT_TA_62917
gttttccatacccggttcaagcatccgatctgcgaatctcacgatgatcgcagacgtacagacaaaccatccacagccggcaggatgggtaaggaggagaagactcaccttagcgtcggcgtcatcggcgacgtcgactctggggagtcgacgactaccggtcacttgatctaccagtggggtggtatcgacgagggaggcatcgagaagtacgagaaggaagccgtcgagctggttgagggttccttggagaacggctggggtcatgacaagatcaaagccgagcgtgagtgtggtagtgccattgatatggccctctggaagagcgagactcctcgtgtactatgtccgcgctgttgacgatcccggtcaccgtgatttcatcaaaaatgtgatcgctgggacttcccatggcgagtggggcattctcatcgttgccgacggtactggtgtggtcgagcctgggatatcaaagcggtggccccaacgcgtgaagcaccctctccttagcatttatgggtggaagggagcaacctcattgataaaaataggccttctaggga

SEQ ID NO: 62918 - DNA, 741 bp, Triticum aestivum
  Clone ID: PAT_TA_62918
aacccttccttttaagacataccgacctttcaagtctcaaaacgctccttcacaatggcttctccttcagaccgtcgacccatcgttatctcgggacctagcggtgtcggaaagggtacgctgatcaacatgctcttcacccgacaccccgatcagttcactctctccgtgtcgcatactacccgtaaccctcgtgagggcgagagcgacggtgtccactaccacttcgtcaccaaggatgctttccgggacttgatcgccaaggacggcttcgtcgagcacgcccaatttggtagcaacctttacggaacgagtaaggcaaccatcgaggagcaaacagccaagggcaaggtcgtcgtcctcgacatcgaaatggagggcgtcaagcaagtcaaggcctccaccatcgacgcccgctacgtcttcgtctccccccctgacaccgaggagctcgagaagagactccgaggccgtggcaccgagaccgaggagagcatccagcagcgtcttacccgtgcgcaggacgagcttgcctgggcgcgatcagccgagtttgacaagattctcgtcaacgatgatttggagaagacgtaccaggagttggacgcttttgtatacactgagaagagcgattaaagttggagacaactgatgggaggtatcttcattcagaggagtttggcaaaagtaaaattataaacgaagcatgatagacctgcaatgatcaatgactatatcctt

SEQ ID NO: 62919 - DNA, 792 bp, Triticum aestivum
  Clone ID: PAT_TA_62919
atattcgagcaatccgcaagtcgtcgccatgatcctgaggaacgcccccgtgcggcattgccgccacacaatggcgtctcccatctccagatccatcctcaggcgaatgtccacccaggtcactcctaagaccgaggctgcacctgagatgaaggagtggacgacctctcaggccactgccgctcctccaaagattgtttcagcagcacgaaagaagcagcgaattgtacaggacggtattctatccctcaggaccaactccgcacacgagcacaaggtctcaacatggacgacacccaacaagaactcgaactctgcgaccccggcgacgcctgctcagcagtacagagaatggaagcgtattcaggctaacacacgaagcctcggttcaaaacttgtcaaacgatatatccccaccgaactcgtcaacaacccaccaggacctgaggatatcactctggagttgctgctggcttcgcaaacgcatattgggcacaagacttcactctggaaccctgccaactctcggtacatttatggtgtgcgtcagggtgtgcacatgatctctctcgagaccactgcggcacatctccgacgagcggctcgtgtggttgaggaggttgcttataatgctggtctgattctctttgttggaaaccgtaagggccaaatggagattgttactcaggctgccgagatggctggtgcttgtcacttgttcactaagtggactcccggtggcattaccaaccgagatgtcatcttgaagatggctggtacaaaggtcgtgga

SEQ ID NO: 62920 - DNA, 831 bp, Triticum aestivum
  unsure (1)..(831): unsure at all n locations
  Clone ID: PAT_TA_62920
attcatacggtacttgagttgagatcaccactcgtcctataccatcaactatcggaacagaccaagtattccgatcagctttctccccaggacttcacccgtctactcgtggagtgccggtcatcgcgccggctgcggaaccctttggataccctgcataacccgacatcggagactactcctaagcgcccatgatgagtacacctcagctcagaatagagacagacgccatgaggatgctcatgagcgactatgaagtcacacttgttaacgacaatatgcaagagtgctatgtaaggtttaggggaccgggtgaaactccattctaaggcggaacatggaaggtccatgttgagctgcccgacacgtacccttacaagtctccaagcattggatttgtcaatcgcatcttccatcctaacatcgacgagttgtagtttacccaagtggccctaccagtaatagttctgctcagctaacagcttcaggtctggctcagtgtgcttggatgtcattaaccaaacttggtcgcccatgtttgatatgatcaacattttcgaggtcttcctcccccaacttctgcgataccccaacccgaccgaccctctcaacggcgaagcagcagccttgctgataagagaacccaagagctacgatgctaaagtcaaagaatacgtccagaaatacgcctctaaggaagccgcagacgaagccggagccgagagcgaagatgacgacgagctatcctcagttgccagctttggcgacgacgacgacgagccagcaggncagatggatgatgtataagtcatcctactcgaagtttgactt

SEQ ID NO: 62921 - DNA, 762 bp, Triticum aestivum
  Clone ID: PAT_TA_62921
aattacaaaacatcgcacaaccaattccgagtcctagaatccacatctcatctcctccatcagttccgcagatcgcacgaactctcgttgagcagctcataccggactagctagctagccgcgcgctcatggttttgtctatgaagcactgcagagatcaggcccaggaggtgcccttgtccctctcgctctccctcggcgccatggccgaccgcaccaagaagcagcgccgcggcgtcgctgccggcgagttcgtgtgcaagacgtgcagccgcgccttcccgtcgttccaggcgctgggcgggcaccggacaagtcacctgcgcggccgccacgggctcgcgctcggccttgccgccgggatcaatgagccgtcgtcgaccaagaagacggtggaccagaagcaggcgcaccagtgccacgtctgcgggcttgagttcgagatgggccaggcgctcggcggccacatgcgccggcaccgcgagcaggagtccgccaccacggcgcaggcaccgcccgttctgctccagctcttcgtctagcaccgcactcatttctctcaagttcaatacactagctaggcatatctagttctagtccagatttacaggttgatctatgtgcgcggtttggtttgtacatttgctgcacactagttggccttgatcgttgtccgatcgctcattttattagggagtacatattttaggactcatgcattcgttcattactcatattatctattggtgccttcttgattcg

SEQ ID NO: 62922 - DNA, 501 bp, Triticum aestivum
  Clone ID: PAT_TA_62922
gttccaccgcagctaccacaaagacaagtcaatctcaccgaggagaaggaaggagaagggagaagatgtcgggccgcggcaagggaggcaagggactcggcaagggcggcgccaagcgccaccggaaggtgctccgtgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaggaccgtcaccgccatgacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatccttg

SEQ ID NO: 62923 - DNA, 820 bp, Triticum aestivum
  Clone ID: PAT_TA_62923
gacttctaagagcctctctctcaactctctgcatcccattctcaaccaaatctcgtccacgtcttctgcaacctcctattccatcacgcccgacgactcgctttcaccgattttatcttatcgacttgtcctcccgcgacataacgagcaaccgccatcatgaaccccgaatacgactatctcttcaagctcctcctcatcggagattccggtgttggaaagtcttgtctgctcctgcgatttgccgacgatacctacactgaatcatacatctccactatcggtgtcgatttcaaaatccgaacgatagaactcgatggcaagaccgtcaagcttcagatttgggataccgccggccaagagcgtttccgaacaattacctcttcgtactaccgcggcgcccacggcatttgcgtcgtctacgacgttaccgacatggactctttcaacaacgtcaagcaatggctccaggagattgaccgatatgccacagagggtgtcaacaagctgctggtcggtaacaagagcgatatgtcagacaagaaggtcgttgagtacagcgtagccaaggagttcgccgacagcctcggaatcccattcctcgagacttccgccaagaacgccagcaatgtcgagcaggctttcttgaccatggcccgccagatcaaggagcgcatgggtactaccacagccaacaacaccaagcctagcgtgcaagtcggtcaagggccaggcgttggctcttcttcccacacagctgctgctaaatgcacttatgctctcttttctcggtgagcaggatgatggagtacagccggaa

SEQ ID NO: 62924 - DNA, 580 bp, Triticum aestivum
  Clone ID: PAT_TA_62924
attccggccaggaggcaataccgtacctcctgttttcgaggctgatgaatcaatcgtcccgagacgtacccgcgcggcgaatggtatcagagcgcaatatctcaaaactggtgttaccccgtctgcttctggctcggcatatcttgagattgaatcgcaagatgcttccggtagcaagggaatgaaacttacatgtaccgttcacgggcccaggtctctgccccgatcagcgcccttctctcctcacatggtcctttccacacatgtcaaatatgcacctttcgcgacacgtcaaaggcggggctacctccgcgattcaagcgagcgtgacttgagctcacatctagaggccgctcttcgcggtgccattattgcagaccgatggcccaagagtggtgtggatgttattgtcaccgtcattgaaggggactaggccagggaggtagctgtcgagcagggaagtgaggagtgggacatgatgaacgttttgagcggttgtattaccgttgcagcagctgctcttgctgatgctggcattgattgtgtcgatacggtctcctggaggtgttagcagcgctcg

SEQ ID NO: 62925 - DNA, 794 bp, Triticum aestivum
  unsure (1)..(794): unsure at all n locations
  Clone ID: PAT_TA_62925
atttcacctacacatactcaaattgcatccaacatggctacgcagactatgaaggctgtcaactatcagggcccttacaaggtcacagtagaagacgttgaactgcccaagcttgaacatcctgacgacgtcattgtcaaggtcacgacggctgccatctgtggttctgatctacacatgtacgaaggtcgaacagcagcacagcccggcatcacttttggccatgagaatatgggaatagtcgaacagctcggtgagggtgtcactctcctcaagaaaggggaccgtgtcgtcatgccctttaacgtcgctgacggccgctgccgcaattgcgaagagggaaagactgctttctgtaccggcgtaaaccctggatttgctggaggtgcttatggctacgttgccatgggtccttacagaggtggccaggctcagtacatcagagttccgtacgctgacttcaacgctcttaaactgcctgctgggaaagagcatgaggctgattttattctcctcgctgatatcttccctactggctggcatggtgttgaaatctccggcttccgatctggcgagagtgtcgctgtctttggtgccggccccgtgggtctcatggctgcatactcggccgttctacgcggcgcctcacgagtgtttgttgtagaccgtgttcccgaacgtcttcaagcagccgagaagattggctgcacacccattgacttctcccagggtgacgctgtagatctgatcatcaggccaatgggcgnannagagttgatcgatctgccgatgct

SEQ ID NO: 62926 - DNA, 477 bp, Triticum aestivum
  unsure (1)..(477): unsure at all n locations
  Clone ID: PAT_TA_62926
ttttcgaaagagacgacggtatctttactgttctctcagagcgtgctactgccctgcacaaggctttctctcagatggagggagtcgagtgcgccgagccccaaggttccatgtacctcttccctaccatcaaccttcccgcgaaggccgctgaggctgccaaggcagagggccgaagcgccgatgagttctactgcatgcgtctcctcgaggccaccggtatctgcgtcgtccctggttccggtttcggncagaaggagaacaccctccacttccgcacaancttcctcgctcctggnaccgagcgggntggccgcatcgnnaagttccacaacgagttcctcgacaagtaccgatgaactagcnncnacgataagaagaagttgcgatattgnaaacagggccgactacatccatcgnaggcccgatcctgtggcgncgtccccagaggagtttnnatggcgcgnagccgaagat

SEQ ID NO: 62927 - DNA, 780 bp, Triticum aestivum
  unsure (1)..(780): unsure at all n locations
  Clone ID: PAT_TA_62927
tcttcatttccttccactggtcttttcaaaacaattacaatcaatacgaatcgagaatcaacgaaaggaatactcacactctctttcttctcaatatcaacaaccgaattccttccttactctcactcaaattattctataccagtttcttaatgcttggaaactttatcggggtcaggggccaggattcctattcgaactcgacatttctatctcccacgtctgcgacgggttacagcagctgctctactaccaccaacaacaatcaatatcaacaagaaaacgacgacaacatgcgcaaaggaactcgccctcctccgctgaacctcagcatcgtcccgaggccgcggtccctcccgcgactctcgacgacccctcagcccatcgccagggaggtcactcctttactgacgcccctcccggaagaggctgatgaaccgtccggacctgtccttcgggctgtcaggatcgcggtggatttcatgcagattgtttcatgtctgctcgtcattctgatgctggccgtctttcttgtttcatataccggagctgtcaactcctgccatggtctcaaagcatccgttcttatcgctgctctcgcttgcgacgttggtcttggcatgtggtccatcgtcaaccacgacaagacatggtgcggccccgccgtcctgctaagggcgttcacagtgacagtgctcgtcggtagtttagtctcccttcttgcagtggacggngtcttcccagaagactacacatactggggtctacctctatcacatc

SEQ ID NO: 62928 - DNA, 605 bp, Triticum aestivum
  Clone ID: PAT_TA_62928
atttctcatgcgggatgaagaccagacgcatcatcccaggcactcttatacaggttatctggtgattataatcctttgcattcagaccccatggttgcacaggttgcagggttcacccgtccgatactgcacggcctctgcaccctggggttcgcggcccgggcggtcatcaagtcgttctgccacggggaccctgcggcggtgcgaaacatctttggccggtttctgctgcacgtctaccccggcgagacgctggtcaccgagatgtgggtcgacggccagagggtgcagtaccagaccaaggcgaaagagcgtgaccgcgccgtgctttccggatacgtgctgctcaaacacatcccctcatcattgtcttcggatgcagaaaatggaggaggccggctgtaggagtaggggccgtcgcgccaaggaagaagaagaagaagaagaagaagcagcggtctcggggcaatgaacggccggagaccgagcgacggcggtggagcaggccggctggcacgtctctgtatcatatatcacacattgtgaccagttcagtctaaataaaatgaaagttgcatgtgcatctgctcatgcatcccagcgac

SEQ ID NO: 62929 - DNA, 689 bp, Triticum aestivum
  Clone ID: PAT_TA_62929
attcccgaccaaacgcaccggatcttgaccgatcaaaccattcagtgctcgcgctcactcacgcatcatagccaaattaagcgggaaggaaggaagggagggaggaagccatgtctgccgcggagggagccgtcgtcttcagcgaggagaaggaggcgctggtgctcaagtcatgggccatcatgaagaaggattccgccaacctcgggctccgcttcttcctcaagatctttgagatcgcgccgtccgcgaggcagatgttcccgttcctgcgcgactccgacgtgccgctggaaaccaaccccaagctcaagacccacgccgtgtccgtcttcgtcatgacgtgtgaggcggcagcccagctgcggaaagccgggaagatcaccgtgagggagaccaccctgaagaggctgggcgggacgcacttgaaatacggcgtggcagatggccactttgaggtgacgcggttcgctctgctcgagacgatcaaggaggcgcttccggcggacatgtgggggcccgagatgaggaacgcgtggggcgaagcctacgaccaactggtcgcggccatcaaacaagagatgaagccctccgagtagctcatccactgtgttgtgtttgtattgtgtgtttatgtgtactgacgcctattgtaaaatgagcattcaataaaggaacaaattgtgcaa

SEQ ID NO: 62930 - DNA, 605 bp, Triticum aestivum
  Clone ID: PAT_TA_62930
aaaattacaaaaaaaacgaaaaaaaaaaaaaaaaaaatttccaaaaaaaaaaaaaaaaaaaaaaacccccccccattgaccccgtttcggccgacaaatatcgaatccgaacgtctccgtcacaaatcccccacgatgagacctacacaagcgctctcggtcggtcgataccgccacctcaactcaccaccaaggatgttggaaagggtttctacaagggtaaccgcactggttccatgggtcgacacacaaagcacggaggttacgtgatcgaatggaacaaggtccgaacatatgctgttccacctctgaaggacttcaagcttacacccttcgtgagccgagaagtcaagacacaatcaggagactacaagggccttgaaaagggtccccaagatccttacttctatgtcgagcagtggaagcgatttaacggggttgactaagcggacaacaaacgacgggaatggacttgaagtgggggagagtctagacgaaaaagcgaatctaggacgaagacacgaagtgcctaccaaagacttgggaatctctgtgaggccgtatatacccctatacactgtaatactatgtatgattatggacac

SEQ ID NO: 62931 - DNA, 285 bp, Triticum aestivum
  Clone ID: PAT_TA_62931
ttttacatcaatcacctgccccgtgccaatccttgcaagttgcgaggctgataataatagcattagcacacttggggatttattcatgtgcggaaacgcaactactccatcatcacatcaacttccatctagtgagcccgtcgtcaaatcaaaccatctcatgtcaaagtaggtgggcgtccaggttcggataataacaaggaagggacgtggacgccggacggacgcgctccggacgccagacacgagacgccagagcccaacctaaagtcttcttctatgcac

SEQ ID NO: 62932 - DNA, 837 bp, Triticum aestivum
  unsure (1)..(837): unsure at all n locations
  Clone ID: PAT_TA_62932
atcctgcagaaatacttacgtattctcccctccctgggaattctgttctctctttcccaacatgtgagcctcttgtctcaacgctttgcttgcgcatctacacgacacaaagtaaacgcaacgcaaacatgtggattttacctcttgtcggctacgtgggaacccttttgggtttctgctttttgactctcgctatcgcgtctggtctctattacctgtcggagctcgtcgaggagcatagcgtcaccgcgaagcgcttcctgacgcgtcttatatatagcgtcattgggattcagttggttctgtggctggtggatgggttcccattctttgctacagtcttgacgatcgtctcccatgttgtctatctgggcaacatgaaacgattcccttttgtgaagctgaccgatcctctcttcctggcttcgtgtgttcttgtcctggttaaccactacgtatggttccgacacttttccgatgcccagtcccgtgcctaccagcgtacctcgttctacgacaaggccgatgttcccagcttcgcacagatcgcctcgtactttgggctttgcgtttggcttgtgccttttgcgcttttcgtcagtctatccgctggcgataacgtccttcccacgatgggaactgagcccgtccatggactcgatgngaggggcaagcctcagggtatgatcaaggcacttgttgatcagattcgtggggcaattggtcaaatctttggatccattcatcgcctggacttgctcgaccgaaaaagctgggaagtgattgaaacacatcacagtgcaggctggacgaccgaaatgctcgtctgatctacgt

SEQ ID NO: 62933 - DNA, 836 bp, Triticum aestivum
  unsure (1)..(836): unsure at all n locations
  Clone ID: PAT_TA_62933
ngataccacatagcacaactagattactactagagttcagttcagaccttggatcacacgcgcacacacaagctagtagtagagtactacaagatggccggaggcggagaagaagaggcgaagctgctgggcacgtgggcgagcccgttcgtcctgcgagcgcagcttgcgctcagcttcaagggcgtgagcttcgagaacgtcaacgaggacctctgcaacaagagcgacctcctcctgcgctccaaccccgtgcacaaggcggtgcccgtgctcatccacaacggcaggcccgtctgcgagtcgctggtcatcctgcagtacgtcgacgaggcctttggcgggccgcccctcctccccgccgacccctacgaacgcgccatcgcccgcttctgggcagctttcatcatggacaaggtgcttaattaccggatacacgatgcactactgtgtaattacgttatggatgatgaaattcagtcgagtcggagatgttaacatatgtatgttggcgtcgtacgtgcagctggtggcgccatggcaaaaggtgttcacgactaagatcgaggaggagaaggccgagtggatggagcagacgctggcggcggtggatgtcctggaggggggcctgaaggagtgctccaagggtgggagcttcttcggcggcgacaacgtcgggtacgttgacgtcgtgctgggtggggctgtgccgtggatctatgngacggaggcgctctgcggtacgaggctcttcgataccagtagggtcccgnctcctgggcagcgtggttggagcgcttcggcgcgctggacgtggcccagctggtcatggcgga

SEQ ID NO: 62934 - DNA, 663 bp, Triticum aestivum
  Clone ID: PAT_TA_62934
attttccataaccttcacctttcctcacacgatcagttgcgcttgtctccaattctatcgccatgtctggagactctgctgaggtggcggaggactatcgcctcgcgctggaagacctctcctctaatttgcgcttcgagattagcaacctgactgtcattgctcgcgagaatactgaacacgccctagcgatcgcggaagttttgcagcaacacatcctcaaggcagctccaagcaagaagctcccagctctgtacgtactagactcgatcgtcaaaaatgttggcactccatacactctctacttcggtcgcaatcttttcaaaacctttatggaatcatacgctagtcgatcaacctgtgcgtcggaaaatggaagagatgcttagaactggaaggagcctgttcctgggtctatggacagcagacctgtgttttctcacgagttggtgcgacccattgagaatgcactcttgaaggcacgcgccgctaccatgccccaagcgggaatgatgcctgggcgaccgcgatctgctgtgccccatcgtgataccccgacaccgcctggaatgagatttccaccaggccacccagctcaacaatacacatcaaatggaggacagtcattgagcaatgacattcggaatctaattgttaccacgc

SEQ ID NO: 62935 - DNA, 844 bp, Triticum aestivum
  Clone ID: PAT_TA_62935
gttactttggaacttgacggtgttttgttcacgcgtgtctttgatgcgtacaaggcaagctatggagtcgaggatgccgaatatgccatttctcagctcgcccagacgactatgcgatccgagattggtcaactgacccttgaccatgtcctgaaggaacgtgctgcgcttaacaccaacattaccgctgccatcaacgatgccgcagaggcttggggtgtcacctgcttgcgttacgagattcgagatatccacgctcctggtgccgtcgtcgaggccatgcaccgacaagtcactgccgagcgttccaagcgtgctgagattctcgagtccgaaggtcaacgacaaagtgccatcaacattgccgagggtaagaagcagagtgttattctggcttccgaggcgttgcgcgctgagcgtatcaacgaggccgatggtgaggctgaggccattcgtctcaaggcgtctgccactgctcaaggtatcgatgctgtctcagaaagtatcatcaggggagatgctggtgcccaggctgctgtcagcttgagggttgctgagaagtatgttgacgcctttggcaagctggctcgcgagagcactgctgttgtcgtccccggcaacgttggagatatcagcggcatgattgctactggtctgagtgtctttggcaaggttggccaggctcaggcacagactatggctaaatctcttgttgaacccaagggggactcgcagactgcagagctcgagggtcaggcaaagcccgatgttaaggagacagttctcgagagcttcaaccagcgacttccagcgatagcagagagaagacatgatctatcaactg

SEQ ID NO: 62936 - DNA, 728 bp, Triticum aestivum
  Clone ID: PAT_TA_62936
actctctatccaattcctcctatttctcgatttccccatcgcaacaatggcccaacccggcgtgcaatcattgaagtgtgtggtgaccggtgatggtgctgttggaaagacctgtctactcatttcctacaccacaaatgcattccccggcgaatacatccctacagtctttgacaactactctgctagtgttatggtagatggcaagcctattagccttggcctctgggatactgctggtcaggaggattacgacagactgcgacccctctcatacccccagaccgatgtctttctcatctgcttctccatcgtcagccctccgtcattcgacaacgtaaaggcaaagtggtaccccgagatcgaccatcatgcgccaaacatccccatcattctcgtcggaaccaagctcgatcttcgagaggacgcatccaccctcgagtctcttcgacagaagcgcatggagcctgtgtcatacgagcaggcgctgacttgcgccaaggagatcaaggcctacaagtacctcgagtgttctgctttgacccaaagaaacctcaagagcgtctttgacgaggctatccgggccgttctcaacccccgacccacaccttcaaagcaaaagaagaacaaatgctccatcctgtagatatccctaatcaacgacgtctcgacgacgcgaaacgaaataaagattgaacggatgcctgataagcaaggcatccgataac

SEQ ID NO: 62937 - DNA, 809 bp, Triticum aestivum
  Clone ID: PAT_TA_62937
aatttcgccaatctgggtgtttatgcaggtgtatcgacactcgtcgccctgctcttgacctacggcatcccattgtttctcaacgaatactttccctggcagagcttgtataaacaacgtcacggaaaaccgacagtcacgacaaaatcgtatgagggacgaactgtgctcatcactggagccaacggtgcttttggatcgagggctgccaagctctttgcccaccgcgatgttgacacgcttgttcttgttgacgtcagggactgtggagaactaaagcaggagattgaaaaggaattgagtgcagcgggcaaagcaaaacctaccattttggtctggcaggctgatctgatgaacttttcgggatgtcaagagattgcgagaaaggcaaaggatctcaagacgcttgaccatgtcttgatgacgatggggatcttgtcttttaaccgtcgcgtgtcacccgaaggctgggaaacctccattcaggtcaactacctctctggtgctctcctcgggctttctcctcctgccccttctcaagccttgctcttccaaccccaacccccccgtcatgacctttgtaacatccttcggcatctacccatcctcattcacaatgggcatgcccaagaatggttcttacctcaagatgctcagcaacaacaaggacggcatgcagcaagctcaccaatacggccgctccaaggctcttcttctatacttcacccgcgaactcgcagagcgcgcctcgaagcttccctcacaggtgaccatcaacagcgccgaccctggatctgcatggacgcctc

SEQ ID NO: 62938 - DNA, 746 bp, Triticum aestivum
  Clone ID: PAT_TA_62938
gttccacatattgatcatacctaagcagagcttttactctatcattctgatagtcttgatattactccacgcggcctctggtcaatcggcgtctctgtgacacttaccccccctgcatagacttccacgacaccctcccgctcgacttcgattatccataccgcatgctgtagagctcaaagcagcgatccctcccgaattccgtcatcatgacagacgctgagaagctcgagcctcccaagggcagtcccgttgaggaccctggagcccacgagcttgctgaggaatccgagtccgatgaccaatttatggatgctgcttctggttctggaagccccaggatcagctcgccaattcccacaacccgagtcgaaaaagtcgatgatcaaccttcgcacggcgaggttcccggtactcaggcgtatgagttgcgaggacaagatgctcaacctgacgagatcgcaattgccccagaaacagccacatccggagatgctcccccgactcccaaagtaagccctcccacgacagtcgtagaagaggctcctgagcttcctggagccagaagccgatcgtattccattcagtacgaggagaggcgcagggcagatgcatccccggatattcttgtggcctctgatgggcagatcaaggaaattcaaggcgagagcacaaatgtggaaagcaattatggtacgagagtagcaaagtcctaaacaagcacacaagaatgatcattgaccgct

SEQ ID NO: 62939 - DNA, 766 bp, Triticum aestivum
  Clone ID: PAT_TA_62939
ggccgctcgagggcggccggggcggaatttctcacgtaaaaagggactagaagggatgtcgcctatgaagggtacggttgggcggtgtcgccatggatggcccgggtcctcgtctgcttggaggaggccggcgccgagtatgagatcgtgcccatgagcaggagcggcggcgatcaccggcagccggaccacctcgccagaaacgtacgtatgttactagcttctccggatccggttgagctactgcttatatgattttgagttatatatactcagtcgtttcgaagcaagaatcaaatattgtcaactgcgcgcgttactttgcacggtcaaggtcaaatattccgtccaacaatttcgtgtgtgtgcagcccttcggtgagatcccggtgttggaggatggcgacttgacgctttaccgtaagccatcatgctttttgatttttgagctatgtttttctaggtagctattgtacgaagtaagaaactccctggacctgatgttattatggtgatgcctgctaataatctccaagtcaggcataaaaagtacagctaactattctttttacacgatttcatctaactaatttttctaggcatgaattcatttatattagagttaaataacgttgtgtcgctgatgcaatatttctttccagaatctcgtgccatcgcaaggtacattcttcgtaagtacaaaccccgagcttctgcgagcaggcaacctcgccgagtcggcgatggtggatgtatgcctcgacgt

SEQ ID NO: 62940 - DNA, 854 bp, Triticum aestivum
  unsure (1)..(854): unsure at all n locations
  Clone ID: PAT_TA_62940
atccactcattgcttttcttgaccttcaacttctcttctctagcaagcacactcgattcacccacaagcaatccgtccaactaccaatcacctcaaaacaaacatacacaaccatcactatgttctctgctactcgtgccctccgacaggctgctgtccacactgagcgaacccctctcatcaagttcctcggaccccgaaccattccttccaacctcgaccacacccccaagcctcaccccgcctctggcgctgagaagctccccgagtcttggtccggctacggaaacggcgatgccgccgcttcccacaagaacttcagctcctaccgcgaccacgtccagcagcatggccctctccagaagtctggcttcggtggcaccagcgctgcctccctaggctccgtcaacgcccccaagggtgttgcctttgacctttctgagctccctgctcgcttccaccgtgctcgcctcaacgctgccgaggtcgaggctatcgagtctggcggcgctgctctcttcggttaaatctgtctcccgccacaggcgaggagtcataggtggagcggagggatgaatcagatgggatgaacgaatacctacaacgacacgcagattatggcaagaaccaggacgataccgcctggggcatacatcctgcgcggcgtagtatacgaggacgccaagtggttgtgcacagtgacaaactattcacggtgcatttcgggatgngcacgcaagcctatttcatcgacatacagtgcagacaaggacagagtctccgaactgcaactgcaactcgtccagaataccacttagggcactacgatactatgtcgtcaggagcgtcatgaa

SEQ ID NO: 62941 - DNA, 827 bp, Triticum aestivum
  unsure (1)..(827): unsure at all n locations
  Clone ID: PAT_TA_62941
gtccgctcctcgtctcagctacagaggttgtcgccatgcagcaagaaactgttgtgctttacttgaagctgcaggcttgaaacacgtttactctcccagcagtgacggatacaagactcgcacggactcttatttctctatatcgtcacagttacatccttactgtatcgttcagcccgagggtactgaggatgtctcaaccattatcaagactttagtgcctgacaccacctgcaatctggccgtgcgcagtggtggccacaccgtctggggagctaacaatattaacgatggcgttaccatcgatctaggattaatgaacaagaccacgtatacacaggagacaaaggttgctcatgttcaagctggatcaatctggcgggatgtttatgaagctctcgagcctttcggtgtcactgctgccggtggtcgcacctcaactgtcggcgttgccggtttcttaacaggcggtggcaacactttttatactgcccgtcatggtttcggatgtgaccaagtcgtcaactttgaggttgtccttggtgacggacgcatcgtcaatgccaacaaaaccgaaaacgccgatctttggaaagctctcaaaggtggatcaaccaacttcggcatcgtcacccgcttcgatttacaggccttcgacgctcctctcctttgnggtggcctcgtcacgtacacgaccgaaaccacagatgcccacgtcgaagcttataaaaactggactgacaacatcgagggttaccaagatggatctgttatcccttttggagtatactcctcagctggaaaaatggcatcacggtctcgtatga

SEQ ID NO: 62942 - DNA, 644 bp, Triticum aestivum
  unsure (1)..(644): unsure at all n locations
  Clone ID: PAT_TA_62942
cgactcggagagaggactgatgtcggcgccggcgtgcggacgatgaggaagatggcaaaatgttcttcggctacgtgatgtggcgaaacatgcaaatgacaccgcggaacttacaaacctcaactccgcgtatcgagctcgaacgagaccggatgaaggggagcgaggggacctgaaagggggtcgccgaatctgcaaaagcggatggcgtcgagggaggacatgggcgaagaggtcatgcggtgggtcgccccctacgaggcgaacgacgatctccatggccaggtcccggtagaatatccggaaggtggggaaggctggtttcatcatcaggaggtcaaagaaaagcnactccaggtatcgggaaaggaggggacatgaggtcaagcagaagggccgttactctggatatggcaagcgtagggtgaatgagggaggaaaggctccccaccaagatcctggggatgaggaggatgcgggacctggggggccttctggaaaagaaccgggaggccaagaagaacgaccagtttttgaccatgacaatgaaaagacaagtttatgggtaacaggttcaagaaagagaggggccttatggaggagactccacaaaactcaaggtgtgcaaaggcaaaagagaagac

SEQ ID NO: 62943 - DNA, 658 bp, Triticum aestivum
  unsure (1)..(658): unsure at all n locations
  Clone ID: PAT_TA_62943
ctttcaaaaaaagggagggnganaaaaaaaaaattcccaaaaaaaaaaaaaaaaaaaaaaaaaaaaaaaaaaaaaccgttttttcctcctcctcttccaccccaaagtccaaagctatggcgctcgccaaggcaaaggaaatcgtcgcctccgcttccgtcgtcgccttcagaaagtctaactgccctttctgggtcaaagggaaaaagttgctcacacagtttggaaaaagtttaaaggccgttgaaatggacactgaaagcaagggaactgaaattcattcagctcttgctgaaagaactgggaaaaggactgttccaaatgtcttcaacaaaggaaaaaaaatcgggggctgggacgaaactattgaactgaacaaggtaggaaaactggttgctctgctaaaaaaggatggaaaaatctccggtacttcttaaaaaacaaccgtcactgcttaaatttgtttgaaaattgttgggatcaaaatgtaagggggaaaaatgaaatgaattgttcccgggccatgaaaaaaccaagttggatgggtttggaaaagtacagggcttgttatggacaaaaatgcccgaaaaaactgtaaaaacctaaggaaaaactcgtaaaaaaaaaaacaaaaaattttggggaaaccatcaacccc

SEQ ID NO: 62944 - DNA, 487 bp, Triticum aestivum
  Clone ID: PAT_TA_62944
aactcaacagcagagagcgggggtctacgggtttaccggcaacagcgacagctttggtatagattgtacaaccgacggatagcacaccattgtcgaggggatcctgattctccaggccgccgctgaacatgctaatacctctcacaggctaacgcctgcatcacgatatgctgcgacgactggacgaacttctccgcctccacgagctgagacaacagaccgactaagcgcagcgcaagatcgcgcgaactgccgagcttcggagactagacccagcaagactcccggtgcgccgaagtggaggaaagacggacgccctgacctcccggaaacaaggaccgatgacacatgcgcagaaattaagaagccgcctccaactgaatgcactcggaggatcacgagcgtagtcatggtgtcggccttctgcgaaaggaacaccacgcctcgtgaaaaatggtagcgtcacgtgaagtgaccatcctgatct

SEQ ID NO: 62945 - DNA, 369 bp, Triticum aestivum
  Clone ID: PAT_TA_62945
gccgctcgagccggcgggcgggaatcggatagggggggaaaaaggatttcaccaacgcttccgtgtatgctgcacatcctccctctttttctcctcgctgccggcacccacgccgccacgttcaccatcaccaacaagtgccagttcaccgtgtgggcggcggccgtgccgtccggcggagacaagcagctggaaccgggggcgcagacatggaacatcgaggagccggaggaaacgacgggcgaaagagtgtgggagtgcacggcgcgcaacttctacgaatacgtcaactcgccagtgccacacggaagactgaggcggagtgctgcagtgcacggtgtaaggacaggagccctccacgctggacga

SEQ ID NO: 62946 - DNA, 346 bp, Triticum aestivum
  Clone ID: PAT_TA_62946
agagggaggaggttcggcagtggcccaaggcccaagtcaactgggaggccggagaaggggatggagaattggggagctcctctccctggcaaagcgaggcggcgacaggaagatggaggggatcgagggagagaagagcgagggagatggggcgctgggtctggcctttggcggcgcgaggggagaggatgagggagagaacgaggggatgggggtctcctggcactaggttacaggaggaggaggcccggcctggtgggctgagaggaaaagaatgggccggcctcgttcggcttcctcttctcccactggattttttttcagcaaaaaaaaagaattagagaga

SEQ ID NO: 62947 - DNA, 350 bp, Triticum aestivum
  Clone ID: PAT_TA_62947
cccacgcgtccgatgggcgcagccgcggccggagccttcgccctctacgagaagcacgaggcgaagaaggacccggagcacgcgcacaagcacaagatcgaggaggaggtggctgccgccgcagccgtcggcgccggcggcttcgtcttccacgagcaccacgagaagaagcaggaccacaaggaggccaaggaggccagcggcgagaagaagcaccaccacttcggctaggtcgccgtcgacgtgcggtggccggcctcgccgccggccgtgcgtgtgcctacgttacgtgcgttccataagtgagagaggctgggacgtgggcctggtctcgtgctcgcctgtgcgtg

SEQ ID NO: 62948 - DNA, 247 bp, Triticum aestivum
  Clone ID: PAT_TA_62948
cccactcgtcctgtggggacgacttgagatccatttgtgaatcgattaatttgggcgctgttgatgagccaggcagctagcgctactactagctttgtatggaatccgctttgtatgtacatgtaccaccattgatcattaattgcttgagtttgacatgtcaaaaaaaaaaaaaaaaaaaaaaaaaaaaaaaaaaaaaaaaaaaaaaaaaaaaaaaaaaaaaaaaaaaaaaaaaaaaggctcatct

SEQ ID NO: 62949 - DNA, 365 bp, Triticum aestivum
  Clone ID: PAT_TA_62949
gtttttggtgctatgacggatgaggaattcttttcagcttgcactgagaatgatactgagagtgaggggttcgatgatgtactgactgacgaggagaagaggcagctggaatctgcgcttaagatggattcttcagatgctgttggtgacagccagtccgacacctttgtaggtcctaagcatagttgctttgagccaagggagagggaaataccaattgaggatttgagcatctctggaaatggggagagtaagcatgataagaaaggctgctttagtaattggggaaagaggggtcaaactggcattagtaaactagagatgacacagaagatggcacctccaagaagttcgctctgtgtaga

SEQ ID NO: 62950 - DNA, 125 bp, Triticum aestivum
  Clone ID: PAT_TA_62950
cacacgcgggcagtcacacagagcaaaactagcacgtcaggggcgggcgcaaatgatcagacacggacatgagttcaataccattgccattgataatgattcatacttgggcatggaccaccctt

SEQ ID NO: 62951 - DNA, 155 bp, Triticum aestivum
  Clone ID: PAT_TA_62951
ggcggatctcattctccagattcaagcccacttcgaggcaaacataaccaatttggctcagctatgaggtgttgccatgcaagttgacaaaactcggggatctaaatttggttaagagctcagcgggctgaatatgcactgtgactagtagtatg

SEQ ID NO: 62952 - DNA, 344 bp, Triticum aestivum
  Clone ID: PAT_TA_62952
cccactcgtccttggacgcgtgggctacgacaacgtcatccccgacaactacaccatcggcaccacctatacacctcaagggtagcgcgtccttccattgacgtagatccgcaaaagtatgttcaatcggtcttccctgggttttggtagttttttagagagatatcatgtatgaataatagaaaaagttgtcgacgccactcttgactggttgtttatgtatgtaactgtgtcggtgctagggttatggagtgtgtgttgatatgggctagtgtgtccctgtgtgggtaagcatatgcgtttgtaccgtgtttctaaaaaaactatatttgcttaagattgag

SEQ ID NO: 62953 - DNA, 377 bp, Triticum aestivum
  Clone ID: PAT_TA_62953
aagctggctgagcacggcctcctcttgggtttcctgatgctgctgcaggggggcgtgaagcatgcggcggctaagccacgggagtggtacgtcggcgaccagaagggctggaccttcggcgtcgagggctggcctaacttgcctaccttcaagcccttcagggaaggcgacgtgctggttttcaagtacgaccgtgcggcgcagaacgtgatgcaggtggacgacttcgggttcggcacctgcaccaggcaccccgccaacgccacggtgtacgactccggcaacgaccgcatcaggctctctcgcggactcatcaacttcatcagcggtgtctcggataactgctacaagggcggcgtcaagatctcactcaccgt

SEQ ID NO: 62954 - DNA, 336 bp, Triticum aestivum
  Clone ID: PAT_TA_62954
cccattcgtccgcccgtgacaatgcctgaaaaagagattgacgatgataacagtactctgcccaaggaggtggactggaggaagaaaggggcggtggtgccggtgaagaaccaaggcggctgcggctcgtgctgggcgttcgcggcggtggcggccatggaggggctgaaccacatcaagaatgggaagctggtgtcgctgtcggagcaggagctggtggactgcgacgcggaggcggtggggtgcgccggcgggttcatgagctgggcctacgagttcgtcatggacaaccacgggctcaccaccgaggccagctacccgtacctgggcgtcaac

SEQ ID NO: 62955 - DNA, 147 bp, Triticum aestivum
  Clone ID: PAT_TA_62955
ctgttatgcaaatcctgtaaagattgactgactacataaccaatttgtcatagaacaatgaggcaagatgcattctttggatgtactatctgaaattttacaaagtaactacagaacagatgacgcaatgaagtacatctactaatc

SEQ ID NO: 62956 - DNA, 170 bp, Triticum aestivum
  Clone ID: PAT_TA_62956
tcggatgtttgtttacttctgaagctacttcgccctttccaaattacttacagcgtgctcggcagtatgagggaaagggaatggaaggttacaagagggagtatgtctagatattagacttgagaattactagaattttagtctcaatctccattttgatgtgtggtcgg

SEQ ID NO: 62957 - DNA, 106 bp, Triticum aestivum
  Clone ID: PAT_TA_62957
cacagaccaaacgcagtcttttagcttgtatagggcacacgacggtcggatcacagtagggaccaagaaccataggtggacgacaaggcgccgaagcccaaaacaa

SEQ ID NO: 62958 - DNA, 131 bp, Triticum aestivum
  Clone ID: PAT_TA_62958
cggttctcgtgggctcatttcttaaaatatcccatatatgtagggggaaaccgaggaagaggacagatctatcctgatggtagcaagagtaacaatacagtctataatgctacgtcaacaggtatagtaag

SEQ ID NO: 62959 - DNA, 104 bp, Triticum aestivum
  Clone ID: PAT_TA_62959
attctctcttcgagctcatgtatgattactttcatttgtatgcatagtgtatgtacgtatggtgtcgatttacatatggccccgtgattgcttcttcatcgatc

SEQ ID NO: 62960 - DNA, 252 bp, Triticum aestivum
  Clone ID: PAT_TA_62960
gtgtttggccgcttgtgggtttatatataaaggcagacaggcgccgcagagcgggcgcgtgcgagcgagacgaagatcgatcgagccatcgagggaacatgtcctctgcacgttttgaacctttgcagcgttttggatgccggtcgtggaccgaacgtttattgttttgttttcagttgtatcccgtttaaacctgatgcccgagggctttattattaatttaaagccggacgtttctagcgtctccgttcc

SEQ ID NO: 62961 - DNA, 400 bp, Triticum aestivum
  Clone ID: PAT_TA_62961
cccacgcgtccgcccacgcgtccgttttttccctcctactaaaataatgatcagtaaaatcaaaataaatacttggtaaataaatttatttggcaacaaacattgttgaatgttctgtgtaccttcattttttcctgaagaaaaacttagtaaaaacaaaattttaaattatatttactttttttatattattgttcatggcctgcatttgacccgcgcaacagaaacttcacgcccgcaaaagcgccaaagtggtgatactacattgactggataaaaattctttgtgttgtgtccctcttctttttttgagaacctgcgttgtgtcatcctaaacaatcactcacttcaagttttcaactgctactatgaaagaaaaaatgcgcacccccagaccaaa

SEQ ID NO: 62962 - DNA, 187 bp, Triticum aestivum
  Clone ID: PAT_TA_62962
cccacgcgtccgcaaaaatggtggaccacatatgattattagattaggttagaagtagccagattgaggggtggggttttttcagattcttattagattagtagtggaatttctgcaattctttaggtgtttggagtcaaatatatacttctgcttgatgattaattaaatggatgcttagttctaa

SEQ ID NO: 62963 - DNA, 423 bp, Triticum aestivum
  Clone ID: PAT_TA_62963
tctccattggcttcggccccgccctcgccagcttccgcctcggcgccgtcgagtacgcgctccgggccatcccgctcggcggctacgtcggcttccccgacgacgaccccgagtccggcttcgcgcccgacgaccccgacctccttcgcaaccgccccgtcccggaccgcctcctcgtcgtctccgcgggggtcatcgccaacctcatcttcgccttcctcatcatctacgcccaggcggtcaccgtcggcgtccccgtccaggcgctgctctccggcgtcctcgtccccgacgtcgtgcccggctccgccgccgcgcgctccgggctgctcgccggcgatgtcatcctcgccgtccccggcgccgcgccggacccatccgtgccggccctggtcgacctcatcaaatccagccccaacaaga

SEQ ID NO: 62964 - DNA, 396 bp, Triticum aestivum
  Clone ID: PAT_TA_62964
tggacgtatgtacggccgcctgggcccacacctggatggagtcctgaactagctcgcagcgttgtgtatgtcatgggacgcagagcaaaccgccgttctagccggaggatactatttgatcagtgctagccttggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatctttcgtgagcacaacgcattctctgggtactacgatggccggtactggacaatgtggaagctgactatgttcgggtgcac

SEQ ID NO: 62965 - DNA, 194 bp, Triticum aestivum
  Clone ID: PAT_TA_62965
gagcaatttgttttcctgaacatggctgtagctgtgcgtcaagctcaaaccatttgtttatcttagttttgaacaaaagaaatcttattgtcttatgtaaattctgtttaccgatgtagttggatgctaccaaatggatctttgaatgttgaaatactgatgttttgagtcattatgtgtttgagatccggtac

SEQ ID NO: 62966 - DNA, 436 bp, Triticum aestivum
  Clone ID: PAT_TA_62966
gcgcaatgtctggtacccatgtacgtggcgaccaagatggcctcgatcaggcaggcgtccctgttcgccccgtcgccggagacgtacgcccgcgccgccgtgcgctacattgggtacgagcctcggtgcgcgccctactggccgcacgctctactgtggttcctcttctccgtggtgcccgagcccctcgtcgatgggtacgtcctcggcatgtccctcggtatacgcaaaatgggccgcgccaaggaggccaggaagaaagcggtgtgacacgcgcggtggaagaaagggcacgtacggtcgtaaagatggactcagatgaatgtgttaattctacaatcttcatgaccaattgtaacacgacgaacgactgaatgcagcctcccttgcccttccaaacagttttatctgtattaagacttaattcgtgatattt

SEQ ID NO: 62967 - DNA, 244 bp, Triticum aestivum
  Clone ID: PAT_TA_62967
agtttatacagatgcaataatatggcacacaaaaaagaaggaagtagcagctatttacaagagcctcgcagtgtgcaatatagctacgagatcctattgtctgttggaatttcactttagaacggttggttttattcttcaaacagttagcctagaagaagatacacttgtaaggcacatacataaatacaagttcaatatgtggtctgatcaaatacatatagcctacctgatactttcgatc

SEQ ID NO: 62968 - DNA, 314 bp, Triticum aestivum
  Clone ID: PAT_TA_62968
cggtctctttgggtgtcggacgatgactccgacgactccgacagcccgccagggcccgccagctcgccagactcagactcgccagctgactcgcctgaccccgccgcagacgacgaggagagcggcagcgtcggcgtgaggagtggcgtggtggcttccgtcgtggccgtggccacctcagcctccgtcgtgcttttattttagaacatcgtagcgatgtcaaatgtactacttaggttgtagacataaacttttttggcaatctgtactcagttttgggtgaaatttcaggcgcgggtgagtaattatgtggc

SEQ ID NO: 62969 - DNA, 252 bp, Triticum aestivum
  Clone ID: PAT_TA_62969
gttgtgttgcaatttccccatcttttgtgctgaaccttagttcgtggatggcagctttgccccattaggcatttagactaggtgagttagttgtcttttttttattttctcccttttatgcaaccttggatattttgtgacgaaggtgttcagcgaacctcatgtttcgatgcacgaacccaatgtctacccccaggaaattcaatttgtatgaggtagcgaatcatgaatcaggcaactatgctcataatc

SEQ ID NO: 62970 - DNA, 472 bp, Triticum aestivum
  Clone ID: PAT_TA_62970
aaattattgaaaggggatatcaccatgttgagttcaattctaaatgttattgcatctacaatgaggttgtctatgaaaaggaagatataccaaccgcattttaccttgtccctccatggcatatttaagttgtgccaagctattgatggcaattcaagaagtatcgaacttaagccatcaatggagcttggtactgatgtcgtccttatgaacggtcctctgccaattttttctgaaatggataagtcaagaactgtgatggttgtttcctgggtaacttccaatatcttctggttgtgtaaacaaaagtctgcagcggaaatgtcatgtgaagagccactaaacaatgagtgtctactatcaaagatattgcgttggttagtggcttctgtaatccttggcagaatctcccgcatctctcctgaaaagaggggaggtcttgccacgagcacaaatagtcccggaactcttc

SEQ ID NO: 62971 - DNA, 328 bp, Triticum aestivum
  Clone ID: PAT_TA_62971
cagctgttgctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactatacatgtgtcgtctgtggtatgcatatatcatcaccttctttttcttcttcaaaaaaaaaaaaaaaaaaaaaaaaaaaaaaaaaaaaaaaaaaaaaaaaaaaaaataa

SEQ ID NO: 62972 - DNA, 194 bp, Triticum aestivum
  Clone ID: PAT_TA_62972
gctttttggctcggccaggccggcgtcgagatcggcacgtccgtcggcggggccgtgcagcacgccgtgcgccagctgcccgtgcccttccggggcgcccagatccgtcgtcgcaagctgcacccgcccccttctgcggacggggccgtcggcctcctctcctcggagagggccgtcgatagatgccctctcga

SEQ ID NO: 62973 - DNA, 418 bp, Triticum aestivum
  Clone ID: PAT_TA_62973
ggcgtggtcggtgggctgtggctgctgcagctgctgctcctgggctgcctgtggaggcggctcaagtcgaacgggcggcgaggggacgcggtcgcgagcggcgacggcggcaggtctggcaagagcgcgtccggctccggcggcgtgggaggggagagattcctagtgagtgacatatccgagtggctggacaagtacagggtgttcaaggtggaggagctgcagcgcggcaccgacggtttcgacgacgcgcacctcatccagggcagcgtgtacaaggccaacatcggcggcgaggtcttcgctgtgaagaagatgaagtgggatgcctgcgaggagctcaagatcctgcagaaggtgaaccacagcaacctggtgaagctggaggggttctgcatcaacacggcgacgggcgact

SEQ ID NO: 62974 - DNA, 152 bp, Triticum aestivum
  Clone ID: PAT_TA_62974
gtatcctcaaaatcttggagtgctccggtactctgtctgcaaataccacttcaaaagtggtaaaaaattcaagaaaaatggaagacagagacacaacatgtgtcaactatgtcatgtgttgaaatccaaattccaatctcaaatctagaaac

SEQ ID NO: 62975 - DNA, 386 bp, Triticum aestivum
  Clone ID: PAT_TA_62975
agaactgaaggctagaagagcccaaagatttcttggagactcttctccaatccccctttcccctccatggccacgctccagcacgctctcctcactccgtccccgctctgctgctgctcgcacgctctcctccacccaagggccaggaagatatctccgaggtacccagatggggccttctccatggcgaagccattcttgcggcgcgagctcccggagaggggcggcaccttggcgcggagaatggcgggcgggcggcgccttggcgtggccggggccgggaaaggccccttctttggcggcgggcggcggcagggggggaccggccgcggccgggtcgtggcgaacctcgccttcgtcgccctcgtggcctacctcgtggtgag

SEQ ID NO: 62976 - DNA, 104 bp, Triticum aestivum
  Clone ID: PAT_TA_62976
cacaaacatgtgcacaactggtacttgtaataatggatgatgccaataagattgtgaaccttaattcatcaggagtgtgactgaatttgcaagtctgcttcatc

SEQ ID NO: 62977 - DNA, 145 bp, Triticum aestivum
  Clone ID: PAT_TA_62977
cttgtagtggttatcatttgttcaatactattggtactgaaatggtatttgcatgtgtgtctgcgcaaatagagaatagtgatgaaccctttaggttattcagtgtacaaggggattcgagcttctatgtgattatattgtaata

SEQ ID NO: 62978 - DNA, 414 bp, Triticum aestivum
  Clone ID: PAT_TA_62978
cgcccttcccctctcttccttcctcccccgtcgtcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgagtctgcccacccttacgtaatgcccagaaaatgataatctatctatctacctatctgtgtcgcgcttcactatctgtggctgtaaaagactaccttcagctgtgttgagcattaagcattgtcgcagt

SEQ ID NO: 62979 - DNA, 344 bp, Triticum aestivum
  Clone ID: PAT_TA_62979
gggtaatagaactatatagtgttggggggggggggggtccaaggtttaaattttggggcacatgaatatttcagaccccaacctaaattattagagcaaaatttatcatattttttaccaagaaaatgtttttagtatgaatttaatttgaatctagctagtccaaattgcatatagaaaagtatattttatttcctatgggaggtgccgatgaaactatttatatgtgtatggaatctatctcaagaaacttggaactcttgattatcagctattcttgctactcctaagtgtaggcttacaccacatagggcaaatttagcaggtttgaaaagcaattcaca

SEQ ID NO: 62980 - DNA, 134 bp, Triticum aestivum
  Clone ID: PAT_TA_62980
cggacgcgtgggcggacgcgtgggtggtactggatgatgaatgtacctgagttatttgtttgccagatatttatccgaatgaggctcaacctcttaacttttttgctctgtgggttaaaagatctcttttatca

SEQ ID NO: 62981 - DNA, 298 bp, Triticum aestivum
  Clone ID: PAT_TA_62981
tcgcgcctcgcctcgcctcggctcggctcgtgcttgtgtaccatggatctgatggattcccctctatctatgcttctgttgatacttgatcgttgtacttcgtatcagtaattggaaagatgctgcatgcatgatgcatgcaattactgtaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaatatagaaaaaaaataaaaaaaaaaaaaaataaaaaaagggggggccttt

SEQ ID NO: 62982 - DNA, 399 bp, Triticum aestivum
  Clone ID: PAT_TA_62982
cccacgcgtccgcccacgcgtccgcccacgcgtccggtgtgtgtactacgtgagcgtgagcagctcggcacggacgtccgtacgcgcgtgggggtcacccaccggggcacgcaggcagccgctgacgagggccaggccggcacggtggaccagcggcgagcgggcgcgccactgtgcgtgacacgcgtgcacatgcatggcgttcgtcgtggggcgctccccaacgggcagaagctgccgtgctgtggatctgtgttcgtgttggtgttcgtctcgtgatgtgtttgtttggttgtgttcggcgcgtggtgtttcttctcttgtcatgagactcggagcgtgtgtatggctctgttcgtttcatcttctctgctgtaatatatgagcgtttcatgtgca

SEQ ID NO: 62983 - DNA, 409 bp, Triticum aestivum
  Clone ID: PAT_TA_62983
atgttggctattttcacgctgtctgacaagcagattaaaaaagtatattgttattttcgaagtttgagtaaaccattgcttcctctggggtctacaatacatataactcactatagtactaatactatttttaccacatcgaaaaattttatgttgagaaggagatccgcaaggactcggccaagaagacggacaaaaagtcgcgcgtcaaggtgttactcaagctcgtcaacttcacccacctcatgcccacccgctacaccctcgacgtcgacctcaaggaggtggcctccggggcgcccgactccctcacctccaaggacaagaaggtgggcgccgacaaggccgccaaggccaagctcgaggagaggttcaagaccggcaagaacaggtggttcttcaccaagct

SEQ ID NO: 62984 - DNA, 472 bp, Triticum aestivum
  Clone ID: PAT_TA_62984
gcgctctccacgctcgtcccgggggtctcctacatccacgcgggccccgtgctccgcctccgctccccggccgccgaggcgctcggccccacccacctcctccactcccgctacgccaccaaggccgacctcgccgcctacgcgccgcacccggcccacgtcgccgccgtgcaggcgcacgtcgcccccaacgcgctcgacgccaccgccgtcgactgggtcaacgccgcgggcgccccgtcccccgtcggccccggcgccgccgtgcgcctcaccctcgccaaggtcaaggagggcgtggaggtcgggcagctcgtggagaaggtggccgccgccaccaaggacgccggcgaggccagcggctccaaggtcagcttcggggagaacttctcccccgcgcgggccaaggggtaccagttcgggatggtggccgtgttcggcagcgtcgaggagctggacgccgtggagggcg

SEQ ID NO: 62985 - DNA, 241 bp, Triticum aestivum
  Clone ID: PAT_TA_62985
ctcagcgaggcgcgcgaccgccccgttgcagatcatatggcggctgaagcggttcttcaacgtcggggacgagagaaagctccgggaatccgtgcgcctcgtcgacgggttcgccgcggaggtcacccggcaacgacacaagctcggcggcgccgcgttcggcagcgacctcctgtcgcgggtcatgggctccatcagcgacgagaagtacctcagggacatcgtcgtcagtttcgtgctc

SEQ ID NO: 62986 - DNA, 299 bp, Triticum aestivum
  Clone ID: PAT_TA_62986
tcgggggtcgtcgctcatgcagctgccggcagggaactgccgtgtcgacccccggtgcgacccgccgggcggcatggactgctcggcgcacgccgtggagttcgattcaacactggcgcggtccggtcttttaagatcttaaccgattcgtggtgctcgtcgggagcgttcgacgtggacggtatgctggtgcaaacgggcggctacttcgaaggggtgaaggttgtgagacgcctgaacccacaaggaaatgccgactgggtcgagtttcccaataccttggccgaaggaagatggta

SEQ ID NO: 62987 - DNA, 309 bp, Triticum aestivum
  Clone ID: PAT_TA_62987
tcgggtctatgtcatccctgcaaatgatgccaatgttgattgatactgttaatgcttttgtgttggtgatagtgctttcatttgttgttggttagtgaatcgttggtgagggcagtagtgatgttgtgttagttagtgaattgtctgtgaagttttctgcttttcttacaaggataactgattccttgttaattagttgactactacttaactcgcataatgaggaatgatgcatacttttgatgcaagactgaataaataatgtaattgtgttgtgtcgaatttatgttcattggattttggactcct

SEQ ID NO: 62988 - DNA, 369 bp, Triticum aestivum
  Clone ID: PAT_TA_62988
agcgtgataaaatactgattctttttctagaagattaataaacaaatttctcaggttgtcctaatttttcaaaaaaattggagttgcagaagtattcgagagttacagattactacagactgttttgtttttgacagattctgttttcgatgcatagtttgtttgtcttatagtttatatggcttatattgcttaatataaattgtagaattgatagggtacagtaggcatcatgtgcgaaaaattatgaatcttatcttgacagtacctaagtggtgatttgctttattatactaacggagcttacgagttttctgttaagttttgtgttgtgaagtttcaagttttgggtaaagttttgatggacta

SEQ ID NO: 62989 - DNA, 390 bp, Triticum aestivum
  Clone ID: PAT_TA_62989
gctacgcaaatacctgaggcatgagcagaggaagagcctgagaagattcatctcattcgtccatggcaaggatccaccaaagaacgacgagaggcggtccatgagcctgcttggaagctcgacgccggcaacgccgatgagcagccttactacccttgagatagaaaggccggccatggaagtcagaaacaccagcgttattgaaatggaaagctagttcatgtgtacaaagctagttcgtgctttatctcccaaagcagcggggcaactgttttgtgtgaagcaacaatgcggccgactaacctaggtcccggtaacctaggttggaaagccaaacaccagggatgtatagagggggttcaaatacttcttaaaggaagggttgataat

SEQ ID NO: 62990 - DNA, 274 bp, Triticum aestivum
  Clone ID: PAT_TA_62990
attgggtagttcgtcttcttttgccatctgaggatctgctagactctgatgctgccttcatcataccgcatcattcgtttcgttccacaattttgagagctcagttcgttaatagcttagcaaggttttgttcgcaaattttgttcttgccagatacggtttatatcctttttatgtcttgtcttaatacacctgcatcgttcaggtgtccctagtagagatgatcagaggacgacttgtgtccatctcattcattacgaatatttgcccttcc

SEQ ID NO: 62991 - DNA, 431 bp, Triticum aestivum
  Clone ID: PAT_TA_62991
cccacgcgtccggccacgcgtgcggctcccatcgagagaactgaggcgtctcttgcttcagaatctcataatcaagtgcaagctgctccatttgcatctcaagatcctcacggtctttcttgtacagctcgatctcatcactcagttcaagaatcttctcttgtagttcagaactagcgacgccatcactcttcttcaccaatgcatccaacataagctcgtcttctttctcttggtacgagcttgtttcagacatgtccatcttgtgtccagcactgtgcacatttgacagtgcatgctcatattctgcctcctggggatcctctactgtttcttcttgcaaaatggacatatctctattcttctgctcgagcatttcatcaagatccttcacagccagaagcagctcagagttggactcctgcattttc

SEQ ID NO: 62992 - DNA, 323 bp, Triticum aestivum
  Clone ID: PAT_TA_62992
tcttcacccaggatatgcagggggaggaggacatggagcggccactgccaagggaacggccgctctatttacccttattgtcggtttcacttgcctagcctagtttgaagagtttcccgggggtggcgaggagtaccggcatatcgagtccctggtgttttcctctacgagctggggagggcgtgtggttctctcctcgattggaacgaaaagaagaaactacagcgtcacataactgcagcaaagaaggtactgcatgagatgtaacagggtcgtattatggaagaacagaatccctgctgttgcacggagtgagtacagtt

SEQ ID NO: 62993 - DNA, 327 bp, Triticum aestivum
  Clone ID: PAT_TA_62993
gccgcaactgcgtgctgctgctgaacgcgccgcccaacgccacgggcctcatcgacggcgccgacatggccaggctgcgcgagttcggcgccgccgtgaggcgcatcttcggcacggacctggccgagggcagcagggcgcgggccagcagcgagcgcggcggcggattcgaggcggggaaggtgctggacgggcgcgaggagacgtactgggcgccgacggcggaggacgggtggcggaacgggtactggatcgagctgcggcggccggcgggggcgcgggcgttcaacgtggtgcgggtgcaggagcacgtggcgctggggcagc

SEQ ID NO: 62994 - DNA, 116 bp, Triticum aestivum
  Clone ID: PAT_TA_62994
catgtttgaagtcattacccttaaccgtaaggagggggatgcctaaggctaggcttgcgactggagtgaagttatcgtcgctgtaattttatcatcaagtggaattctgtaatttt

SEQ ID NO: 62995 - DNA, 278 bp, Triticum aestivum
  Clone ID: PAT_TA_62995
gcgacgggctccgagtgccgacgtacctctacggcgcggcgcaccgggagggccggaagctggcggccatcaggaggcagctaggctacttcaagccccagagcagcgccgagtggcacgggccgctcccggtcgcggccgacacgacggcgctgccagtcgcgcccgacgccggcccggacgcggagtaagcgtccaagggcgtgctggtgctcggggcgacggactgggtggacaactacaacgtcccggtgcgcaccgacgacgtggaggccgtg

SEQ ID NO: 62996 - DNA, 203 bp, Triticum aestivum
  Clone ID: PAT_TA_62996
tcgctctgacattgtttttgggctttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatggcgactatatacgttttaatggtaaccaatgg

SEQ ID NO: 62997 - DNA, 331 bp, Triticum aestivum
  Clone ID: PAT_TA_62997
tcggtgaagctggtgccgttcaacccggcgtacgaggacgcgtcggtgctgtggacggagagcaaggacgtgggcaagggcttccgctgcatccgcatggtcaacaacacccgcctcaacttcgacgccctcaacggcgacaaggaccacggcggcgtgcacgacggcaccaccgtcgtgctctgggagtggtgcaagggggacaaccagtgctggaagatctggccctgggccgaggcgcacgccgccgtcgagtccggcgccaccatgggcaacaacgcccacgccatgggcggcggcccccccgtgcatgccgtgcgcgtcttctgca

SEQ ID NO: 62998 - DNA, 376 bp, Triticum aestivum
  Clone ID: PAT_TA_62998
gacacaagaagctcataggcaatcaaagcctcttaatgtgcgaagctccaaccgaaccgcggatgtcttgctgcggaggaaactgcggaggcagcaccggctgcacgtgcggcaacggctgcggtggatgcaacatgtacccggaggccgaggccggcggggccaccctccttgtctgcgccaccgacacccacaaggcgagctcccgcgggatggagatggcggacgaaaacggcggatgcggctgcaaccagtgcaagtgcggcaccagctgcggctgctcctgctgcagctgctagatcatcgatcatcgaccatgcatgcaccgtgccgggcgtgcatcatcgagcatatcgatctactactaccataccat

SEQ ID NO: 62999 - DNA, 201 bp, Triticum aestivum
  Clone ID: PAT_TA_62999
cctaatcaaaagtaatcattctcttctagaaagtagaaataaaaggttcggggttcgttaatgggtacgtttgtaggttttgtcccgtctctcaaccgttcccagatgcaatggtttcgagagaagtgagaatatttcaaccccgaacacatgtcctgtttaatttacagccccctcacttgatctaaaggtggttgtggc

SEQ ID NO: 63000 - DNA, 425 bp, Triticum aestivum
  Clone ID: PAT_TA_63000
agggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcaacgaggtggaggaggtcaagaaggagtaccctgacgcctatgtccgtgtcatcggcttcgacaacatgcgccaggtgcagtgcgtcagcttcattgccttcaggccaccaggctgcgaggaatctggcaaggcctaaagtgcaagttgaagtaacacatatacatgccatgttagttcacatttgtcggcagct

SEQ ID NO: 63001 - DNA, 319 bp, Triticum aestivum
  Clone ID: PAT_TA_63001
ggactttgcattttcagccctttttctgttgagttttaacattccagaaaatatgtggttattatatatggcatgttcaatgcgtttgctttttagcaatccctataacatgtcttattagtccaacaatattgttttgcgattgagattaaatttttctcgcataacaatattgatttgcgattgagaaaaaataatgttttcctctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaagggg

SEQ ID NO: 63002 - DNA, 334 bp, Triticum aestivum
  Clone ID: PAT_TA_63002
ggtctcggcccgtgagctagctcgaagaccaggtctttgccttctagaacttggattctagcagcggtctggggtctatgggcgtaggcccgggcaaagtaaccgtctctccagccaagtgaccatgacggcatgtactcgcatgaaacgcaaaggggcgtcgcatgcctcgacgggaataatatgtagctcaaggacggtccgatatatacaaaccctcccgtgccctcccttcctcaagacctataagaagcggggaaccttgccgcaatggggcacgtgaaatggggtagaaacgacatatgtatgtgtagatatttatgcatatacccac

SEQ ID NO: 63003 - DNA, 396 bp, Triticum aestivum
  Clone ID: PAT_TA_63003
ttgacgcgtgggcggacgcgtggggggtgagttttggagcaaacactttcatctcagtctgtaccacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggccta

SEQ ID NO: 63004 - DNA, 262 bp, Triticum aestivum
  Clone ID: PAT_TA_63004
ttcacgcgtccgcccacgcgtccggcgcccgctccgaagccgccatgatcagcgacgggtgccagtggcgcaagtacgggcagaagatggccaagggcaacccgtgcccgcgcgcctactaccgctgcaccatggccgccggctgcccggtgcggaagcaggtgcagcgctgcgccgaggaccggacggtgctcatcaccacgtacgagggcaaccacaaccacccgctgccgccggcggccatggcgatggcgtccaccac

SEQ ID NO: 63005 - DNA, 398 bp, Triticum aestivum
  Clone ID: PAT_TA_63005
ttaaccttgactggtacatgggcccaaccctggttgaggcgcttgaccagatcatcgagcccaagaggccctcagacaagcccttacgtattcccctccaggacgtttacaagatcggtggcattggaactgtgcctgttggccgtgttgagactggtgtcatcaagcctggtatggttgtcaccttgggtcccactggtctgacaactgaggtcacgtccgttgagatgcaccatgagtctctcctggaggcgcttcctggggacatcgctggcttcaacgtcaagaatgttgccgagaaggatctgaagcgtggttttgttgcatgcaactccaaggatgaccctgccaaggaggctgccaacttgacctcccaggtcatcatcatgaaccaccct

SEQ ID NO: 63006 - DNA, 390 bp, Triticum aestivum
  Clone ID: PAT_TA_63006
gtcgtgatgctggacgccaaggggagctgcgcggtgccctccgaggaggcggccatgggcgcgggtggcaggtgcctgtcggtgccgtccgtcgtgccggcgccggaagggggagggatcgtcctccgtctccgcatcgacaaggaggtcaaggcgagcaggagcccccgtccccgtggctgattacttacttggtcaccttgggctccttattatctactactcgccttaacctggagtactatatatatttaccatggttggacattggtgatttggtagtgaactggtggtagtgatcgaaggttgaaccatggttgggctttgattgattctgtccatggcaatgttggccaatgtatcgcgcaggctatatatgcagctgatcac

SEQ ID NO: 63007 - DNA, 167 bp, Triticum aestivum
  Clone ID: PAT_TA_63007
ggaggaactttaggacatacttggggaaatgcacctggtgcaccagctaatcgagtggctttagaagcttgtggacaagctagacacaaagggcgcgatcttgttcgcgaaggtaatgaaattatgcgagcagcttgcaaatggagtcctgaactagcctgagcttg

SEQ ID NO: 63008 - DNA, 449 bp, Triticum aestivum
  Clone ID: PAT_TA_63008
tccacgcgtccgtgcctctccagggtactacgacggtcgatactggacaatgtggaagctacccatgtttgggtgcaccgacgccacccaggtgataaacgaggtggaggaggtcaagaaggagtaccctgacgcctatgtccgcatcatcggattcgacaacatgcgtcaggtgcaatgcgtcagcttcatcgccttcaagccaccaggctgtgaggagtccggcaaggcctaaacaagctaactacccttcatcatacaacatggtttcgtgtcaggttgattttatttcccttttttacttttgttctgcttgtgtatgtgttctccccctgcaactcgagttaacattatatgagtactacaaatcataagagtactacaactatcgttgggtgagaaatatgtgaatgtaactacggctatgcataaagtaaatatatactccc

SEQ ID NO: 63009 - DNA, 266 bp, Triticum aestivum
  Clone ID: PAT_TA_63009
tttcgcgcgaggaggagggaggtcgcgcgccggtccatggcggcggcggcaacctccgtgcgggggtgcggcccggcgttggcgtcgacggtggggctctcgctgcgttgggcgctgcagcggtcgttctttttgccgcccttgacggggagggcgtagttcgtgcgcgcgctgcgggccgtggtcgcggacgcgccccaccgggggctggagctctggccggaggggaggcaggcggtgctgctggaggccgtgatcgggggaga

SEQ ID NO: 63010 - DNA, 363 bp, Triticum aestivum
  Clone ID: PAT_TA_63010
cctcgcgtttgcccacgcgtccgcccacgcgtccgaccaattttcccgacgcgagagcgagagacctactttcccctcgtctcaggccatggctcttagggtttccaccctgcccgtcgccgccgtcggccgcgccggcaactacaccgtgcacggcatcacggagagcccggggggcatctgggacggcctcaccatcgtcggcatcgtcgtcaccggagtactcctccgccgtcgccttcgcagctggagcaggcacctgttctctggttcccggccccatgacccccagcaccgagacctaagggtgagggccgaccgggctgaaaacaagggcaaacgtgagcagtgggcggagacaaa

SEQ ID NO: 63011 - DNA, 354 bp, Triticum aestivum
  Clone ID: PAT_TA_63011
ttctcgttatatgaaaacgaaggcgggccatataaaaagatgatgaaatgccgagccgcggcgggtgactggaccaatggatggtcctgtgttgttaagctgatggtactaacccgctcatcaaaggataatgacgaatatgcatgcatgcatagcagcttgcggaccggcgtcggctggaaatgctgccatgttgtctcccatacatgtctctctctttttggttgtcgggtaaggctgcatgctgaattgtgtctagtagtatgtgtaaattcctggtgccgtctgagccttgtacaaaaacgctcttgatagtgagtgttgtgcgattctttttgtactccagtgggtgat

SEQ ID NO: 63012 - DNA, 380 bp, Triticum aestivum
  Clone ID: PAT_TA_63012
taccggttattgctccgaccgataccgggagcatttcttcagaactctaccacgcgcgaatcgccgcggaattttactgaattaccagcaccagagcagagatctcggtcggctcggcgccaggggcaacttccgccatgagcgccacgaggtcgtccttcttcgggtccaacggcaagaagaagcccgccgcatgcgcccggaaccccttcgactccgactcggacgacgacggcgggatggtccagcagaggccgccgatgcgggcctactccgtcccgacccccgccgccgcgccggtccccgccgacgagcggaactccctcttcgtcggcgccgccgcggcgggccccgggccgtccgggttcgcgttctcgtcg

SEQ ID NO: 63013 - DNA, 178 bp, Triticum aestivum
  Clone ID: PAT_TA_63013
cgtactcttttgtggacacgcgccaggacgccacaaagcgatcagacgcatactcgatcacccgcaggagcgtgcacaaaggcagcaccatgtatcgatcacaagggaggcccagctgggggcatgaatggcaaggacgcagagctgaccactgatgcagggtacccctacagaaacc

SEQ ID NO: 63014 - DNA, 188 bp, Triticum aestivum
  Clone ID: PAT_TA_63014
ggtagatttagttgcactgccctccaaactgcgcgtgcaacgccagtgccaagtgtgttccttttgggtgtgagtgcacaatatgcatatacgctaataagcagagtacacccctccaacaaacagatggatctagctgatgatgtacaaggacatgttccctgaaataaatgtgattgagacatatg

SEQ ID NO: 63015 - DNA, 422 bp, Triticum aestivum
  Clone ID: PAT_TA_63015
gttgtaacacctggatagtaaatctgaagatctcgctcacagtatttagatgatcaagatctctttattgataatttcagctgccacaatttggacattgtgatgatgctgaaagatggttcttccctgtcaagtgcgtatgggtgcaatacctgtcactgatctctgaaagcaacggtgatgtagagcgggtttgtctacatatgtgttgaaatgtgcatcctttctcagattcatatattaacaaagaatgtctgtcaataccatctggtaaagattgctactccctctgatccatattacttgtgatgacttctcattatggctctgaaaagaaggattagtatgcgccatctggggcttgctctgcagcttttcatcctggacagaaattgtggatggatgattagtatgcaccatct

SEQ ID NO: 63016 - DNA, 265 bp, Triticum aestivum
  Clone ID: PAT_TA_63016
ctgacgtgtgggctcggaagctcgcattgcagcgctggcttgaagttatcgacccgtgacaccggtacgggcacaaccttcactactactacgactgctggctgaggtgcgaaagcagggagcctttcttctactggctcgacatcggagagggcaaggagatcaacctcgaggaccgatgcccgcggtcgaagcttctcagccagtgcatcaagtatcttggtccgaaagagagagaggaatatgaggttgtgatcgaggatgg

SEQ ID NO: 63017 - DNA, 113 bp, Triticum aestivum
  Clone ID: PAT_TA_63017
tcgctgcgatctccgtcgtgccatagcctgtgttgtgccggattcggccaccggggccactagatccatggcaagtggatcccgtgcgtgctagattcggctgtgttgcgccc

SEQ ID NO: 63018 - DNA, 305 bp, Triticum aestivum
  Clone ID: PAT_TA_63018
ttttgatattcttgtcatatgtatatgactcatattgttgaaatctcacctctaaatcgagtttagtgctctttttttggaaatacaggtacttctgaattcctgcaatttctgtactaattttgtattttgtgaggagccacagatgtttacaaatactagaatgatgcatgataggtcgcacacaaactcttgaccaggtgcctctcacatattctcatgtttgtactatattcttcttaaactgttaacacaatgagcatgtacttggttcatccaagaacacaatgagcatgttcttggtt

SEQ ID NO: 63019 - DNA, 166 bp, Triticum aestivum
  Clone ID: PAT_TA_63019
ctcacgcgtccgcacactttggagcttgatagtgagtgtgctccagcgagtgacgccgccacagcaaactctctcggcatacaaaactagtaccagtagtaaacaacagagcagagaaagaatataagttctttgaagggccggagaggtaactgtaggggaaatg

SEQ ID NO: 63020 - DNA, 129 bp, Triticum aestivum
  Clone ID: PAT_TA_63020
tttcgtcgtcaactttcactgattgtgtgaactgtcttattgcgttcaccaacagtaggtttaacaaggatataggccttaatgcaattggttttcttcgattctgtgcggcaaagctggcagaaggtg

SEQ ID NO: 63021 - DNA, 184 bp, Triticum aestivum
  Clone ID: PAT_TA_63021
tttacctttctgaattagctgttaacagtatgggaatgaacatggggccaccagttgtgagaagagacgaatttcagctcaggaaaccagatgggaggagacatgaaatggatcgattaaacggaagggaccgggaccgggatcgggatcgggagcgtgaacattcccgcgagagggaaaggga

SEQ ID NO: 63022 - DNA, 153 bp, Triticum aestivum
  Clone ID: PAT_TA_63022
ctgaaaccccacgcagacacagctccgctccgggctcacgcacctcaccccggccacctcctcccacccaccgccgccggcggagccatggaggtcggcggcgaggagttcgcggtcggcgtggtgatctcggcgaagaccacccttggggag

SEQ ID NO: 63023 - DNA, 362 bp, Triticum aestivum
  Clone ID: PAT_TA_63023
tggaaaagaaaaactaaaatcttagtctcccccagcacgcgtctttcaaaatttagactgactgggtctttcaaaatctagatacagctagcaagcgtatgcgcggtcagtccagacgaccaccagatctggatctcttcattcccctttgggctttggtcaacgcttttgcttggtgagcatcgtcgaccggctgcaggttgctcatggtctagctacctagaagacgagcagcagcagcaggccttggcgagtctccgtgtccccttccctcctttccccagcaagtcaagggaggaagaagggaaggaaggaagttaggagaagctgctagcggccgaagccttatcgctttgctgaca

SEQ ID NO: 63024 - DNA, 172 bp, Triticum aestivum
  Clone ID: PAT_TA_63024
tacgttgtgccaaaaatggtctcctctcctccccattctcctactcgccggcatggttggcatctcccaagccggcaacatcgccgtctactggggccagaacggtaacgagggcacgctcgtcgacgcctgcaacttcggcctctacgcatacgtcatggtctccttcctc

SEQ ID NO: 63025 - DNA, 110 bp, Triticum aestivum
  Clone ID: PAT_TA_63025
gtcgtggaaggaggaggtttcttctcatcgacagcttcaggatacagccatggccttgctcttttgctgctgggacggacagaagaagacaagcctgtcaaggcatggag

SEQ ID NO: 63026 - DNA, 375 bp, Triticum aestivum
  Clone ID: PAT_TA_63026
gttatttccgtcatgaaacttcctgtcttcttcaagcagagggatcttcttttctttcctgcatgggcctacaccataccatcgtggattcttcagatccctatcacgtttgttgaagttggagtttatgttttcaccacatattacgtcattggatttgatcccagtgtaagcaggttctttaagcagtatctgctgctccttgcgatcaatcagatgtcatcttcgctgttccgcttcattgctggaattggaagagacatggttgtgtcccacacctttggacctttatcactgttggcttttgcagcattgggtggctttatccttgcaagacctgatatcaaaaagtggtggatttggggttactggata

SEQ ID NO: 63027 - DNA, 156 bp, Triticum aestivum
  Clone ID: PAT_TA_63027
tttagttggcgctggccatgcaggcgcacccggacagggtcgccgtcgccgtcttcgcctccgccgccatgccggccgccgggaagcccctcaagttcgtctccgaacagtttgcgcaagaaaggggcccgggtttcttcatggacagcgtgatcg

SEQ ID NO: 63028 - DNA, 120 bp, Triticum aestivum
  Clone ID: PAT_TA_63028
ttactttcacaccacgcggccgacgcccaatccgcgaccacgaagcgcaacccgccgagatggcctccgaggcggcgaaggaggcggagcccgacaaggggatcctacagaggaggaggg

SEQ ID NO: 63029 - DNA, 198 bp, Triticum aestivum
  Clone ID: PAT_TA_63029
tcgctggcctccatgacaagcgcgccaccagcgagtcccggagatccaagcgccctgagcggtccaggccggaggcgaaggtggcggagcctccggcacgccgggccaagcgcgccgagggccatgttcctctgcgcaagcgcgagtctgcgagggtcgggcgaccaccccaccccctggactcggagggtgtgactg

SEQ ID NO: 63030 - DNA, 201 bp, Triticum aestivum
  Clone ID: PAT_TA_63030
gtcatcttgtaccagcgccttatgcggaatgggggccattctacctatcaaacagctagcaggcgaggggacccgttcccacctagagccgatgcgcgactccgtacagggcggtggcgctgcagcagcaccagcgtctggtctcctcctccggcggcctggcggcgacgggggcccacaggtgcggcgagcacgacggga

SEQ ID NO: 63031 - DNA, 324 bp, Triticum aestivum
  Clone ID: PAT_TA_63031
ggttgatttggccaccggtcaagagattctcgctactggtattaaggtagatcatctttctacctctttgctatatccacaggtcacatgtgttgtttttcatgttctgagctcttttcctattaggttgttgatctccttgctccttaccaaagaggaggaaagatcgggcttttttggcggtgctggtgttgggaaaacagtgcctcatatggaactgattaacaatgttgccaaagctcatggtatgtactttccgggtagtttaaagtagtgtgcacagtggtgttccagtttttttttaactttggtgcttcttctgat

SEQ ID NO: 63032 - DNA, 401 bp, Triticum aestivum
  Clone ID: PAT_TA_63032
aaaagaggctaaaaccaacaaaaagttacttagaagcagccaatagttttttttgagtttctaaggtcaaaatgtgccagaattcaatgcatttgactaattagaagagttaaagatgaattacgagttgttagacaacactgctacccattttgtccctaaaacgctaaaaacaaccgaaaattgcttagaagtagtaaacagctttgttagtattttcatggtcaaaatgtgtcataatctaattcatttaaccaattcataagagttagagatggagtatgagtgtttagacaacacttttacccattttattcaaaaagaggctaaaaccaacgaaaaattgcttagaagcagtaaatagctttgttagtgttttcaaaatcaaattttgtcacaat

SEQ ID NO: 63033 - DNA, 453 bp, Triticum aestivum
  Clone ID: PAT_TA_63033
atcgaatccaattcctactctctgttttacaataccttattgcatttgttcccagactagcaataaaatgagcgatgagttggatcttttgagggaacagaaaaagatattatctgaagaggcggcactgcaattaagttctttaaaacggatgtcagatgaagctgcaaagtcccctcaaaatgaggagattaatgtaatataatcaccctgttcatgatatctatatctagttgttttactctagcaaaatattgaccttctcggttctcgttgttgcttaggaggaaattaaagtactcaatgacgacatcaaagcaaagaatgaccagattgctacgttggagagacagataatggattttgttatgacatctcatgaggcattggataaatctgatatcatgcaggtaggttccaattgtcaagtattatgcactgactttttttgtc

SEQ ID NO: 63034 - DNA, 517 bp, Triticum aestivum
  Clone ID: PAT_TA_63034
catatggtataaaggcgttgaactaattactgatcccgtcatgtatagtggagtgtgatttgtttgttttacttcataggataatagaaaaacaaacaatatatacaaaattaactgtggattacaaataattgtgttcatatatcttatccacttatataaactagataccatgatacttgagcttaaataattgatcacatccgccgaacacaaatcatggtcacatccacatgaattctttcattacttttgtttgagatttaagtcccaacgggtaaattggaatcttgcactactttaattgtatatagtttattgcctaaacagccaataatcagtttcacaaacaaataaaatataactaaaaacactccaataatcagaaagaaaccaatagaactgcaaggaaaacaaacttttttgagtaaccaatgaatttttaaactttgcaaatacaaaagaagattctgattacacaattttaaattatgatccgggcaaatagaatctcttt

SEQ ID NO: 63035 - DNA, 489 bp, Triticum aestivum
  Clone ID: PAT_TA_63035
ataagggtttgtacatatagatatcgaagaaaatagaaaaaaatattaaaagttccctttttgcttcaatccgtcaactaaaaaaagggtataaaaggaaggtaacattagttgatactatggtatttaatagacaagtatttaatacacgcaaaaaagaaaaaaaaagttctttattctttatctgaataatgagtcatccgacaattcatgatttagattcaactacttatacttattaataaactaatagcaaggaagaaacaaattgagttgatccgtttacctaagtaaggaccaataaaatcaaaaattttgatcttcgaaaccaattaaatgaaattctaagggttccattttatggggcagtgcgcgagaaattaaatcataaacaaatgatagaatttgagcgccctgaaaatgccataatatataacatcaaaatctattacattaatggggttcggaaatggttgaagtagatgaata

SEQ ID NO: 63036 - DNA, 469 bp, Triticum aestivum
  Clone ID: PAT_TA_63036
cctttctagaagtttcaaatggtcatctgaccatgggctgagcccagtccacaatattatggacattccatggtttttccgtaatgaaaacgggctgtatggtctaaagaccaattttgtccatggccttaatgggctagcccacacggtttatggttggcccatcaattttttcaacacatcaatttttcttctcttctctctctctcggcaacgacgctctctctcccggcgacaaagctctctctcggcgacgaccaagctcgacctctctctcaactcctactccggttagttctactagcttgtgggtttgtccaaatttcaattgttagtgtttctgaaagaatcttagctttttggatatgaggagagctagctagcaaatgggcacttttcagattttgtttatggctcgccatttcgaatttcattatgaattgaagcacatcaatatgtagagaccctt

SEQ ID NO: 63037 - DNA, 291 bp, Triticum aestivum
  Clone ID: PAT_TA_63037
ccatgtttcacatgaaagtctctttggtttgccctttgtcttgtttgttggggtttggtcttttaataaaaaagagctcgaagaacatgcgtcggactctttctcttccttgaattcattcaattggccacggcgacaaaacagggagccgatacagcgaaactgatacatcttcttttattttctggattcttagggttctttttcggggaatttaggtaattatgtctgtccattttggtggggcttgggagatataaaatttgcttttctttgcgtcggattctcaaa

SEQ ID NO: 63038 - DNA, 334 bp, Triticum aestivum
  Clone ID: PAT_TA_63038
agacggtgttgttacaacgaccaactgacaaggtactcgcgatggctctttagaagaatttggcattgtgtgaggtttgtggctcatttcttgtggctaatgatgcagcagaaagaacgcaatctcatgtcactggaaagcaacatgttggctatggcttggctcgggatcttattgctgaacaaaaagtaagtctcagaactaatacttgaatcttgtttcatttgagctgtcattccttataaaatggggatagtgatgctatgattactttttctattctaggctgctaaagataaaggaaaggaagaagaaagactagtcagaggaaaag

SEQ ID NO: 63039 - DNA, 437 bp, Triticum aestivum
  Clone ID: PAT_TA_63039
atacaacagaccaatttccaatcctaaaactaaatggaatacacacttttttttttctttatggaataggaaatttctgtgcgtctttaggttcctttcttttatgaaaaggaaactcttaagacttctagaattggaaatatttgatttgattgaacacaaacgacttcttgaagtcttctccaaaaacctacatatgtttcataagtgctggtcctttttggagaaaaaaatgctaatgggggacaggcgaatttgatgcataaaacaaagaccgcatgctttcaagcaagaaaaagtcgcatagacataagtacaacaaggattaaaagcaatactaaaataaggaaaatatattttaaaagatttgaaatccgcaagtagtctatagaaaccaacttaagatctgtactagcactcgttgacttcttcgcacg

SEQ ID NO: 63040 - DNA, 444 bp, Triticum aestivum
  Clone ID: PAT_TA_63040
ttgtgcattttcatgctcaagcaatctccaacattcaatactcctagcgttgtataacttcttactgtcctttgctcgagttactggtgggacattgctcaagtttcttaattgtttcttcatttttgttcttctgtgtttattttttgcagctttctcgacatgagcccaggggattacacactgttttggtcactggtggtgctgggtctattggttcacatgcagctctaaggcttctaaaggaatcatatcgagtgaccattgtggtatcttctttggcttacatggatttaggttattttgctcaacattattgtaaatgtcgatatcacaaagtaaatctctttctgtttaataggacaatctatcacggggcaatctcgctgcagtcaggattttgcaagaactatttccggaacctggaaggcttcaatttattta

SEQ ID NO: 63041 - DNA, 498 bp, Triticum aestivum
  Clone ID: PAT_TA_63041
ggaggaaattacgaaaggaagaggtacaaaatcgattctcttaaattccagcggacaaaacacaaagccttaaaagtatctagtggaccttagtaaaagcccaaatgatggagcgtgcttgattgaggcatagtacatatgtcatcataagatgaagattttgaaatcaccaagcagagtcaaaatctaaggcaatgacaaaacgtaagcagcaggatacaaaagaaaacctaaccctaaccgtatttgaatccaataaacgatgttcaaactctggaggagaatactttgatcgaatccctgcagatttggtcatcaaaatcttatcgaaattgtctgcaaagtctatggccaagtgtcgttgtgtatgtaagctcttgtcgtcgataattcgacaaccaaattataaccagttgttcccgatcaagtatcccgatccaccgaggttcatcttcaccttcttaggtggaggaatgttattttcctacacttcaacac

SEQ ID NO: 63042 - DNA, 455 bp, Triticum aestivum
  Clone ID: PAT_TA_63042
aactcatgataaatcaaaaggtggaaattatgtttacgacggtttatatcttttggaaaagtattggcaacaagtcggatctcacggtatgaatgtcttcaagtttcaacttaggcgcatacctggacaacctgaactttcttgggttgaggtgaagaaatctaagtcaaaataccgggaaggtctatgcaagcttgacatctcagaagggaaagagcagtcacccattagcgctgtgaacgaaatagacgacgagaaaccgcctttgttcacctacactgttaaactgatttacccagattggtgcagaccatttcctccaaagtcatgctgttgcaccacgcgctgcaccgaagctgaagcgagggtgtgcgcttgtgtggagaaaaacggtggagagataccgtacaacttcgatggagccattgttggtgcaaaacctactatctatgaat

SEQ ID NO: 63043 - DNA, 509 bp, Triticum aestivum
  Clone ID: PAT_TA_63043
aaaaagtaggtcagatttcgcctattcctaatcctaaatggaatgtaacgacgtagggatccctatgtaaacatagtatctatttagatacgctcgaatgaccccttctcataatgagaatgtatataaccttattccggtctggtccggtatggaatgaacttataatcatggaatcgactcgatcatcagattatagattataagttcataaccttagtccattcccattttgggcggaaccgatctactaattctttgattccagttagtattagtaagagggatcttgaactaagaaatagattctagaagctaaaaagggtatcctgagcaatcgcaataatcgggttcattgatattcctggtatagtagatgctatcacacatacaatcatactcaattcgatggaattgtttgatcttaaaggggatattctataatttcgcatgtgaggggttatttcttggtttcgttcagtcattaataacttgattatttttagata

SEQ ID NO: 63044 - DNA, 249 bp, Triticum aestivum
  Clone ID: PAT_TA_63044
gatcggacggctcctgcgatttcatcagctttcacgatttctccatattttgacacgtattccaaccgcatctccaacgcgaaaccaagctccttcacaatcgtgaacgcgtttagttgttgttccgcgtacattggccacgtggctattggaacttcgaaacgcaaactctccaatatcgagttccaaccgcagtgtgacacgaacccttcaattgctttatggtgccagaatttcaacttgaggagc

SEQ ID NO: 63045 - DNA, 473 bp, Triticum aestivum
  Clone ID: PAT_TA_63045
tatgtacctagtctctcaagcatgaaacatcgccgggtagagatttaagctaagtaaccttattatattttataatgaagtttcatacgattggttttgagttgaattttataggtttttgattaattgaaaactgattgtcaaggactagattaattttcaattttggtgtaaatttctaatgtctcctcgaagaaagactcttatcatttaatctcgatatctcactcaaacctatattaaacttatttagataaaataattaagcttcatgaatttccaattcagaatcatttcaaaattatttgcaataagttgacttcgacatgcatattatgtttagttccttcaaactcccaaaatgattccgatcatatgtattggtttttttttttctctttatttggtcaattataatatgtttagaaaaaccccatgtgtttttgcatgttcatggattggtcattttcatt

SEQ ID NO: 63046 - DNA, 463 bp, Triticum aestivum
  Clone ID: PAT_TA_63046
cgagcaaggcaacaaatgcgatgacgagaggtgaacaagcgccgatgtttgtgcccacgacttccccacgaaggagaagccgcgggcatgggtgtaaaccgaactcaacaattccttcaaattaggtacgaaacacaggccccggaactcatcatcgagcgtaacatcgcccgtgaattaactgagaaggataggtggtaggtagttcgatgcgcgagcatggagcctacgaacactagctatccgatcaccactcatacgccgaacgttcaattaactcaaaatcatcaatcgttccaactaatctaccgaagtactcggctaagaagaaagaagacggacgaatccgagccaaagccgtacaagcgcgagataccttcgggacagcctaggcggatccatgctttccaacgaagcacgcccatccaacctaggcgagacaagggttcacatttcgttcatc

SEQ ID NO: 63047 - DNA, 430 bp, Triticum aestivum
  Clone ID: PAT_TA_63047
gaatcgactatgagtccttttaatatttagtatagaatgtttacagcaaaaataaatattttaaagtctctttcagagaaaactaataacaataaaaaaaaaaaaaatcgtcaggtaatgcgcctacactgcgtagatgcattatgtatataatggatcaaacaactttgtcatttcaaataagactagcatgtaccgacacatgatagcatatcatctcaattaatgaagcttcgctttttagttcaatttaatatcagtttaacatctagcatttgtttttcatacttattctattaattccacgtacgatccgcattcttcatacttattctattattttgtccgacctgatttttcagtatcaatttgtttcgctgtttctaaattctttgtgaatccactcatatattatcttatcaaaatcata

SEQ ID NO: 63048 - DNA, 565 bp, Triticum aestivum
  unsure (1)..(565): unsure at all n locations
  Clone ID: PAT_TA_63048
cgtggaagacatgacggatgtcatacttggtttacaaggagagcctccttccaactatttgcacggagttccattcgttggtggcaggtaaggcttttgttaatttggttcggttatgatagccttacaaaagtatgttcggtctttcatgcgtgttattttgatagggataaagttgcagcctgtgccaagcattacgtgggagatggtgggacaacccgcggagtaaacgagaacaacactgtgactgatttacacggtcttcttagcgttcacatgcccgcttatgctgatgcagtttacaaaggtgtttccacagtgatggtttcatattcgagctggaatggtgagaagatgcatgcaaatactgagctgatcacagggtatcttaagggtacccttaagtttaaggtctgcttacttatcacaacttcaacgcacattctctgtgttctggcagtagtctttctgaatgaatatttctctctctccatgtantttatagattcttgaatagaacatatatatagcatgtgtgagttcttagatgaaggagttgattttg

SEQ ID NO: 63049 - DNA, 484 bp, Triticum aestivum
  Clone ID: PAT_TA_63049
gatgatgatcactataaattaattgccggccagttggaaggtttcctactttgttcagatttccaacttaaataataaatatgtgatgatggctcaaccctgcataaaatcacgtacaagcaatcatatgacatttatgaccaatccaatataaagattagcgcccatctaagtgttcaaatgttaaccatgagtattggtcgaggataaattatgagcatatgacttatacgtacaaatacaatagtagtattttaaaacatttttactttacttaatagttggtggtagtacaaaacaattgatagttcagatactctttattctttaacatctttgttttattcgtgtgcatgctaaggtatttgcgttatcttatataagatttcttggctatctcatcaagacaagaaattagggatcttatatctatatattcaaatttacgtaatgcatgtttttatttgaagtacatcgtatacac

SEQ ID NO: 63050 - DNA, 496 bp, Triticum aestivum
  Clone ID: PAT_TA_63050
aacgggaagtaataacccgaaaagaaacaaaggaaggtaaatagtcccgcaatgcaagatctgtctatgagagtgtgtatatagaatggttgagacccaaattcttccctgtctagcattctaacgcataggtctgcacctgtggttcaaaatttttccaaggatggaaatcgaaacattcatatgttagttcaaaaagattcgtttgctttcattcatcttttattattatttcaagaagatcaaccttgttaataattctacctcggccaagttctcatcgggagagctatttggtgcagtgagattggacgcagcagctgtgttgtaccggaagatccttagttttccctcctgagataaatattgagcaaatatcaatacaagtcaacattttagcgccgagaagtttttcacattacgatttaggattaattacctttgttccatagacaagacctcccccaggagaaggatgaaagcaagcaacattaac

SEQ ID NO: 63051 - DNA, 389 bp, Triticum aestivum
  Clone ID: PAT_TA_63051
ataaacaaaattcaataaataattttttagtaattattatgttatttattaattcacctttctggttaccatttaccataatcattttgttcaattcctatgttcctcttggttcctacttatggccattttctttttttcttgttcctttttgttatttttcattcatattcctatcgtttcttttgtttatcaccaatcagagtcttaaaagtaattaccaatcacaaaagttttaccaaaagcatcattcttagtctttattttcaaagttaattttcaccgcctttaactattccgatattgcttataccttcttttacctataacaaacttgtatggttttgtatcaccaatggtattaatgtatatttgaggggggggggggg

SEQ ID NO: 63052 - DNA, 505 bp, Triticum aestivum
  Clone ID: PAT_TA_63052
tgtagatgaaatacaataaattagtttccacaaccagaggaatacaaaaaggaaccttcgtttataactcaaaaacaaagaaagaattattaactaaaagaacaagcaacataccttgtgccttgatctacagaatttattgaattctttgggtcttttcctcttagatactggctttgttcctcagagtactcctgagagtcactgtcaccacctccctgtatgaaccatataaggttttagtcttccacaaacgtttcacaaaatcaactgcattttgcaatggtatatttctcatagtataagcatccagtgagactatgctatggacagtttaccaagctccatcgtaagtactaagatatcaatcctaactgcatcaaaaggaaaaaaatctgtaacaacaactacaaacctcttggagggaagctgctttggctctgaaagatgcctctaaaaattcagcctctttcttgagcttccttatcttttctaggtcagagca

SEQ ID NO: 63053 - DNA, 409 bp, Triticum aestivum
  Clone ID: PAT_TA_63053
taggaaaatataaaattaatcaagaaaaatagacatgaaaaacatactactccatatgtttttgtttggccaataaagagactaactaagctaatatctaactaaaaaagagtttatttattatcaattttataactgagcaaattactaatctattatgcaaaaagatattcctaattaataagatggattctactaattttgataatagatatttgattcatatatagtgaaaaataaaaatgacctttagcaatcattaaatttttggtcacaaaatactaacatttttcttttctggcatagcataaattaactttagatagtttgcaataatcttaaggatcaaaagataatagatacaatttatgaaaaaattgttcttgcaatgtaacaaagatcacctaaa

SEQ ID NO: 63054 - DNA, 258 bp, Triticum aestivum
  Clone ID: PAT_TA_63054
cctgcaaatatagggtttgtgtattcagacgtgagaacttacacagtctataatgaaaaagggggcgtgttgtgcgaaagattaaataacatctatacacaaaatagaaaaatgttagctaacacttcgccaactatgatggataggtctaaataaactatgaatgcttgggatagatcatagcggtaataatactagcatatgcctatgtgaaccaaaacatatattattaattaaaaaatatagatatgttaatgg

SEQ ID NO: 63055 - DNA, 569 bp, Triticum aestivum
  Clone ID: PAT_TA_63055
tttatcttgtttctaatttcctcttgaatctgcatcagtgtccttcgttatgttcctttggaatcactttacccatctctagctctaggattctattgccgcgacaaaggtattgtattactacattctctgaaaccaaaagtttttaaattctgtaacttgaaaaaacctttccctaatcttcaacagatgatttcgacgatttctgtctccgagcattgaaactagctgaggaatcaaacggtgctccattgttcacagtgactcaaacccacacagcgataaaccaaagcaactacgggtttgcggatgacgacagcgaggatgaacgtgaagatgactggcaaatgctctgatcatgatcatcgtcaaacattttaacaatctcaagctacaattctttttttccttttgttaaccagttctttgttttttatatgtgttggtgtatattacatcagatcagaacacaatgttgtactataaaatcttttgggattttcaaacatagattgaagcatgcgaaaatggaagagtagagaaatcacaaggtatatgaacatgatgac

SEQ ID NO: 63056 - DNA, 392 bp, Triticum aestivum
  Clone ID: PAT_TA_63056
ttgggtttatctcaagaagatgagccacaatgtctgtgatttcttggtctcccattggcaggcgatgtctgaacgatgttctttttggtatcaggtactccaatctgttgctttcctgaacaaacaatttttccagagagaatgttctttattagcatatgtgtcttccattcaacttaagagttgcagagtttttggagttcagggaatgttcctttaaggtctctggaaacactaacctgggtccgatcatagagcattcggctttttgtgaaatatttgtgggaatcacgtaccttggtaagcatttcattatcgaaagatcctacgatttccatatcccttgctagcaaactggccggcgaatcattctggaagagaacctgcaaaag

SEQ ID NO: 63057 - DNA, 509 bp, Triticum aestivum
  Clone ID: PAT_TA_63057
agaagtttatcttctgttctgttatgattttcattgatacttaacgaacgtttaagcagttttaacgatcttttccctgaattttcaccgattttctcttaatttcccgcaaaatttacataagaacgacatgtttagtctgttcttttcttttgaatctcccgaggcaggtacaactctaaatattcaagttatgtcactgaagaagatccaaacgacataaatcatacgtcaaaacataaaagaaccaacgcgtttcttatgaattctgcttcagctcatggtaaaacctagctcctctgtttcctctgtttctatgtttgctctgttttctcttgtcctctgtattcttattcattgcttgtacaccaaaaaacctagcttctttcaacgttttctctcccttctcctcccagatctaagattactagaggtagataaagagaagcaagaccccaaatcaccaagaggagccctcgaagcctgcttaactcgttgctcaatctctt

SEQ ID NO: 63058 - DNA, 499 bp, Triticum aestivum
  Clone ID: PAT_TA_63058
agaaatcattcaaaacaataatcgtcaataaaagaaatattatatacaaaacaaattagctcagtagatataaaactctttctaagaagttatttatagttttttatgtcactataattaaaaaatatattaacatagcgtcactattctatagctttttaatttattgctttgttgaacacattacatataaaatctattgcagaatagatataaagaacatataagatgctttacaatgatattacatgaaacatgttattataaaaaattaaagtttttaatttgtcccaaacatacatgttatgtcttctctctctcaagatgtatacatagatgataattagataacaatttaagcaatgtaaaggacaaaaaagaatccaagtagaaaattgataccagcgcttctatttttgtacatgaagttcttagaatgttatttgtgcattttgtcttgtactatgttccttttgggctgctgcaatacactcatgtg

SEQ ID NO: 63059 - DNA, 567 bp, Triticum aestivum
  Clone ID: PAT_TA_63059
caaaatgcctctggttcttctgttcgtttgtctctccctttgtctattcctcttctatattttctatcttctctttatcttttctctttaactctatgttcatcactactactcatctcatggactatagcttgccacaagtatagtggaattattaaaagagaaatgattttcacatttcgttaatttaaataaatttaaggaaaactaagcaaaacctaccaatgttgaaagaacaataaaacactccactagtcttattattaaaaagagaaacaaagattcttaaaagaaaccaaataagctcgaccctaaattttctcttcctccggcaagtagtatctattcttcaaccaaatagagtctgcaataacagcttcgtcttctttatttctatgtcaagtgtaatgtgcatgggtcctgttttttatttccaaaagggcgtgtccgaaactcgcctccctaaacgccgagtaacttggttggggatcggtgaaactatatgaaaaataaataatcttaatcaaacaattcacaaaacgaaagctttagtcaaattcactatat

SEQ ID NO: 63060 - DNA, 534 bp, Triticum aestivum
  Clone ID: PAT_TA_63060
acaacaaataacttgtgattggcagtaaaacaccgattaccctgttgaggtctaattcgatccttatagatttctctagctattttcttacgaagctttgttatagcgtctataacagcctctggtttaggtggacaacccggcaaatagacatctacaggaattagcttatcaactcctcgaacagtactataagaatcggtactgaacatcccccctgtaattgtacaggctcccatagcaataacatacttcggttcaggcatttgttcatataatcgcactaaagaaggagccattttcattgttactgtacctgctgttaaaataaggtccgcctgtctaggactcgatcttggtactaacccataacgatcaaagtcaaatcgggagcctattaatgaggcaaattcaatgaaacaacaactggtaccataaagaagcggccataggctggaaagtctcgaccaatttgaaagatcatttaacgtagttgaaataacggaattttttgttgttcgatcaagtatggga

SEQ ID NO: 63061 - DNA, 368 bp, Triticum aestivum
  Clone ID: PAT_TA_63061
tgtaatgaccgagagaggaacttccatatcatagacagctaaatccttttagatgttttactttccatcgtcgtatgtaacttcaacaggctcaatctcaaattttctggcacaaaattctgagaaggttgcaacctggaaaacgctaaatgattagttagctattgatcagctagcactgtaggtttgatttggtaacaacataccattgtattcaaaacaatcttggccttcgtcaaatcagttgcagtacattcaatgaagacattctttgtctgtaagggaattgctgaaagtgcaccattgataataggtggcaatgacagcacagttctgcaaaagtgagctttcattatgtgtcagtacgt

SEQ ID NO: 63062 - DNA, 466 bp, Triticum aestivum
  Clone ID: PAT_TA_63062
ctccctcctatgtttctctcatcagctacgctggaggcgactatatttattacatcgactaaaatcgtccttccgctgtaagaaaaaaaacattaatcttagatgtcaaggctaattaattcagttgtatcaaacatcattacaccaagttctctgcctttacatgtgaaagaacacttttgtttgtttgttattagaaaaaaatcataacgccaaatgtatatatacttttattttgggtgattatttgattcttatcttcattaaaatttgcatgcagggcttaaaagcactagtagagaaagtcgtggataatttacgcgttaatatgatagtattgggtggcctgctatttaagaagatagcagtaacatcgctgcagccgatcggatgccttccttcttacacctctgcatcctcgttcaagagttgcaacgagtcacaaagtgcattggtggaactacac

SEQ ID NO: 63063 - DNA, 435 bp, Triticum aestivum
  Clone ID: PAT_TA_63063
atcgcaccctggaaaccccgcgatcgtttagtttgattggacgactagtgggacacctaggagatctgcaagaatcagtgagaagactaaggctacgccgataccaaataaagagccacccaagaagcgaggtagaaccaaatctgcagtgtcaaagaaagatgcagaaggtgagaaatcagagggaggaggagaggaaaactctcatgtgaaagatactgaaatgaatcctccagagggaatcgcccagaatgaaaatgtgaccgataagaatggctccggtgaaactgagagggtgaatgatgcaaaagaaaacattgttgctgaggaaactccaaatgctgctccagttcaagaagagggtgagtcgatgaaggagaaagctctggattctgttgatgataagagtaaggagactgacaaagaaaaagatac

SEQ ID NO: 63064 - DNA, 436 bp, Triticum aestivum
  Clone ID: PAT_TA_63064
aatttaattgcggttctagttggtatactcactcatacacatgacatctagtcttatttcgctccaaaacactaaccaagcttcttcttgcttctaaaagcttggatggtttagtcgaattccgtatgagtctttgtctatgtatcttctaacaaggatacaatatttaggcttttaagatccgttgcggttctagtttttatactcactcatacacatgacatcaagtcatattcgactccaaaacactaaccaactgcttcttgcttctcaaagctttgatggtttagccgaagtccatatgagtcttcgtcattgtatcttctaacaatgatacaatacttatgcttttaagatctgttgcggttctagtttttatacggagtcatacacatgacatcaagtcatattcgaatccaaaacactaaccaagctt

SEQ ID NO: 63065 - DNA, 472 bp, Triticum aestivum
  Clone ID: PAT_TA_63065
gtgtctgcatatacgtcacactcttgctcatctctgatgttattttttttttatgtgcagttagagaactatagcaaagaagagtcccagctccaaacgacgtcgttacacagttcctcctctgtttctggaatcagaagaccatcgtcctctagtagctcaagatcaacgagtagacctcccacgccaaccagaaagtctaaaactccagccaaaaggccatcaacgccgacctcacgtgccacctcaacaactacacgtgcggcattaacctcgtcctctactactagctcaacaagatcatggagaagaccttcctctagctccggaactggaacctcacgtgttaccttaaccgctgcacgtgcaaccagtcccaccacctcaacagaccaacatactaccggttcagccacctctactcgatccaataacaggccgatgtcggctcctaattcaaaaccgggatcga

SEQ ID NO: 63066 - DNA, 514 bp, Triticum aestivum
  Clone ID: PAT_TA_63066
caataacactaatacatctcaatacagataaattttttcttaaaaccgcgctttcaacaaaagtgagttttttggacctccatgaaatataacctgaggacttggatttacaagcattggtgcagcttgaacagaatggtactgagcggtgtatctctgaggctgtgctctgttaacagttggcccaatcatctgcaggaaaatgggttgcaagtggaagaatgattcatccatggcaaaacaaacaaaagttggtggcagaaagtatatggaagcattttaacagtacagacaaagccatatcaattcagaatgatcttttaatctggtgttcaatactaacatttatggttgttaaccattcaggcgcttagtggtgagaggaacagtctattctcaattactagttgataaaagccctttgacataacatgcttgaagagagtaagataatacttacgtgttgaggaaattgaaatccaccgacagcatgtccagcggtcacattaccata

SEQ ID NO: 63067 - DNA, 460 bp, Triticum aestivum
  Clone ID: PAT_TA_63067
atatacaattcttgttcaatgagacaaatcatatgtacctgaaacctgaaccataatcttataaaacccgcaggattgaccggattggtctctctgaacgtctcaaactctcgagtatcaagctcaggactacgtcacctgaagccattgaagaacttgagatctctgaccttggagtcctgcaagctctctgctaatgacatcaggaagcttcaggcgactgatctgccaaacttggtcaacttccgtcctgaataaaataatatgttcaaaggcaaattcacgaactctgtaaatagatcgatctcctctggtctcagactaagacactgctcttagatatatcgtcaaaagctatgctcttcttcggattatttgctgaagaaactgtaaataaagcttctttcaagctatggccggacgaaagagtcctccatggctcttctacgtggtcagcttt

SEQ ID NO: 63068 - DNA, 357 bp, Triticum aestivum
  Clone ID: PAT_TA_63068
aatacatatgacagtgaatataatatatatgtcaaatacagaaatttatacaatttataatatctatataaaatacagtttttttgaatccttttttttttatgaagaggcctgttttgagtttgggctgggctgaattgtttttacccaccacatcattcctaaggataattatacagtaaccctagaaaggtttcctccaccttcctttttccctcctatataaaaaaaatcgacatcgtttttgctcactcttctctcttaggttttttttcccttctcccaatctcatcttcttcgaaaacctttcttctttcaaatttctgtgaaaacatgtttgacgacgagcaccacttt

SEQ ID NO: 63069 - DNA, 494 bp, Triticum aestivum
  Clone ID: PAT_TA_63069
gatggattgttcgtgtggacgctttggaagatataattggaggacatgtatggttaggttctcatttgtatatttggtggaatctggcatatcttaaccaagccttttgcatgggctcgccgcgcacttgtatggtctggggaggcttacttgtcttatagtttagctgctttatctgtttgtggtttcattgcttgttgttttgtctggtttaataataccgcttaccctagtgagttttacggacctacggggccagaagcttctcaagctcaagcatttacttttctagttagagaccaacgtcttggagctaacgtggggtctgctcaaggacctacaggtttaggtaaatacttaatgcgttctccgactggagaagttatttttggaggagaaacaatgcgtttttgggatctgcgtgctccctggttagaacctttaaggggtcctaacggtttggacttgagtaggttgaaaaaagacatacaacc

SEQ ID NO: 63070 - DNA, 465 bp, Triticum aestivum
  Clone ID: PAT_TA_63070
gtaaggtcctgcaattctgcagaaacatattgacatttttacttatgccaaaaccttttgttctattttgaagtttgatgctgttccatggggtctggaaggtgttcttcagcatataaagcatcgctataacaatcctccaatctacattcttgaaaatggtacacttcattctcttttgtcttctggctctgtttttgtctacttgaaagcaaaccttcttgttcttaagattcttcaaatcgcacccgaaaacaaaaacaggttcaccgatgaaacacgattcgatgctacaagacacaccaagagttgaatacattcaagcttacattggtgctgtcctcaacgctatcaagtatggtcatcctttttcaaattttagtcctcacgttaatatatttgactgatcggtggtttagtttcggtttacttgactctctctttgtgacaaataatttgactgat

SEQ ID NO: 63071 - DNA, 447 bp, Triticum aestivum
  Clone ID: PAT_TA_63071
ttggaaattggaactgatttgggggctcattgtttatttttggataggcatagtacttggtttatttgaagatggtaggtataagtctgaatcaaagaaaccatctttgaaagctgttgatattattggatttggaactggggctgaggtagaaaagaagctgaagtatgctgaagatgtttcttacggtgtaattttcgggagagagctcattaattctcctgccaatgtgcttactcctggtatgaattgttgtcatttatgaaatcaaatattttcgtgtttgtgtggtgttcgctgagttttcctaaactgctttgatttttgtatcgtttcagctgtactagctgaggaagcagcaaaggtggcttctacgtacagtgatgtcttcactgcaaacatcttgaacgaagagcaatgcagagagttgaagatgggttcttacct

SEQ ID NO: 63072 - DNA, 453 bp, Triticum aestivum
  Clone ID: PAT_TA_63072
acttttataaacaaaatcgggtgttatgcttcctaacctgacagatcgtgttgccaatctggaattgctctgtcataacacgaagagtgctttgagagacattgtaactagaatccatgcatgggtatgcaggagccattattggcatatgatgatagcggtcacgacgattttttcgtgggtcccaaacaggaaagctaaggtcatcttcttctattgcacaaagcacgactggattcggccagcgccattgtgtatatactctaaaaaatcgtgaaaccaacatactaggaatagcatttggataaaactggcaaaggcgtgcaaccagaagtgcccagtttacaccaccaagaaatccagttacctgctcaatataacagagattacaagagctgtaacctaagaatattgtcaacagatgtgatattcagaaagacaccaccttacatt

SEQ ID NO: 63073 - DNA, 139 bp, Triticum aestivum
  Clone ID: PAT_TA_63073
ggctggcgattgggtccctctaatgccgtgaagtcctgtgcttccctcggtcttagacattgcctgtgccatgttctcctgtgtgacgtccttacttgatgtgaatatttttataggccttatctgttggaatatatcc

SEQ ID NO: 63074 - DNA, 459 bp, Triticum aestivum
  Clone ID: PAT_TA_63074
ctatcctattctaagagaagagcaaacccaacaaattgttgaaaagacatttaggtaaatactctctcaatgtatataaagccatggagccaaacactaagcttatcgttcttaccttggttcttgcctttacactcacggcagcaaccggacagatcttctgcggtatgacttctacttgtctgaactcttgcaagccctatgtgtaggctaggaacccaatgaccaccggaattgatcccttgggcccttgctgcaatgccctgtccaaggccgatttccagtgcctctgtaagcataaagacagtatcaatgtccgtgatatcgagctttgacctcgctgagaaactcccggagaagtgtggattagctgctgcaacttgctagtaggttttctttcggaaggtttcgctttgtggtttggttttcatggttttcttatactgatttatattgatg

SEQ ID NO: 63075 - DNA, 515 bp, Triticum aestivum
  Clone ID: PAT_TA_63075
aacgtgtatcccctgttgattgcatttaggtttcttaattttgtcacctgttggttctactcgacccaatgatcgtgtagggcttttaagttcttatttttacttgtttgaatcctgacctaggattgttactagaaacccaccatcattataatctggcttgactttgttgtttttgtgcacatcttgattgctagcaatacagtggactggattgacaccctgtataactgcatcgacatgtttgtgttttaggggaattgaactgaatcacacattcaccataagcagacctgaaaaacctgtttatcaatttggcgccattgccaattcattgttgcattgttacattcaagatatcagaaacttttaagatcaagttcttttacatttatcaagttactaactcatattttcgtctgcttgtttttgtggtataggtactaatctttgtgcatgcaaactcgatccaaaggttctgcacacctactaccattcaaagacagaattgacag

SEQ ID NO: 63076 - DNA, 477 bp, Triticum aestivum
  Clone ID: PAT_TA_63076
tttagagcattcttgcctctcagcattctcttatccagaagcataagtgaacactcatggtttatatcaattttttctttaacttgagtacgacgccataaactgtccgttgccatggaaatcagttctgtaccatcatccctttcacacttgatgcgtttgagaaggtctagaatttgattaagttcatcacattccaaaaagcagatactctgaggtgtttccactaaacggcactcggtagtaatagtgttctcggaaacttcaaattgtgcgataagatgcttaacaggaaaccgcatcatccagtctcgaatactacaagagagaattttacgctccaacaacaacacaaggagcaatcggatttccttgagtaacttcctgcgctcttcatctgcagctaaaggccattctttggaccacccattcacatatacaaactcttttacaaactctagccggttcttgatcatt

SEQ ID NO: 63077 - DNA, 437 bp, Triticum aestivum
  Clone ID: PAT_TA_63077
ttaattggaatttggttattcaccatgtacgaggatccccactaagcatccatggctgtatggttaatgcgcccaactcataattggcgaattcgtaggttcaattcctactggatgcacgccaatcggaccctccaataagtctattggaattggctctgtatcaatggaatcttctcatcatctatacataacgaattggtgtggtatattcatatcataacatatgaacagtaagaactagcattcttattgagactagaactcatagggaagaaaatcgatttatggatggaatcaaatatgcagtatttacagacaaaagtattcggttattggggaaaaatcaatatacttttaatgtcgaatcaggatcaactaggacagaaataaagcattgggtcgaactcttctttggtgtcaaggtaatagctatg

SEQ ID NO: 63078 - DNA, 443 bp, Triticum aestivum
  Clone ID: PAT_TA_63078
aatttctccaaaacttcataagaatcagctgcactctcaggtttttcaccttttgctttaggatttgctttcttagtatcaccagcaggtccattacttaacttggccttaggcttatcagtgggaagagcagacaaccgagattcagcaacaatgtacacttttccagtgttcttgttacgaaccttcacatagacaaacttcgcatttacacacaaagcaagattgcttggaagagtccacggagtagtagtccatgccacaaaagcagcattatcttgatccccaataaccggaaaagtcaccatgatttcaggatcagggacttcctgtacatacacacattctaccaatatcagagatcaaactatacaacacaaatcaatcacctgaagaacacaataacaacaacattaccttatagttctgaccagcttcaaaat

SEQ ID NO: 63079 - DNA, 478 bp, Triticum aestivum
  Clone ID: PAT_TA_63079
taaagaaagaaacttgtgtggatcatttttaaatgagatgaaatccagttgtcagttattctcaattacacaattttgtgttgactttagattctgttagttctcaccgtctctttctcgattctacatgttaggccaaggaggtctctctagacaatgcatattcagaccaagaaatagaaaagaggtcatcagttgtattgttcaatgcctcaaagaaagaagtgaaacaagaatcaagcttcaagcaggaaccattattatgtgaaccacaaatagaagcaagggttaaccccagagttttcagatacaacccaaaattcaaatcaccttcgacgaacaacacttctttacatgagttgagaccaatacaaatccaagaatccatctccatgaactccaacagacaaaagtctccagtagaccaagaatcatatgacaaggaaaatgttgacggccatagtactgaaactggatt

SEQ ID NO: 63080 - DNA, 478 bp, Triticum aestivum
  Clone ID: PAT_TA_63080
cttttaggtatattctcttgtactaacggatatttgttgtttctagtattttttttcctcagatgaatctgaattcttgatttgtatgttctgtacatgttgtgaagtttaaactagaaaaagtgggaggatagtaacttgaagcatatgagccaaaagtcaaactatttaaaaatacaccaaaggagcttgagattgattaggtaatttaagttagttattctcacgttctttaactatatagtagtgcttatttccttcctagcattaagttgcagaaaaaacagagaagtagagattttttctcttctcttcaaatttcatagttcattaaaatttgtgtgttgaatgaggcaatctcatgtttaagattgttcttaaattgtcctctgagtgattctagttggttttgtcttttgactttctgttgtcttgatctctctattcaggtttttttggtcacgtgagaagaagcttt

SEQ ID NO: 63081 - DNA, 495 bp, Triticum aestivum
  Clone ID: PAT_TA_63081
gactgttactcataaaaccagccacaaactcaaccaccatatacgccgtattgatcaaaagaaacaacgcaatcttcctcgatttcttgtcgctcaaaatgtgacggataggcttcataaacatagtggaaaacgactcaggcgattccataccaatctcttgataatctgaatacacagactccaactctctaacagcaatgtaaagcaacaaaccacaaagcaacaatccccaaagagatagctcaggaaaatagaagagttccaatactatagtacatagaaacgttacaagaaactccctctctgagtccttcttcgagcttgaaaacttatcatcattataattctcactcaacaacactccaaatacaacagtgttagctaaaggccaacctaaattcccaaaagagacactatcatcaccactaccagagaagaagaaactccaaatagcaagtgggaacaacaacacagtggttagaaacaaagaca

SEQ ID NO: 63082 - DNA, 372 bp, Triticum aestivum
  Clone ID: PAT_TA_63082
taaaataccaaagtggatgattgactcttttccatactagaaagaatcgcaggaaatggggtgatttgacggattcagcctatttctcaatcgtatcccacgatcaagacaattggctgaatcccgcgaaaccattttagagaagtccatttgatatcttctttttctaaagcaaatcgacttcgattcttgaataatccacatcacttctgtctctattgtaacaaaagattccctttttatgtggaaaaggcccgtctcaataattctgattttacgtttacgtatggacaattcctcactatctcgttcattcacaacaaaacattttcttcgtgcggtggtaaaaaaaaacatgcttttttggagaga

SEQ ID NO: 63083 - DNA, 343 bp, Triticum aestivum
  Clone ID: PAT_TA_63083
tatatgaaatccatctggaaagcttgaactaattcgatcacaacttaaacttgaacaatttaaaagcatattataccttgtcgtctggggggtcagataaagacccccagggactatgaactgaagcctcaaaaaagtcacgaaggaagcagaaagctgcatatggtttcaaccagccctttcaaagataacaaaaatccgtaagccaatggaacgctgacgtggccttaggaggcataagttctatgcagacaattcttaagagatatcaaggaaacaatatcagattttgaagcataccttgcttttagagaagaatttctggaaggtgcttgagttcaaa

SEQ ID NO: 63084 - DNA, 433 bp, Triticum aestivum
  Clone ID: PAT_TA_63084
gtgacgtttgtttacccctgacatatttatacaaagaaatcgttatagcctatatcatgtaaatacacaccccacatgtagtgggattaacaataacacgttttataaattttaaaacaaatggatttagtattagttaacgttttacccattcccgtcgacttttctcaaaaatgttctctcatgtcaaaacaaaataagaaagaaagatggtcaaaccatgcatttcacacactaagtatttgggtaaacattcatgcaccatttgaatttcaactctagtggggatcttcataatatctctcccataacccctcccatacgaattctccagacgcctatctatctatctattattatttaattcgatctctatgactaaaaataatcacacattaatatgggagtttctctaataatctctagtatcaaa

SEQ ID NO: 63085 - DNA, 344 bp, Triticum aestivum
  Clone ID: PAT_TA_63085
caacgacaatggcagcggtggcaaagtggccttgaagagctattgtttgacagcttttctatatagcacttgatcattgctcctgggttggtgtatatgacatccccaactacacagaaaacatgtaaatgtgaccgccacagttctttacattgtgtgtaaccaagtctttggatttgattctctttcgcaaatatcacaccagtatttgccgcttgccttttcttcaccataacaaagagtgagtggatgatcattatacctgggaagcattaccgttaatggttgagtggcacaacggaaatccaaaaagtaatctgatttggtacaacctatggcgactc

SEQ ID NO: 63086 - DNA, 317 bp, Triticum aestivum
  Clone ID: PAT_TA_63086
gaacttaaaccgcaatcttatcctaaaagcctaagttttgtttttttgttcgaagatacaaagacagagactcatattgacttcagctaaaccatcaatgctttgagaagcaagaagaagcttggttagtgtttcggagtccaatataaattgatgtcatgtgtatgattgagtataagaacttaaaccgcaaccatagcctaatagcctaagtagtgtttccttgttagaagatacaaagataaagactcatatggactttggctaaaccatcaaagctttgagaagcaagaagaagcttggttagtgcttttgga

SEQ ID NO: 63087 - DNA, 494 bp, Triticum aestivum
  Clone ID: PAT_TA_63087
tttattatgtttctttactatgtgtgaaaactctaaaattatattattcagaaacatagtttgtatgtttcagtgaacaaagttgaagataaatactttttaaaagtactatactgaaatgctatatttattatatattgttaacaatatttaattaaaaatccgaatgtaattattttctataaatttttagatttaatttattagaaatattctcttatttctatatcgattatagtaaaaaaacttcacaaattctcttatataaaatacacttttaggtgtaataagttaaaccagtgtgttatacaaaaacttaaagcttaatagtgtctacagaaaaaataattatgcaataacataatttcttatcttatctcatattaaaacttctgaactaattatcccgtgcattaacacggatcattaccaaggtttgtaatcaaaattaccttgttttaattaaattataattttagatttaaaataaatag

SEQ ID NO: 63088 - DNA, 382 bp, Triticum aestivum
  Clone ID: PAT_TA_63088
atgggcgacccgcagggaggttttcacgaaagttgacctggagcatttttttcagcaaactgccaaagagcaggatgatgataaccaggagctcaattaagaactgtttgaaaacgcattgagcctgcccatggtcaagatcaggcaatgcctggtgcccaggaccgaaatagaagggcttgatatcagcacacccatcgaagagctgaagcagcagtttatcactacccaactcagtaagctgatcgtgtatgatgataatatcgattccatacaagggtatgtgcaccagcttgacctgttcaggaaacccggttccatcagggagatcctgcaccccatcatggctgtttcggaaagcatgagcgctaccgacctgatc

SEQ ID NO: 63089 - DNA, 397 bp, Triticum aestivum
  Clone ID: PAT_TA_63089
gagagtctagggcatagttccaaggaaagacatggccacctaaaggagagatgttccgattacagaagagagccccctcggaaaggtctaattttaggggaaccggaagtatgaaagaagtaaaggagaaggaggtattttaaagaagaagtggttggaaactatggacctcaactgatctgttctctcttgtggttttgctacatatcctgcattcgagactattcggtaaccctaaatactttaactccaccacataaaaaccaaattcccctttcataccaagctccgtctaccctgacaccttcaaaagagaaagaccacgccaaacatttcaaagaatgtaaagagttgactaacgtgaattcaaagttctgtaggatcaaagcggatggac

SEQ ID NO: 63090 - DNA, 485 bp, Triticum aestivum
  Clone ID: PAT_TA_63090
gagaaaacttttagaaaatattctttttaaaaaatttaggagttagatagatgatttaattcttgatttacagtaatagaatttgcggcgaatttttgttttaaaaaaaccatgattatttttttgtcattttttttcatcgttggatatgtgaaacaatttattttcactttactgtagccttttgctatttaaagttacgtcatagagctcttttagtaatttataaataggtgatatagtatatttggaagaaatataaatattgaccggctttttttattagtctaattgggttaattaattcacatacaaacaaaataaaataataataaacctcgattttggaagaaatgtaatttggattcctaattgtaacttgtaagtagtaggtccaaatttttattagtacatgatgtgattaaatccttgaaatcattgtcatattcatatagaagaaaagctgagatttattatttattata

SEQ ID NO: 63091 - DNA, 482 bp, Triticum aestivum
  Clone ID: PAT_TA_63091
ctcttcccgcacctagcaaatggtaagccaagaaagccaactgacggcattgcacatgtgcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaatgc

SEQ ID NO: 63092 - DNA, 481 bp, Triticum aestivum
  Clone ID: PAT_TA_63092
cctcttcccgcacctagcaaatggtaagccaagaaagccaactgacggcattgcacatgtgcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaat

SEQ ID NO: 63093 - DNA, 491 bp, Triticum aestivum
  Clone ID: PAT_TA_63093
tgttctccgacctcttcccgcacctagcaaatggtaagccaagaaagccaactgacggcattgcacatgtgcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaat

SEQ ID NO: 63094 - DNA, 466 bp, Triticum aestivum
  Clone ID: PAT_TA_63094
tgttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacatcggtgttcgtcaacctggagagcgaattgacaaaacggctggagagcggcgagggcacctttt

SEQ ID NO: 63095 - DNA, 143 bp, Triticum aestivum
  unsure (1)..(143): unsure at all n locations
  Clone ID: PAT_TA_63095
tttatncggtggaatcttctatgctaaagattacctatcttatgtgcttttaggctgaattttgcggatttgatatgctattctggtgagacctaagtatctgtgcaatgagaactgcaaaccaccttgggatggtcttttta

SEQ ID NO: 63096 - DNA, 278 bp, Triticum aestivum
  Clone ID: PAT_TA_63096
tcggtttgcggcttttctgggcggtcaccggctggttctccacgggcggtgctccgggggcgccggcggtgagggccaggccgtcggccggcacggtggacgtggcgcgcttcgcgttcggcagcgccctgctctggcaccccagccggtgggacagcttccccgtctacgagcccgacgcctcacaggatttcgtgaagttcgtgcatcggttggccgcggtggattacaacaagtctggggggatgcccaaccgggattgctcggaggttatggtg

SEQ ID NO: 63097 - DNA, 242 bp, Triticum aestivum
  Clone ID: PAT_TA_63097
cccacgcgtgcggtccgcctcaggcccgtcggggacccccctgaccgccttcccgcggagcgcttgtcgtagctgctgctcggcggcgccgagtgggacttcaggctcctcgactgccgccacggcctcgtgctcatctgcgacacctcgcggaacatggtgactggtctgggaccccgccaccggcggccagcactgggaggacgctcagggagaaaacccccatcagctgggcggggctt

SEQ ID NO: 63098 - DNA, 318 bp, Triticum aestivum
  Clone ID: PAT_TA_63098
catacgtgggcctggtgccccatcgcaggagacagccatgccggcagcaggaaagtccatcaatgtccgcgaattcatcgacgagcgcgcggtcagcccgttccagtggctggtcgggtttctgacgttcgtcgacatctcgctggacggatgggataccgtcatcatcggcttcgtcgtgcccgagctcatcaaggaatggggcgttaccaagagcgcgctggcgccggtactcagcgccgcgctgttcggcctcgcggccggtgcgctgctcggtgggccgatcgccgaccggttcggacgcaagcgcgtgctggt

SEQ ID NO: 63099 - DNA, 110 bp, Triticum aestivum
  Clone ID: PAT_TA_63099
ggttaactctagctgagtactcggccttgttttaatgtcttaactgaagtgaaccttggcaattagtgggtctgttaatgtccatcggtacttgtatgcttgtgtgtggc

SEQ ID NO: 63100 - DNA, 295 bp, Triticum aestivum
  Clone ID: PAT_TA_63100
tcgtccctcctctctgtggaggaaggagagagacggaccccaacatacaggggcggagagggatcatgctgaagcttaggctctgtctcgtcgggctccggccagagaccgactactgctaagaggatggccaatcggaccagcgtgcccaagttcggcacctgggacagggacgatgtgggctacacggtctacttcaataaggtgcgcgagaacaagggcgccaccgcgccgacggtccatgggacgctcaaccccaacgacccttaagaggaagccccgagggtgatccccc

SEQ ID NO: 63101 - DNA, 165 bp, Triticum aestivum
  Clone ID: PAT_TA_63101
cccacgcgtccgcccacgcgtccgaagatcatgcaaattgctttgttgcatactactccgtacataacatagttgaaccatgagcatccatcactctataaaatcatactaaaatatgttatgtacggagtagtatgcaacaagatcatgcaaattgctttgtaa

SEQ ID NO: 63102 - DNA, 122 bp, Triticum aestivum
  Clone ID: PAT_TA_63102
cgtcttgttcctatttctttgcattgcacacatacacagttttgtttcatggaaagtttgtagccctactgctagtgtttgatgatgatgatggcgatcgccattttgtccaatcaaatcaa

SEQ ID NO: 63103 - DNA, 389 bp, Triticum aestivum
  Clone ID: PAT_TA_63103
tcttggacgcgtgggcggacgcgtgggcaagagatgcagcccttcagtccagaaatacagagaaccaaacagggcgagctgttcccaacaattccgaagcttcgtctagttgtcacactgtgcagaagagatcaggaccactgaagctcactcccggcgcgaagcatatactggtgccaagtgatagcacgcatggcgactctatgcctgtgtactcctgtttatctttcggaagtaggagcggaaatgctgcagggtctcagaacaaaggagcatgatagactttgtgaaatgctgtttaaccttcagaagtaggagccttttgaaaaatgtttacatttttctatctgtaaaactggattgactatcctgtaagaatagttaccata

SEQ ID NO: 63104 - DNA, 179 bp, Triticum aestivum
  Clone ID: PAT_TA_63104
tttcgttcgcccacgcgtccgttccattgtcttcttgttcttggtgaacttgatgttcttgtcgagcttgtggaggagcttgccgagcttggggaggagcttgtgaaacttgacgatgcacgtgagtttgatatattcgtgcttgaacttcatggctaagtgctctttgttgctcatga

SEQ ID NO: 63105 - DNA, 315 bp, Triticum aestivum
  Clone ID: PAT_TA_63105
ttctgtccacgcgtacggggcagtccatagtcccatccagactgccgggaccactggactgtaccaatgtcagagcagcagattactggtactaccatcactccgcactccgcagagatcacggggtccagcgtgagcgctcggcgcagcatatcggcagccatggtcacggtggttctgaccctgctgctgctggtgctcctcccggtgcgccatgctgtcgccacggcggacggcgactcgcacccgggctacgcggacacggaggccgacacctgcggggcggctcccggtggctctgcccgttccggagga

SEQ ID NO: 63106 - DNA, 326 bp, Triticum aestivum
  Clone ID: PAT_TA_63106
aaaatatataaaaaaaaaaaaaaaaaaaaaaaaaaaaaaaaaataaaaaaaaaaaaaaaaaaaaaaaccaaaaaaccaaaaaaaaaaaaaaaaaaaaaaaaaaaaaaaaaaaaaaaaaagggccgcccgcccaaggggacccaagctaacacccccggccagccaacgaaaaagctcttcaatggggcccccaaaatcaaatccccggcccgcggtttaacacccccgggacgggaaaaccccgggcgtacccaaactaaaacccctggcaaaaaacccccctttccccagcgggcaaaaaaccaaaaagcccccccccaaccccc

SEQ ID NO: 63107 - DNA, 111 bp, Triticum aestivum
  Clone ID: PAT_TA_63107
tttcacgcgtccgaaaacttcagtagcggcttgtacgtatggaaatgtaattcttgatgtgaatgatggcagagaatccaaaattggctctaatacgtcaattatttgttg

SEQ ID NO: 63108 - DNA, 159 bp, Triticum aestivum
  Clone ID: PAT_TA_63108
tgctcacgcgtccgcccacgcgtccgggatgttagattagattagctttcttgactcgttgactttcttgacttgttgttgttttcccctgtgccatgtgtataccgttgtgctgactcatagattgtgtgtatcaaggataaaataccttttacagtg

SEQ ID NO: 63109 - DNA, 262 bp, Triticum aestivum
  Clone ID: PAT_TA_63109
ggttattgtgcggctggtgattgagggcaaggaaggtagtcagctcagggcccggctagctgctctcagggaagaggcagaggcagccctgcaggaagggggctcgtcgcaggcggcgtttgcccagtttctgttggatgtggataatcttgaaaggcagctcagcgaatgatgcactagtatgtacatttatgttgccagcatgttgctagtccaagccgcccctgtttacattttggttgtgtggtcaataacttaagtc

SEQ ID NO: 63110 - DNA, 105 bp, Triticum aestivum
  Clone ID: PAT_TA_63110
aggtgttgtgctactcgacccgggcagtgctgcatctaaggcgttgagcatcccgcccagggacatgcgcggttgatatacaattgatatcacagacgtttattt

SEQ ID NO: 63111 - DNA, 133 bp, Triticum aestivum
  Clone ID: PAT_TA_63111
tttcgctgatttaccgcatgtaatgttcgcatgtacaggtctgttgcatcaaaatttgcctagaatcatttttcctcatgggcctgatacagagaacacacatacgtgggggcccctctgtttcgggggcccg

SEQ ID NO: 63112 - DNA, 157 bp, Triticum aestivum
  Clone ID: PAT_TA_63112
tctctttctctcttaaagtcgcgtcccttccgacggaaccccgccattaatccccacgaccgacatgccgtgtttaattctctgtaccacctagctctagtagatgatccatgaccggaccagtgttgcttcctaattgtgcttgatttcgttgctc

SEQ ID NO: 63113 - DNA, 280 bp, Triticum aestivum
  Clone ID: PAT_TA_63113
ccaaggtgaaggtgaaggactgtgcgagcgcgctgagggccaaggcgaagatcgtgtgggccaaactggcagagaaaacggaggccgcgacgtcgaggtcgcacgacgagcggcagctggcgcatgagcgcggcagggccaaggtcgccgccacggaggcgcagcttcaccaggagaaggtcgcgcatcgggaggctgccatggagcaccgcctccacaagcacgccagcgtcggcggtcacaaccacaagcacggcgcccgtggcgtgcactgatatat

SEQ ID NO: 63114 - DNA, 129 bp, Triticum aestivum
  Clone ID: PAT_TA_63114
ttcaagggaataggaggggattcaccaaaccattcctcggagatttgcactcccagttctcttgtttggcttgtggattgaattaaatattgagagctggacaaggaattcatatccttctgtttggtg

SEQ ID NO: 63115 - DNA, 170 bp, Triticum aestivum
  Clone ID: PAT_TA_63115
tttgttagcagataaagttcaccttcagatgtgccggacaactgatccccggggccagttgtctcaacatgttgcattagttgtgacatcttgttttttgtttcggtttacactcaattgcgtcaaagcttcaaagaaaatcaactgacttgataagattttccggtctc

SEQ ID NO: 63116 - DNA, 415 bp, Triticum aestivum
  Clone ID: PAT_TA_63116
ttttttagcccttccaagttatgatgatccatacatcaaagttccaaatgcactgaccaaagtaatgacatgtgggtctgtaaatcaaagttgtgattattgtaacattctatttcattatacaatgaggcatggtgaatcaactgagcttgcaaaacatcgaacgagcaatcagcaagcctgagttaagtttgacatcctcggctagaacagtacgactcaacaatttgagcgatggatctgcagtgcctgcaatagaagatccatccttgcgtgccatcctgtgttcggaccaaatacatgtcattttcttaatgtgcttttatttatgtttctggaatgtgggggcttcttgcgccatgccttccaaacggcgatagggttcatgtgatgctattacccggtaatttgtctt

SEQ ID NO: 63117 - DNA, 404 bp, Triticum aestivum
  Clone ID: PAT_TA_63117
cactggttccttatgctgccgtgtaatattaacatgtttgcgtttttgtttgactaactcctgttgtttttcccttttcagaacttcaaaaattccaagagcttgggaaagaagaacctataacatcactgcatgatggaggagaaagcagcagttgcatacacgcaggacacgaaggagctagtgaagcaagctcttcttaccggtttgggtctgaaaagatgggagaaatggaattaacttctctagattccgagatactaaacctggtgaacaatgtagagcatctggagatcaaactagaagaagcaaagcgtattcttgaggttaaagaaacacaaatccgcgaactcgaatctaccataaacgtttcagagacgtgtaacggaggaacagagatcggg

SEQ ID NO: 63118 - DNA, 392 bp, Triticum aestivum
  Clone ID: PAT_TA_63118
ggacaggtcgcgttggcagctctcgatcctggcagatggtgatggcgttagcggttgtttactcttttggattctgaatggatttccctggaagttttgtaacttttggtgcagaggtagatgctgattggccttccaagtatctgagtttggtattcaatgcctccactttggcattcaggtcattgtagctgcagtccagcttatggtgcaattcagataatttcttagccatttccattgagctagatgcttgtccctgtagcagctgctggaccatctgtttcatttcagcatcaggggcagcaggaccttggttttgctgaggtgcaaacccaggtggtggtggttgctggtagttcccctggaattgctgcttaggaacgaaacct

SEQ ID NO: 63119 - DNA, 479 bp, Triticum aestivum
  Clone ID: PAT_TA_63119
tagctttccacagaacaacactcttaaacaaaattcacactgtaaaattttgcatcgtttattcttgtttagaggcatttcgaaattaaaatatagaactatcatatacgagacattgacaagtggaatggctattgactgtaactagctacaagcgatatcgtggtacattaaccggttaaatcgtatagttcccgttcccggttaagcgtggtttccaccatcacatcattccatgaatcaattggaccaggtaagcaccaatgcagacaatcattctgaacattgctcttattcttaactccagcaaaaggatttggatgcctgtacggtcccggatgcccgtctggacggagaagagacattccagtcgtgtctaatagcctgatgttggaacctaagccaaaacctttcccaaatttctgaaacacctcaagctcaacatcacgcatcacatcatctacagttttcatatttgc

SEQ ID NO: 63120 - DNA, 510 bp, Triticum aestivum
  Clone ID: PAT_TA_63120
aactacaggcagtggtttttttcttttcgttattgtcacaagaaacagacaggtattattcatatgcaagagatggatccagcttctgggctgctgactctttagcgagcttctctgcctttgcaaccacctcatcgatacctccaaccatgtaaaacgattgttcggaaagatcatcgtacttgccatccaacaaaccctgaaacaaacacaagatgattttggtcacttactcttactctaaatattctatttgataataacaaatctatctacgccagagtaaatttagtccatctacacatagacatcacaatgaattcttctatactgaaaggcagttgtagctaaacttctaatacgcggacatgttaaggcagcattgaaagctttcaggaattcaaagcaaaatgtttgataatcatatgattatagcaaaatgttgttgtatgtatcatacctggaaactgttgatgttttctttaaggtcgacatattttccaggggcac

SEQ ID NO: 63121 - DNA, 421 bp, Triticum aestivum
  Clone ID: PAT_TA_63121
ctttgttttcctctagaccaatgagcttgttgtgtctgtttatgtggcagttctcgagttcttaatgtttccaatcgatgaccgcatcaatgtctattgagtccttacacgagatcatgtaacagcaaacctctctgtctgttacagattcaagccctttgcatcaaatcatttcaaagtcatatactcgaatccagattgttttgtatggactttgtataagaaacttacagttgatcaaccaaagcttgcttagagagagcttcagacttatcgattttgctgccaagaatcagaagaggaatgccacttaaagacggtttcgttagcagatcattcaattcgcttcttgatatcggtacactattcttatctgcagcatcaatcacatatctgcaatattaccacagtaacatatacc

SEQ ID NO: 63122 - DNA, 427 bp, Triticum aestivum
  Clone ID: PAT_TA_63122
tataaatgttgtctaaacactcatactccatttctaactcttatgttttgtcaaatgcattggattgtgacacatgtttaccatagaaacactagcaaagctatttactgcttctaagcaaatttttgttggtttttagcctcttttgggacaaaatgggtataagtattgtttaaacacttctacttcatctctaactcttatgattaggtaaatgcattggattgtgacacattttgaccatacaaacactaacaaagctatttactgcttctaagcaattttttgttggttctagcctctcttggaagaaaattggtataaatgttgtctaaacactcctaaaccgtatctaacttatataactagtcaaatgctttgaattgtgacaaaatttgattttgaaaacactaacaaagctatttac

SEQ ID NO: 63123 - DNA, 344 bp, Triticum aestivum
  Clone ID: PAT_TA_63123
ttccttcccttttgctatgtatttggacaaagttgggctaaagttgggtaaattcaatgttttttttctccctaatttagcttatcggttatcttctttagtactacaatgacccgtcaaaggagaaacttttgaaaagctaacccacaaagtagcttttttgttcagttgagtactcatttcgtttttctcttatccagtctcatgtttgtcaatcttgattaggtttttgcctctcctctttcacaacttcttatcaaaggttgaaggttgaagcaatgatggatatgaaggagagaatggtgaagaaacttaagcttattacatctcttgggaacttgaag

SEQ ID NO: 63124 - DNA, 437 bp, Triticum aestivum
  Clone ID: PAT_TA_63124
gctcgctggaagagttcgttccgggatgttttgctttgatcgacttctcggcaattaacgaaattctccctggcgtgcttggcgtaatacggccttgaattcgccggcaaaagtctcaccagcctcataacgccgccgtatactctcagcaccttcttaattttcgattaccttctgcaacacgttacccaattctaggactctaatactgtatcataaacatccatgggctcttaatgggcctttaataataagcaatcactgaccggctaaacgttcacatttgagggtctaaaaccggttcaaacaagacttttaaagcttaaatctcttgatcttttaaaccggtctctatcgattacagaaaccataactcaaaacatctctttagatggaaataaacaaaaacttttattatcttaacacaaagccttaac

SEQ ID NO: 63125 - DNA, 428 bp, Triticum aestivum
  Clone ID: PAT_TA_63125
aaacctgttcaatcaccatttgaaaagtacagaatttcacatttattagagcttggagtttctcatatattgaaaagtttaacagcacaaaacacttacccatatggctaacagcaccgagctcttgaatacaatcccacaccatttccatatttggttaagcaagactgaagtcctctttgacttgacatgctcgatagcatacctggccccagatatggtagtccaaaaggcatatgtgccaatgacgaaagcatacaaatctacatatttttagggaatactgttaataatgtgtaacccgtgccaaagaatgactcagaagatcaaaattaacaaacattaccattgcacttgatgccatgagttattggaagaatgggaatggcactgaattagagcacgtcccagcgaaactggcacaacta

SEQ ID NO: 63126 - DNA, 244 bp, Triticum aestivum
  Clone ID: PAT_TA_63126
gattttggtattctgattcgatctaagcaagttaaattaaaagagacataatagttcttctctcttaattgaatctttctttacaaaattatcaacaaagttataaaagaaagtcccaataaccgaagaaatcgagacttacaaggcaaagtaccaaacacaaactctctggaatcactgcacaaacatatcctacttatgttgacttcttttttctcaaatctcaaaatgaaccttccgtttg

SEQ ID NO: 63127 - DNA, 460 bp, Triticum aestivum
  Clone ID: PAT_TA_63127
atgaaccacaaatgtcataattcattctaatggtctttcgttttgtaccaataggcaagttcgattcgtgaagcgttttgttgaagcgctttcggagggtcgtgttacagcacgaaatccgcagcatttggatctcttactggtctcaggcagacaaatctctgggacagaaactagcaactcgtcttaacgtgaggccaaacttctgaatgatatcatctctaaagactaagtgaaatcctataaactcaatatgctcctcttacggtttggtttctaagtaatctcgtttattgacaatgaaacgcttaaagaagggtactagttcctgtttgtaatcttcttttcaaaatattaacgattattttctaaggcaaataaataaaaagctatgactaatatagcttagtaaacaagtattactatcatccatttggttctactttaaaaatggattttt

SEQ ID NO: 63128 - DNA, 353 bp, Triticum aestivum
  Clone ID: PAT_TA_63128
attcttgaatacacataatttataaacataggttagattttcttagttaaatcagtgtttcttctaaagatcgctatcactcggggtacacatcctttggtgtgggttctcgcataaactttcacctcctataggacgctcttcagagaacagaggcaagaaataccctctaagcccctttagatctcatgattgggacaaagttgatagtagaagagacgctgccaggatttcgtcctcttttggcaatacaaatctacaatggcgagaaaaaactacttctagatgcagtccaagacgggatagctttgaagtattgataacacgacgttttagcccgttttatctattgt

SEQ ID NO: 63129 - DNA, 495 bp, Triticum aestivum
  Clone ID: PAT_TA_63129
tcttcttaaatgcatcatcatcatcatcatctaaactctcttcagattcatcatcattatctaaaacctcttcagatgcatcagtatcatctaaaccctcttcagatgcatcatcatcatcatcattatcatccaaatcttcttcagatgaatcatcataatcatccaaatccttcttcagaagcatcagtagctggatctccttctttccagcacagaggttcagttatcttcacagtatcctttggtacatcaataactggaagaatctgtacctcagcgacaataatgagtctatctctcacgagaaatccattgcctctagcatctgtaccttaccaattgcagtcagaggctacgaaggtgcgagagtagcaattgttatgttgcaatgaacagaagtttttcaaaacccaactgaatcttgtctccttttgcttgctcattattcttgatgaaacggttgaaagtggcggagcacaatagagaatcact

SEQ ID NO: 63130 - DNA, 235 bp, Triticum aestivum
  Clone ID: PAT_TA_63130
ggctaaatcgtgactataaagccacgaattggtcatgtaaaaattcgtggtaaatatagccacaacatagccacgaatatattcgtaaccaaatggtgacgagaaaatttgtggataattcgtcgctatacaatagccacgaaaaacaacgcggcttttcgtcgcaaatccaccgaattaaacatcacatcatgcaacaacaccgaattatacaatatccacgaatgggaaacgt

SEQ ID NO: 63131 - DNA, 484 bp, Triticum aestivum
  Clone ID: PAT_TA_63131
ttgctctagctagattgtccaaaggagcaaatatcaggatagtaaagaatctgagaatttgctgagattgttacgctgttatgaagctaacgtcgaaggttgtgtggggtagaaatattggtccgagacagaaatcgctttcattcatttaaggacggttcttgctcatgccgtgactactggtaaaaggttgtggatagatgtacaccacacatatatcattttgtggactaatgcatccactagtgacctcaccaatggaagcttcactcccaacacaaactttcagatctctctactctctacaacttgaggtcttcatttgcgaggtttgtggtttacattgccttgggactgtgggtaactttgatactttgtattcttcttggcctagaacgtaatatacgaaatttgtttggactgttatttgaaatttctaacagattctaccaaactttgaccagaaatatcaagcacgtcttcg

SEQ ID NO: 63132 - DNA, 471 bp, Triticum aestivum
  Clone ID: PAT_TA_63132
tgagtttggtggaatagagttctaacaatttcctcttcacctggtcaccggtagaagaaatgggtcaatgttagtaatcattacacaatgaactaaaatgtctttatctttgtggtcttatatgtttcttatcaccttttgctccatcaaacaaaacttcatgaatttgattattctggatttttttagaacacgtagttcatgtgactatttatgtggttaaggtctctactataatttggagtatccccaacgctttagctgtatatgttaccttggatagagttctaagatacaaacattgtataatctttttaaatgattctgataaactgatactgatcataataaaccaatatgagaagtagcacacaaaaaaaattacaatctagtgatttttagtcaacttacttttggtttctggaattggaggaaccacctcttcagcttcagctgctgcagcaagtgttt

SEQ ID NO: 63133 - DNA, 463 bp, Triticum aestivum
  Clone ID: PAT_TA_63133
agacaatcgctacttacaaggagaagcttctagcagcgaacccatttttaactgtttttcctgtctttctctaacctgaaaagaagacatcaatattatactcagctggaatttaaacgttttggctggaacgataaaccggccaaagaactcacctggcaaaacaattactgaccctacgaagacgccataaacgtagcatactgaaaataccatatccctgaatactctcatgaagcaagctcccaaaaatttcgtaaggaaatgtggaaaccacgtcgaaaatcagccaagtcgacgcatatctccaagctattctctttggatcatcgacaagaagataagttaccttgtccagaaggcaacaaagaatgtcaagactatatcaacagcgaaaaacccgttgacaatgttatcgagaatactgagaggtggtcttggcttttgcagaaacccaaattca

SEQ ID NO: 63134 - DNA, 323 bp, Triticum aestivum
  Clone ID: PAT_TA_63134
ctgtttggtttgtggattttgcacagttttaggaaattcacatattaagaagggaaatgaattttgactattaacatacctgttcaagtgcattaggtcgggattcaaaaacaatcagaagtacgcctaatggtgatgaggttttctctaagacaagaccatttgccacctgtaaaaggaattgtcacaaagaacaaatagcattaacaactattgtatgtcaactaggaggatagtcatattccttatttaactcatgagtatgtaaattaactatatggtaacaattgtcctctgatcacctctgttttctttaaaacacg

SEQ ID NO: 63135 - DNA, 443 bp, Triticum aestivum
  Clone ID: PAT_TA_63135
agcctataataatgcgacagaagctactgagagtctgagaccacaaaagttgaacatttttgttacctaattataatatgctaagtagagggcactttactttgggtgtaaatgtaacagaaacccctgaaacgaactcaagcgcctcgtatgatgtgtggtttggatccgcatagacctctgtattgagagaaagttgattacagataattagatcatctcataaaaggaactactcaccaggcttttttagtaatcaagagaaaacatacctcctttaaacttagtctgttccacaaaagtattagcctgcatacatagatggtcataacgtgagaagcagcagcttaaaactgcttacgcttacaaaaattgcgtattcaaaatgttgtttacctgatcgatgctttccggtccgatcagaacaagagcaacaccagatg

SEQ ID NO: 63136 - DNA, 440 bp, Triticum aestivum
  Clone ID: PAT_TA_63136
aatgcattagaaacttgggctacagaaaacgtgaacttttttaagatcccaacgaaaccttcaaagattatcattggtatccaactattgcatgctctggatatccaactattgcacgctcttcaactctcatcaacaacttttattttgacaaatgttgcgtcattcttacaagtttgccatataaaagaagcttatctatagctgcaaaccaggagccccgaaacaatggtttcatatgctgagctcttgtttgaatcaaatagactgtagaggagaaatcggcaaaaaacacaaaataaataaaaaacgacccagttgtatatgtttagatcaggatttaagccaggattacaaagacgccatccggctttgtggtagaccaacaacacagctgtttttggaacctcaatacagaccaccaaaacagttcttgctcc

SEQ ID NO: 63137 - DNA, 265 bp, Triticum aestivum
  Clone ID: PAT_TA_63137
tgaaatataaatagatgttcccttcgactttttgagatttcaactatatcgaactcctcgtcctaagaggatgattttacgttgatgcgacataacagttccgactcattactcatttttgtgatatcatggttaggggaaatcaacgactcagaaccataaacttgggaattaccacccaatgggagaagaatggacaaagaatttccttgggctctgtgatcaaactctgctggcacttctcttcctggtaacagaaccgacc

SEQ ID NO: 63138 - DNA, 383 bp, Triticum aestivum
  Clone ID: PAT_TA_63138
atgcttttcactttcctatatatttatgaaaactgcagtttcttatcagcccttttgtaccaaaactgattggaaagttccccccggagccgaggacagccattacagcgacaaataagacaatcattgatcctaacaactgcaccattttactcaacttatcagcgatttttcgagatttccatatttattgcagacacatgaaactaaacattgttaccaattctcaaaaggtgaatgaaaaatgttctacaaaatgtaagcaacgatgtattagtgtacctgaagacgcaaggagagccacaagcttgcgattatctctgagtaagaagtccgctggtatagcgtcaaatgctcaataaatttacctacaaaatgctcct

SEQ ID NO: 63139 - DNA, 431 bp, Triticum aestivum
  Clone ID: PAT_TA_63139
cgtactctcaatcttgtttcgtaagaaaatgtgaaaagaatataaagatttgaacaattttattcctgtttcttacaagcttagagcaatcataatacataacgattgtaaaacagtacagagaaaagttcttgtcatatttttacatacttaatctgaagttttcttgttctttcttgtttaaggttgagaagaaatcaacagagacacaagcaaagaagcaacgattgtaaacattaaaattccaatatgattcactccgttactcatcactacttggttttctgtatgtacaacagagataataatcatagctatggactatggttcaagcttcatctgaagcgttggctcagaacctgcaacataaagatacgagactttaacaacataagagatagttctatagtttcgatagacgaatttgcttc

SEQ ID NO: 63140 - DNA, 470 bp, Triticum aestivum
  Clone ID: PAT_TA_63140
aaggatttctttatgaacacaaggtagtgaactccatttgttagaacagcttccattgattctctgcacttatcccttttttcgcgctttgtaaactccggtttgttcgcgtaaaccaggatttggctcaggattgcccattgttaattccagggtttctctgaatttgaaagttatcacttagtaggtttccataccaaggctcaatccaattaagtccgtagcgtctaccaattccgccatatccccttttttaggatctcattatgatgtctttccttttttttcttatgccgaaacctcgggattcattacattatagatacttattttatgtctttgctatcttcttttatttttttgagctccatccatattgatttagtctaatcaacaaagattctatcatttttgtatttgcaattcaatatggttatatattacataacatatatatgttcttttttttt

SEQ ID NO: 63141 - DNA, 465 bp, Triticum aestivum
  Clone ID: PAT_TA_63141
agtatataacataggtgcgaagttaaaaaatgcaggtgggactattgaacgtggatggattctacgattcactattgacgtttataggggaggcagtggacgaaggcttcgtctcctccaccgctcgccgtatcattgtctcggctccaaacgctcctcaattacttcaacttcttgaggtttttttatttgcctttcattactttttgattattctatttaatactatagactaaatgaacgaatcccaaaataggataattaaattaattgaattcatttgtaatcgcaggagtatgttccaaaacacgacgattttgtattcaaaatggtgtgggacaataccacggatgctttcactttggaaggcgactcgttttagatataggtcatttgtatcttagtctacttttattttattattaaaaatctcggtttttattggccatttcaaatttttgattt

SEQ ID NO: 63142 - DNA, 514 bp, Triticum aestivum
  Clone ID: PAT_TA_63142
cattttgaccacggaaacactaacaaagctattgactacttttatataatgttttgttcgttttagcctctggggacacttaatgggtataaacgtattctaaacactcctaatccatctttaactcttcttattagtcaaatgcattggattttgacacatattgaccatagaaaaaccaacaaagctattgactgcttctaataaatgttttgttggttttagcctcttttggaggaaaatgggtataaatgttgtctaaatactcctactccatctctaactcttacgattagtcaaatgaaatggattgtgaaacatttttaccatagaaacactaacaaagctatttatttcttctaagcaatttttttgtttgtgttagcctcttttgggacaaaatgggtattagtgctgtctaaacactcctaatccatctttaacacttataattaggcaaatgaattacattgtgacacatttgaacatagaaacactaacaaagctattaact

SEQ ID NO: 63143 - DNA, 381 bp, Triticum aestivum
  Clone ID: PAT_TA_63143
tttttcttcagtacaggactaatgtttgccaagtttcaacaatacctttcccggggccaacattggggatttcaaatttgcgtgggtttgccttaagaagagctctaacatgagcatcaaccaaatcagtgacatcaatgtggatcccgtacgcaagttccatcaccggttttgcagtctggtcctttgatctggggaaaaagaaaagttaaatgaatatcaatgattagagaagcttgaaagcttatagccatgtgcatgtaacaaggagactaatttaaacactgctttaataaaggaaactcaagaattacgtggctcaattatgtattttgctcagctggaaactataactacttatcagctcttttacacgcatgt

SEQ ID NO: 63144 - DNA, 201 bp, Triticum aestivum
  Clone ID: PAT_TA_63144
cccgcacctagcaaatggtccgccaagaaagccaactgacgggattgcacatgttcagacacagtaatgctgctgctgctattcaacgagatcgattctaacctcaaagcgcccagatcccaatgacgagctagtggacgatgtccaccacgttgcagtcgcgccatgggccccgaatgcgaaccccggcgacatggcctg

SEQ ID NO: 63145 - DNA, 256 bp, Triticum aestivum
  Clone ID: PAT_TA_63145
tcttcccgcacctagcaaatggtaagccaagaaagccaactgacggcattgcacatgttcagacaaagttttgctgctgctgctattcaacgagatcgattctaacctcaaagcgcccagatcccaatgacgagctcgttgacgatgtccaccacgttgcagtcgcgccatgggccccgaatgcgaaccccgtcgacatggactggtccgctgtgccggtactgtgatccggcgacttgtcccattcgaccatcca

SEQ ID NO: 63146 - DNA, 365 bp, Triticum aestivum
  Clone ID: PAT_TA_63146
tctccgacctcttcccgcacctagcaaatggtaagccaagaaagccaactgactgtattgcacatgtgcagacaaagaaatgctgctgctgctattcaacgagatcgattctaacctcaaagcgcccagatcccaatgacgagctcgttgacgatgtccaccacgttgcagtcgcgccatgggccccgaatgcgaaccccgtcgacatggcctggtccgttgtgccggtactgcgatccggcgacttgacccattcgaccatacagttctcgccctcctcgtcggcgcttcagagctttgccgtgaccctgcaacaggtggccccttcgaagctgttcagtcacagtcgcagcggcattgagatc

SEQ ID NO: 63147 - DNA, 474 bp, Triticum aestivum
  Clone ID: PAT_TA_63147
tgttctccgtcctcttcccgcacctagcaaatggtaagccaagaaagccaactgacggcattgcacatttgcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggacc

SEQ ID NO: 63148 - DNA, 469 bp, Triticum aestivum
  Clone ID: PAT_TA_63148
gttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaag

SEQ ID NO: 63149 - DNA, 491 bp, Triticum aestivum
  Clone ID: PAT_TA_63149
ttctccgactctcttcccgcacctagcaaatggtaagccaagaaagccaactgacggcattgcacatgagcttacaaatttaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaat

SEQ ID NO: 63150 - DNA, 464 bp, Triticum aestivum
  Clone ID: PAT_TA_63150
ttctccgactctcttcccgcacctagcaaatggtaagccaagaaagccaactgacggcattgcacatgagcttacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaacggctggagagcggcgagggcacctttta

SEQ ID NO: 63151 - DNA, 471 bp, Triticum aestivum
  Clone ID: PAT_TA_63151
ttctccgacctcttcccgcacctagcaaatggtaagccaagaaagccaactgacggcattgcacatgagcttacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggac

SEQ ID NO: 63152 - DNA, 448 bp, Triticum aestivum
  Clone ID: PAT_TA_63152
gttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagc

SEQ ID NO: 63153 - DNA, 487 bp, Triticum aestivum
  Clone ID: PAT_TA_63153
ttctccgacctcttcccgcacctagcaaatggtaagccaagaaagccaactgacggcattgcacatgagcttacaaagtaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgccccattcgtccatgcccacctagtcctatttagtgcggctaaagagatctagcgcgaccctggaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagcccca

SEQ ID NO: 63154 - DNA, 435 bp, Triticum aestivum
  unsure (1)..(435): unsure at all n locations
  Clone ID: PAT_TA_63154
cttgcttgctccggccatcgaccatggagggcgaggcgccgcagtcgcaccagctgctcctgcacggcgtcagcctggacctgcgcctcgacacggccacggccacgcaccagctgcgcggcgcccggcgcccggcgtcccctgcgcctactcccgtggccttcgaccaggccggcaaggaggccttctcctgcaactactgccaccgcaagttcctcagctcgcaggcgctcagcggccaccagaacgcccacaagctcgagcgcaccctcgccaagcgcagccgcgacgcctcctccaccgccgccacggcagctcaaactgccacgccttcctctcactggccccacgccggcggcggngagctctgggcgtactctgcttcggccgctgccccggattccacgacgatggcgcccctgatgggcatgggct

SEQ ID NO: 63155 - DNA, 449 bp, Triticum aestivum
  Clone ID: PAT_TA_63155
gttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagaacacggtgttcgtcaacctggagagcgaattgacaaaacggctggagagc

SEQ ID NO: 63156 - DNA, 438 bp, Triticum aestivum
  Clone ID: PAT_TA_63156
gccaagaaagccaactgacggcattgcacatgatttgacaatgaaatgctgctgctgctattcaacgagatcgattctaacctcaaggcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcgggattgagatcctcgtcctcgacgttgctccccttccgctagacacggtgttcgtcaacctggagagcgaattgacaaaacggctggagagcggcgagggcaccttttacaaggacca

SEQ ID NO: 63157 - DNA, 488 bp, Triticum aestivum
  Clone ID: PAT_TA_63157
ttctccgttctcttcccgcacctagcaaatggtaagccaagatagccaactgactgcattgttcatgagtttgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagcccca

SEQ ID NO: 63158 - DNA, 437 bp, Triticum aestivum
  Clone ID: PAT_TA_63158
tcttcccgcacctagcaaatggtaagccaagaaagccaactgacggcattgcacatgagtagacaatgaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagc

SEQ ID NO: 63159 - DNA, 429 bp, Triticum aestivum
  Clone ID: PAT_TA_63159
tcttcccgcacctagcaaatggtaagccaagaaagccaactgacggcattgttcatgatttgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgacctcgacgttgctccccttccgttagacacggtgttcgtcaacctggagagcgaattgacaaaacggc

SEQ ID NO: 63160 - DNA, 475 bp, Triticum aestivum
  Clone ID: PAT_TA_63160
tgttctccgacctcttcccgcacctagcaaatggtaagccaagaaagccaactgacggcattgcacatgatcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcacctttttacaggacca

SEQ ID NO: 63161 - DNA, 348 bp, Triticum aestivum
  Clone ID: PAT_TA_63161
gctgctgctgctattcaacgagatcgattctaacctcaaagcgcccagatcccaatgacgagctcgtcgacgatgtccaccacgttgcagtcgcgccatgggccccgaatgcgaaccccgttgacatggcctggtccgctgtgccggtactgtgatccggcgacttgtcccattcgaccatccagttctcgcccttctcgtgggcgcttcagagcttcgccgtgaccctgcaacaggtggtcccttcgaagctgctcagccacagccgcagcggcattgagatcctcgacctcgacgttgctccccttccgctagacacggtgttcgacaacctggagagcgaattga

SEQ ID NO: 63162 - DNA, 186 bp, Triticum aestivum
  Clone ID: PAT_TA_63162
tgctgctgctgctattcaacgagatcggttctaacctcaaagcgcccagagcccaatgacgagctcgccgacgatgtccaccacgttgtagtcgcgccatgggccccgaatgcgaaccccgaagacatggcctggtacgatgtgccggtactgcgatccacctacttggcccattcgaccatccag

SEQ ID NO: 63163 - DNA, 468 bp, Triticum aestivum
  Clone ID: PAT_TA_63163
gttctccgtcctcttcccgcacctagcaaatggtaagccaagaaagccaactgacggcattgcacatgttcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaa

SEQ ID NO: 63164 - DNA, 406 bp, Triticum aestivum
  Clone ID: PAT_TA_63164
ctcttcccgcacctagcaaatggtaagccaagaaagccaactgacggcattgcacatgagcagacaatgaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacc

SEQ ID NO: 63165 - DNA, 467 bp, Triticum aestivum
  Clone ID: PAT_TA_63165
cgacctcttcccgcacctagcaaatggtaagccaagaaagccaactgacggcattgcacatgagctgacaatgaaatgctgctgctgctattcaacgagatcgattttaaccttaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgttcagccacagccgcagcggcattgagatcctcgtcctcgacgttgctccccttccgctagacacggtgttcgtcaacctggagagcgaattgacaaaacggctggagagcggcgagggcaccttttacaaggacc

SEQ ID NO: 63166 - DNA, 457 bp, Triticum aestivum
  Clone ID: PAT_TA_63166
cttcccgcacctagcaaatggtaagccaagaaagccaactgacggcattgcacatgagcttacattgaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaag

SEQ ID NO: 63167 - DNA, 484 bp, Triticum aestivum
  Clone ID: PAT_TA_63167
cgacctcttcccgcacctagcaaatggtaagccaagaaagccaactgacggcattgcacatgagctgacaatgaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaat

SEQ ID NO: 63168 - DNA, 388 bp, Triticum aestivum
  Clone ID: PAT_TA_63168
ctccgactctcttcccgcacctagcaaatggtgagccaagatagcctactgacggcattgctcatgagctgacaaagaaatgctgctgctggtattcaacgagatcgattctaacctcaaagcgcccagatcccaatgtcgagctcgtcgacgatgtccaccacgttgcagtcgcgccatgggccccgattgcgaaccccgtcgacatggcctggtccgttgtgccggtactgcgatccggcgacttgtcccattcgaccatccagttctcgccctcctcgtgggcgcttcagagcttcgccgtgaccctgcaacaggtggccccttcgaagctgtccagccacagccgcagcggcattgagatcctcgtcctcgacgttgctcccct

SEQ ID NO: 63169 - DNA, 318 bp, Triticum aestivum
  Clone ID: PAT_TA_63169
tctccgacctcttcccgcacctagcaaatggtatgccaagaaagccaactgacggcattgtacatgagcagacaaagaaatgctgctgctggtattcaaggagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacagg

SEQ ID NO: 63170 - DNA, 466 bp, Triticum aestivum
  Clone ID: PAT_TA_63170
ttctccgactctcttcccgcacctagcaaatggtaagccaagaaagccaactgacggcattgcacatgagctgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaaccgctggagagcggcgagggcaccttttac

SEQ ID NO: 63171 - DNA, 335 bp, Triticum aestivum
  Clone ID: PAT_TA_63171
agatgttcgtgttcgagaacctgctggagctcgaggatcgcgcgatccatatggtgctgaaggaagtcgaatcggaaacgctcatcatcgcgctgaagggcgcaccgcccgcgctgcgccagaagttcctcgcgaacatgtcgcagcgtgcggccgaactgctcgccgaggatctcgacgcgcgcggcccggtgcgcgtatccgaagtcgagacgcagcagcgccgcatcctgcagatcgtgcgcaacctcgccgagagcggccagatcgtgatcggcggcaaggcggaagacgcgtatgtctgattcggcgagcgatcgcgcgggcaccctcac

SEQ ID NO: 63172 - DNA, 486 bp, Triticum aestivum
  Clone ID: PAT_TA_63172
cgactctcttcccgcacctagcaaatggtaagccaagaaagccaactgacggtattgcacatgagctgacaattaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaatg

SEQ ID NO: 63173 - DNA, 351 bp, Triticum aestivum
  Clone ID: PAT_TA_63173
tgttctccgacctcttcccgcacctagcgcatggtcagccaagaaagccaactgacggcattgcatctatgagcagacaaagaaatgctgctgctgctattcaacgagatcgattctaacctcaaggcgcccagatcccaatgacgagctcgtcgacgatgtccaccacgttgcagccgcgccatgggccccgaatgcgaaccccgtccacatggcctggtccgctgtgccgccactgcgatccggtgacttgacccattcgaccatgcagttctcgccctcctcgccggcgcttaacagcttctccgtgaccctgcaacaggtgggcccttcgaagctgcccagccacag

SEQ ID NO: 63174 - DNA, 481 bp, Triticum aestivum
  Clone ID: PAT_TA_63174
tcttcccgcacctagcaaatggtaagccaagaaagccaactgacggcattgcacatgagctgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaatgc

SEQ ID NO: 63175 - DNA, 475 bp, Triticum aestivum
  Clone ID: PAT_TA_63175
gtgttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggacc

SEQ ID NO: 63176 - DNA, 476 bp, Triticum aestivum
  Clone ID: PAT_TA_63176
gtgttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggacca

SEQ ID NO: 63177 - DNA, 486 bp, Triticum aestivum
  Clone ID: PAT_TA_63177
ccgacctcttcccgcacctagcaaatggtaagccaagaaagccaactgacggcattgcacatgagcttacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctcccctttcgctagacacggtgttcgtcaacctggagagcgaattgacaaaacggctggagagcggcgagggcaccttttacaaggaccatccgacaagccccaatg

SEQ ID NO: 63178 - DNA, 388 bp, Triticum aestivum
  Clone ID: PAT_TA_63178
agaaagccaactgacggcattgcttattttcagacaaagaaatgctgctgctgctattgaacgagatcgattctaacctcaaagcgcccagatcccaatgacgagctcgtcgacgatgttcaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagctttgccgtgaccctgcaacaggtggccccttcgaagctgtccagccacagccgcagcggcattgagatcctcgtcctcgacgttgctccccttccgctagacacggtgttcgtcaacctggagagcgaat

SEQ ID NO: 63179 - DNA, 474 bp, Triticum aestivum
  Clone ID: PAT_TA_63179
gttctccgacctcttcccgcacctagcaaatggtaagccaagaaagccaactgacggcattgcacatgagctgacaaagaaatgctgctgctgctattcaacgagatcgattctaacctcaaggcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggacca

SEQ ID NO: 63180 - DNA, 472 bp, Triticum aestivum
  Clone ID: PAT_TA_63180
gttctccgacctcttcccgcacctagcaaatggtaagccaagaaagccaactgacggcattgcacatgagttgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggac

SEQ ID NO: 63181 - DNA, 471 bp, Triticum aestivum
  Clone ID: PAT_TA_63181
gttctccgacctcttcccgcacctagcaaatggtaagccaagaaagccaactgacggcattgcacatgagctgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctaacacggtgttcgtcaacctggagagcgaattgacaaaacggctggagagcggcgagggcaccttttacaaggac

SEQ ID NO: 63182 - DNA, 472 bp, Triticum aestivum
  Clone ID: PAT_TA_63182
gttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggac

SEQ ID NO: 63183 - DNA, 346 bp, Triticum aestivum
  Clone ID: PAT_TA_63183
cagtgccccagcttttgccgccaccgccgccgtccctgcccctctccgcctgctgccaccgtcacagacaccgccgtctacttcagctgctgccgaccccgagacggagaggctcaaggaggcagccgctcgacgcaaggcggagggcgcgacggcgtcggcggtgtacgcccgccagcgcgacgagtactggaccccgcagcggaaccttccgtacacggccatctttccgtagccggaggcccagagcgccgcgccgccgcggagacgggtgcgaagagcgtacggtggcgagaggccgaccgagaggagggcgaggatcgacctgacggtgccgatgctgatg

SEQ ID NO: 63184 - DNA, 254 bp, Triticum aestivum
  Clone ID: PAT_TA_63184
aaccttaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtaggcgcttcagagcttcgccgtgaccctgcaacaggtggcccctaagaagctgttcagccacagccgtagcggcattgagatcc

SEQ ID NO: 63185 - DNA, 333 bp, Triticum aestivum
  Clone ID: PAT_TA_63185
tttttgtacgagtcgtgggctgaaggagcacaggacccccgcgtcgctcccaccgggcgactcgggggagaccaagctcgcaggcgccggtccccctccgtcggcgccctcctctccgccgctgccgccggctcggccgcggtggcggcggcccccgtctccaaaggcagcatggggagatccgcggtggacgctttgggcgctcgctgggcgtgggcgcgagatgcgccgttcgtggccgcgatgctggagcttggacgctggtgcgtgcgggctgcactcacctacctcgtgcgggagcggtggaagtgccagcagagctggatgcgtggc

SEQ ID NO: 63186 - DNA, 377 bp, Triticum aestivum
  Clone ID: PAT_TA_63186
tcttgattgtcggcaatcaagtagaggcgtgaatggggatatggagttttggaatgtcatatagaaggccaatgtcttttagaagatcagaattttgtttggcatgcgacatctaataacctggcgatccaggtgaatagagttatgcaccatctggctgctccgggtatgtactctatatttgtggggtggaagatgaaagcatgtcccatgctctgatggcttgccccgaggagagctctacgcatggagttgaaggaagtttggaatattctggggagtgaaatcttcaacttcttaaggctcgattggatgcttctcttgttggatcagttaacctcaacataccttattcatattctagggagcttggcact

SEQ ID NO: 63187 - DNA, 272 bp, Triticum aestivum
  Clone ID: PAT_TA_63187
gctcaaaaaagccagcagaccatggactgctgatcttccttactgcaggtgatgaatgctcgtacaagagagtggcgcctctacttgatggcatgggcaaggtgaacatctgtaatcacaaagaggcactagaataagaaaaatagtcgcgtgctgataagagaatgggcttacattttacctactctgaaagcaggcaagattttatctgggggatgtcgggaatggcacaacaatgaagctcgggggtaatatggcgacggggagcatga

SEQ ID NO: 63188 - DNA, 205 bp, Triticum aestivum
  Clone ID: PAT_TA_63188
cttgttgccacctttaatttgcttacagctgcggagagcgccaattccgggggcggggggggtcaccatgctgggggtgaggaagggcgcggcgactgtggagctcgggtcgctgacgatgaggaggaagggcgccccgcctccggctcccccggtggtgccggtggaggaggggaagaaggcgccggcggtgggggcggggaag

SEQ ID NO: 63189 - DNA, 427 bp, Triticum aestivum
  Clone ID: PAT_TA_63189
gttgttacgcgtgcggttttatccctttaccggaaggggctcgcaagaagtcgatccacaagaaggtgaccctcaagtacatggccaatgactccagccggcgcagtaggtttaggaagcgtctcggggggctgatgaagaaggcggcccagctggccaccctgtgcgacgtcaagacctgcgtggtggtgtacggcgagcgcgaggcggagcctaaggtattcccttgccacgccgaggcggtggatatcctcaacgaatttaaaagcatgccacagctagggcattgcaagaagacgatggaccaggaggccttcctcacccagcgcatcgccaagctccgggaccaggtcgacaaggctcgccgcgagtgccaagacagcgagattaggtacctgctttacaacatcatgcacggtaaccaccc

SEQ ID NO: 63190 - DNA, 381 bp, Triticum aestivum
  Clone ID: PAT_TA_63190
ctcatacattccacaacttgggggtgagaatttcgagtttggagaatgcacatttgctccagttccatccccagcttctgctaggccattcattggtaacaagatgggagaagaatcattagtaaattacgctatgaaccagagcctgtaccctctggtattgggctcgacatggaagaatctcgaaatggctcaaaagtgccagaaagtgttgttgggattgctccgctacctgagctgaataaatccaaaaggggatcccaaacagaaagatatagtaaaccatcaaaaccagcaggtttacttgaacgaatgctcatgttctccagtggggttggcattggtattttatcttcctctctatcaagcaaaaaagatctt

SEQ ID NO: 63191 - DNA, 380 bp, Triticum aestivum
  Clone ID: PAT_TA_63191
tcggtcccctcgcgcgttccgcctcccagttgcggctccggtcgttcccctcctcctcggttgctgagatggccggtcgtgggaaggcaatcggcgccggcgcggccaagaaggcgacgtcaaggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacacgtatcgtgccccgccacatccagctcgccgtgcgcaatgacgaggagctgaccaagttgctcggcggcgccaccatc

SEQ ID NO: 63192 - DNA, 399 bp, Triticum aestivum
  Clone ID: PAT_TA_63192
gttctttggtttcaaattttcctggcgaggacccaaaaatgctctccaattttaaagaccttcttgaaaaaatatttgtcttagatccagataagaggataaccgtatcacaggcacttagccatccatttatcactggcaagtgaaaataagatgttgattcctcttgacattgtaaactacaatttgggttcctcttgtctaatcatcggcatttctatcttgtgtctgggagctatgagatctgagtgcgtgcccaaatggacgaagcatggggttgctgaagagatgctgtcttacggaccttgctgcatgcacttaccatttggatagttctgctgcttggattctgccagggcctctgctgcatgcacttatatttcctaaaggaccaacaaa

SEQ ID NO: 63193 - DNA, 241 bp, Triticum aestivum
  Clone ID: PAT_TA_63193
ttggtttggagggaaattggggcacgtacgttataccgccgatgcgtctgaaggtttgagaagatggacctgactgtctatcagtttggaattactgtccgatggtctaacaaaaaagtggttatgggacagttaaagttttattttgcatgtctttgaatcacgtagctggatcatcgttttctagcatgtgtggtacatccaaatatgcaagtaagacgaattgcaagttttattttgc

SEQ ID NO: 63194 - DNA, 421 bp, Triticum aestivum
  Clone ID: PAT_TA_63194
agctgattttcttcggcggcatcgcgaacacgttcatgctcgcggccggcctgtcgatcggcaagtcgctcgcggaagccgatctcgtcaacgaggcaaaggcgatcatcgacgaagcgcgcgagcgcggcgcgtcggtgccgatcccgaccgacgtcgtgacggccaaggaattctcgccgacggccgcggccacggtgaagcaggtcgccgacatcgaagcggacgacatgatcctcgacatcggccccgatacggccaaggcgctcgcgagccagctcgagaaggccggcacgatcgtgtggaacggcccggtcggcgtgttcgagttcgaccagttcggcaacggcaccaagacgctcgctgaagcaatcgccaaatcgtccgcgttctcgatcgcgggcggcggcgacacgctcgc

SEQ ID NO: 63195 - DNA, 255 bp, Triticum aestivum
  Clone ID: PAT_TA_63195
cccagatccatcctctcctttcctgcaaccgccgccgccgatctccactcccccaaaccgccccgccccgccggcgacctccgccttcctctcccctagccacctcgcctaccctcgccgcctcgccacccctctccgcgctggcgccctcctggagcacggaggtggtgctggcctcctacctccgtcccgaccgacgctcacgtccctggcgcacaccctgcgcctcgaagacgccccgctgcgctggatcgt

SEQ ID NO: 63196 - DNA, 238 bp, Triticum aestivum
  Clone ID: PAT_TA_63196
ttttcgttgagaagaaaaaggaaaaaaaaaaaaaaaggcgaggcgaaccgcgcgcgctcacgggatccgcggcagccagcaccgtcgcctcttcccgccgatccgccccgtcccgcccgatcggcatggcggacggggactcggcggcggcctacgcgccgccgcggtcgccgctcccgcccgagacgccgtccacgcagaagcggaggcagcgcggcctcgtctcgcgggtctggaa

SEQ ID NO: 63197 - DNA, 402 bp, Triticum aestivum
  unsure (1)..(402): unsure at all n locations
  Clone ID: PAT_TA_63197
tantaacaagatatgaagaattaacctgttaatttctttgcaaaggaattggccagttagtattttactaaataactatggactagctactatttttacaatgggttacttattagactagggacgtgtgatatctttctcccgttgcaaagctaaaccacgtcgtgtcatctttgtagtttacatattttttagatgtgttggcacacattttgaggcatcattttctttcaagtcgttcatcatcattggtcccattctgcacaagactatcgatgataccactctgcattggacctacacaatcatcaattttaccaatgtcacaaatggtctgtcttgtaatgtgacattatggctaactgtttggtttaaattatggctggtagatgtccttggatg

SEQ ID NO: 63198 - DNA, 379 bp, Triticum aestivum
  Clone ID: PAT_TA_63198
tcttccacgcgtccggcgctgtttctcttgtgccagggtatctaacgaagttctataataaactgctgatctgctttaaggagtttgataatgaattgagagtcaatagaagatattcaattgatcacatcaagaagaagttccaactgctatctagttgtcaactccaagaggctgaatggttgcacaaaaatcacaagcccaggtttgaagataaattgcatttgggtgccatgtccgtaggcgcggtagggctatgcgtgtatatgatggcttgcatgggtgataaaatgcccaagggagcactggagtgggcacttgcataccccgatgtcatcatggcatgtgccaagattgggcgcctaatgaatgaccttgc

SEQ ID NO: 63199 - DNA, 310 bp, Triticum aestivum
  Clone ID: PAT_TA_63199
ttttattttggatgtttatcaacaataaaatatgggttagggcagaacagtaccaaactcgaaaaatgcatatgaggattttccggaattgttgcttgtttttttcggtctaaattaaacttgcctaaacaggtagtttactcatgcttcacctcttgccatgttaaccaacatttaatattgatgagtagctaaacgagaatgaactaaataattgttgtgcatattgagctgcacttaatctgttttattgtttgttgcaccttgccatgccatgaatcattaaaccggacattgcatcacactcgat

SEQ ID NO: 63200 - DNA, 348 bp, Triticum aestivum
  Clone ID: PAT_TA_63200
tctttgacttccagagttccggactgatgcatatggtagccaccgaccagagcaagacggcgaccaagaggttcggatggctgtacgtggcgcggtgggcggcggcgtccgtggtgacagtgctggccgtggcagtgatcattcgggccgcggtgctgatgctccgcccccagaagctccagttcaggctctccgggggccatgtggcagtcgactcgatcccgtcgatgccgccgcctgacaacgtcgtgacgctcaccttcgccttcgtggcctacaaccccagcgggcgcgcctccggcgagtacaacaacgtcaccgtccggctcacggacatcacgagcgcgt

SEQ ID NO: 63201 - DNA, 385 bp, Triticum aestivum
  Clone ID: PAT_TA_63201
tctgaaagcaagcggcattcaaggagatccagggaaaagagacatcacaaaatgcaagattttcccgtgagcaataggtctgcacggaaatcggatgagaagtggcactatactgattcaagcgcacgtgaaagcgatagacattcaaggaaaccaagagaaaaatcacgctactctgatccaagtgcttctgagtattccgattccgatcggccttcacggagatcgaatgagaagcgacactatactgacttgagtacacgtgaaagtgatagacattcaaggaaaccgaagggaaaatcgcgctgctctgatcaaagtgcttctgagtattcagattctgattggcgtaatagtcatcgccgtcgtcgaagaaagtgagtag

SEQ ID NO: 63202 - DNA, 407 bp, Triticum aestivum
  Clone ID: PAT_TA_63202
cctccaccatgctcctgcttgtcgactgcatcgccacacgaagttcacaggccatagctacggacggacgaaattccaactgtactgcaacccctcaggatccacagtggccaaagatggcgatccacagttgttcggtgtaatgcctaaggagaaaacaatgtctctctcacttttgtttttcgaaagacctacctatcatcttgccgctgctgcgttagagtggctccatctgcagatgggggaggtctcgaccagcagctgggagaagtctcgacctgcacctggtcacgcgtgccactgccacttaggtccaccacctacagctggcgccgcagtgcctcaaccattcaactatgccacctcagcagttcaatatatattggagaagaagaaaaaacaacagt

SEQ ID NO: 63203 - DNA, 179 bp, Triticum aestivum
  Clone ID: PAT_TA_63203
tcggtcgaattcacccgtctgcaccgctcagtcccccggaccggaccgccggacctgttcttgccttgccatggcagcagcagcactgagggcgcacctgaacgatcatatcgccagcatgtacaccgatggtgtgggcgacgaggacacgttcgaggagctgcgggacgagggcaccg

SEQ ID NO: 63204 - DNA, 312 bp, Triticum aestivum
  Clone ID: PAT_TA_63204
ttgaataggaatagaggtcgtgattggtgtaacgggctacaacgaagacctgagacctgagaagaagtttgcaaagaaggcaaggagcgcaggacctgagacctgagaagtttgcaaagaaggcaaggagcgcaggaggctagatatctgtggagctgaatgttggaacaacgaagtaaccaacgagtggcttcataactcatttcaattgcagtatgcgtgcttctcttccatcatcttttaagcatggactaaccgtggtttgtagcacattgagtttttgcaacaccgatagacatgaaccactccctc

SEQ ID NO: 63205 - DNA, 169 bp, Triticum aestivum
  Clone ID: PAT_TA_63205
ttaccggaatccgtttgttattgcggtatagtgagcgacagtgcgcctgagggcagatcttcccttgtttgtacattcatttacactctacaacaggatgtcccaaagaataatggtatctacacctagcaaaccagataacgttattgatgcggtgattctatagctc

SEQ ID NO: 63206 - DNA, 325 bp, Triticum aestivum
  Clone ID: PAT_TA_63206
aatttcactgcatgggttggtctccgctggattgtgaccaactctttgtgtgtggcctgtcccggttctttgtggttctttgcgcctgctcggtcctcccaagacatcagataaattcttgtgaatctgatcagcatcatcttatcgctgatgtagcatctgtagtctagatatttgaaagagtatgtgatcgaaggcattacctcatcaccccatagcccctctgtatagtgtcttgttagaggaatatgtggaatcgtgttcgttggttgatcaagcacagctgcaggtcaaataaatcttaagctgccaattcttattttcc

SEQ ID NO: 63207 - DNA, 375 bp, Triticum aestivum
  unsure (1)..(375): unsure at all n locations
  Clone ID: PAT_TA_63207
gcgttatcaaccacttcaactaccaaggctgccgcgggtacgtgtcggacgcgaggggcgcccggtgcccgtcctgcgggaacgagatggcgaccgagacccagtacgtgccgccgccggcgccggccctgccggagcagagcgccgccacggcgaagacggggtacgtgcagggctccgtgacgtacacggtgacggacgacctggccgtgacgcccatgtcggcatctcagcatcncgcggctcggcgccctcgccgccgtcgggggcctcgccgcgctccaggagaagaccgtggagctcgggtacagggagggcctggagatcctcaaggcctcgctgcggtccaagactgtcctcacggacgtcttcctc

SEQ ID NO: 63208 - DNA, 393 bp, Triticum aestivum
  Clone ID: PAT_TA_63208
gaaggggttgccggatcttggcctggagctgtgggattatctgatcgggaaaggatgtgtacctcataggcatgcattggatgttctggttaccggtttatgctgcagagatgtggttggtgaagcatataggtgcttccgggagctggttgagatgggaatggcacctacagagcgtgcattcagggttttggaagggttcttgaagaagaagcgggagtttgggaagattgacgagattaggcaaatgatgaaggctatccaattggaggagcatcaagctgaagaagaagctgcgtgaagctatcaaccctcctgtgggcccttttgaaaagaaacatatttatttcttggaccatgtaaaatttccaagcctgcgtggtttaagcaaag

SEQ ID NO: 63209 - DNA, 365 bp, Triticum aestivum
  Clone ID: PAT_TA_63209
gtagtccatgactcttctgcgcaccgcgggcgcgaggccgccgcgggccggtggcgcggccttgcgcgccacgccctgcagcagcaggtgatgcagcaccgtctcggccgcgctgctggcggccaggcggtcggcgggcgcattccagtcggtgtcgagcagggcccggcagacgtcggtcagcgagtcgtcgtggatgtaggtgcggtcgcgcagttcgagcgagcgcggttcgcagtcgagccgcatcacggcctcgcgcgccagccgctccggcgcgatgtagagatgcaggaagtgcaccgtgtcgttcatgcaccagcgcgaatagtgctcggccggcagcacgcagaatttgccggcgc

SEQ ID NO: 63210 - DNA, 308 bp, Triticum aestivum
  Clone ID: PAT_TA_63210
tacgataattcctcaaagaagatatccatggaccaccgatggaggttgcagttgccgaattaccagtgctgccacaagatgtcctgatgtctatatttgcacacctggagatccctgacctgatgcgtgccagcttcgtctgctcctcgtggcgctccgcgtattccagcctgcgcaaccttgagcagtaccagcaacgccagacgccgtgcctcttatacacatctgaatctgctggtgaaagcgttgcgtgcctctacagcctcttggagaagagggtcatacaagttgactctcccggagccacc

SEQ ID NO: 63211 - DNA, 304 bp, Triticum aestivum
  Clone ID: PAT_TA_63211
ttcttctatcctgttcgacggctggcgcacgtccgggtggacgggctacctcctctgcctcctggcgctcttgctcggcgccggcttgtaccagtacctggaggccttccggatccgggtcaagctcctcgccggcgccaaggcgtaccccctgcccccggccggcggctcctacgcgcgggccccgatgatcgcgccgggctccgccgccttcttgggcgggcgctggccggcgcgggtggccacggcggcgctcttcagggtcaacgcgggcatagggctcctcctgatgctcgccgtcatg

SEQ ID NO: 63212 - DNA, 287 bp, Triticum aestivum
  Clone ID: PAT_TA_63212
ttcacgcgcaatcgttcgccggacttcggcgcgctcgacccgaacttcttcttcgtccagggcttcagcgggctcggcgtcgcgctcaccggcatcgccggacgcgcgattgccggcgcgatcgcgggcgatacgcgcgcgttcgacctgttcgcgcgcctgcgtcaccggcgcttccccggcggcgacgcatggcggcaacccgcgctcgaactcgggatgctgtaccaccgtgtacgcgagctgttctgagccccctctctccgttctccagaccatgcagacat

SEQ ID NO: 63213 - DNA, 442 bp, Triticum aestivum
  Clone ID: PAT_TA_63213
tcttccacgcgtccgcccacgcgtccgcggacgcgtggggccgacgagaggttcgaggtggtcgtaccgaggaactttgctcttgtgtgctttagaatcaaggcaagtggagccatgacggaggaggatgccgatgaggccaaccgtgtgctaatggataatctgaacaagactgggaaggcttatcttgcacacacggtggttggtgacaagttcgttcttcggtttgccgttgggtcgtcactgcaggaggagagacatataagaagtgcctgggacctcatcaaaaagactacgagcagtatcatggattaagtggatggacctattgacacataaagttccaggagctacacaaatccctatatttagggtatgattattcttttaaaattataatttgtttttcttttgctttgattctgattattacttatttgga

SEQ ID NO: 63214 - DNA, 399 bp, Triticum aestivum
  Clone ID: PAT_TA_63214
tctttcgatcgcctcatggccgtccacatctccggcgagctcgtgcccatcctcaagaaggccggcgccctctggctctgatcggacccttccttcctttccttagtttcctttcatcagaagacggtgccgcggtttaatcctggccgttggatcgaattttacaccgcggccgatttactctaggattttgggtttctttaatggtgtgctaaattttttctcaacaaatatattcatgagaaaaaagaaacagacaggtagcattactgtttttcgtaatttatttcgtctggtcatgagcatgtgaatacggaagaagagcgtgcgcggcattgcagcgtctgtacagtttgtcgtttctatttccgagttaatgagaatcagatgcttcttacg

SEQ ID NO: 63215 - DNA, 226 bp, Triticum aestivum
  Clone ID: PAT_TA_63215
tctgccattcttgaatgaaatgcctagagacggtaacttaacaccatatatatttcatctctgctcgacagtacgtttggttacagcggggggcccttccatacatccatgtaagctgtaacgggtatgcaggaagtcaagagctgggatgcttgctgttgttttaagatgtagacattgtgtagtgacgtcggaaatgaggttccacttcttattttttgcttct

SEQ ID NO: 63216 - DNA, 151 bp, Triticum aestivum
  Clone ID: PAT_TA_63216
tatcggtgcaatgaaaacattgacggggtgcgttgctaatggagctcctgtttgccgccactaagttgatcaatatggtaactttgttgaaccttgtatttctaatgttaacatgttgaagcactctgtaaataacatgttattgttcgat

SEQ ID NO: 63217 - DNA, 155 bp, Triticum aestivum
  Clone ID: PAT_TA_63217
tctcacgcgtccgcccacgcgtccggtttgcattggcttgaattggttgctttggaggcttaggttagctgcagactgtacataaggaaattgtttatgttggttcttttctccagttctttacatgagatccatgtcggcaacagtggatacag

SEQ ID NO: 63218 - DNA, 185 bp, Triticum aestivum
  Clone ID: PAT_TA_63218
tcggtcaatggaagctcctgattgcactgtgtcttatacttgttcagccctaatgatgctctggaccgaggggctcttcctcagtagcaatgtacccggccctgtattcttatcttctgttgcagtttgtttctctttcttgagagctgttacttggccaaaaaaaaaaaaaaaatacaatagat

SEQ ID NO: 63219 - DNA, 100 bp, Triticum aestivum
  Clone ID: PAT_TA_63219
tcgtctgcaagttgtccttcaccatggtttgtatgtgccaccagtatggcagtatggtttatccaggttattgtgcactaaataaatgtactttaagctt

SEQ ID NO: 63220 - DNA, 251 bp, Triticum aestivum
  Clone ID: PAT_TA_63220
aatgtctacaaggagacgcaccactggtcgagactcgtgaccaccgcgtcgctgctacccatggaggacctcctcgctgggagcggcgcgacctgatacacgcggtcgagcgacagccgcgccatgctgctgtcgcgcacgcggcctacttccgaccggatctcgagccctccggtgagaatagacttgacggcgtcggagatggaagcggcgccactcgatgcgcgcggagggcgaccgccgccgtgctt

SEQ ID NO: 63221 - DNA, 393 bp, Triticum aestivum
  Clone ID: PAT_TA_63221
ttctggatgggaaaatgaaagccattgttgaggggcggttacaacaggcttcgtgaatttttctcttccaaaaatcttgacgttgagttgaccggcgatgctgagaaccctatgatcgtcatcggtcaggctatcagtgttgcggcatacgtcaagaactttgacctcatcttccttgataagtcacatcaggggactccaaaaaaaatcttcaagctcacgcatgaagtatctggcactagagaagaagtgctgggtgtgatgcacgagtcggttcacgtaggccttttccggatccaggaaaaaaagtcaaaactctttcttgcaggctacaatttcaaagaccctgaaaacaggaaaggacgttttccggtcttcgcgcgggagatgagc

SEQ ID NO: 63222 - DNA, 196 bp, Triticum aestivum
  Clone ID: PAT_TA_63222
ttttggacgcgtgggaaaatgttgatttctttgattcgatctatgtatgcttccctagaccagttggggacacaaaccttgttcttctttccctatgttccctacgagttctttgtcgaactcataggcaaaggcatcgatcgatggattagttagcttaaaaaaaaagaacaaatacaatagatagaagaacaag

SEQ ID NO: 63223 - DNA, 122 bp, Triticum aestivum
  Clone ID: PAT_TA_63223
tctgctccgacccgcggtccacttgcctgggcccctccacggtcgctctggcaggcctcggcccaggcggtgccctcgtcgacatgaccacctccgaccccacactcgccggcgagatagcc

SEQ ID NO: 63224 - DNA, 189 bp, Triticum aestivum
  Clone ID: PAT_TA_63224
tttgttgctgcggtggtaagcaactatatgtggaaacataccatgtcttgctcatccagaaggttttctgccttaaacctgttcgtcaactcagccccgctcaaatcagcattttgaagcgcaatctgggtagaacaaggagcaataaaatatcagtgccaaaataaaaaatcaaagaaaaacaatttg

SEQ ID NO: 63225 - DNA, 290 bp, Triticum aestivum
  Clone ID: PAT_TA_63225
tctgcactcgctatgaacaaacaggagatgactagtttccgaggcgacagttttgcagcgctggaaaccgtagctagggtcgaatgatgttgccgtcccctgttaattcgtttaggttgattgatattcttgtactgctagtcatgttctttgccaccgagaaatttgatcggtggctgtgttggtctcttgacattgtatttcgcaagcaagataggccttttccctcgccttcaatgctgataaataaactggagccccacctttccaaataaaaaaaaaaataatgt

SEQ ID NO: 63226 - DNA, 107 bp, Triticum aestivum
  Clone ID: PAT_TA_63226
tcacgcgtccgttttattaatggcgcatcactggtgcgccattagtataggccacggtgcaccattagtataggccactggtgcgccattagtataggccacggtgc

SEQ ID NO: 63227 - DNA, 364 bp, Triticum aestivum
  Clone ID: PAT_TA_63227
tggacaaaatcaaatggcagacaaggacgaagacttgtccaacatagctgaagaaattcgactcctaggccttcaatgggagaacatccgtcaaactatccctatcaacaatccttcacttgacagatccaataccatcaattcacaacctcctgtattctctttaccaccattctcccaacaacttacccatgacctgtctactgaaaccagcgaccaagaagactccttggccaggaaatccatgaattctgttgcttcctcgagcgcttcgtccacagatgagaaaaattaaacagagtatttttagagggtagcgagagcaaaaagaaataatgttattgaaaaagaaatttaatattac

SEQ ID NO: 63228 - DNA, 304 bp, Triticum aestivum
  Clone ID: PAT_TA_63228
attggggtgacgaaacgcgtggataaagaaggtgcgatttgtaagctcttgccagttgcaacccaaaagggtatgaacaattacaaaatgcgggaacggaagggacgacggagcagaagcgcgggatacgagaaggaacgaattggcagcccggactgattgttggagtaaacgtacctattgcaagtctgacgcggtggacggcgagccgtccgggagcctggttagacgacgcggttgcgctgtattgtcgatgcgatattgcaacttgtattgtgttgttgtggtgttttgcagagcgctg

SEQ ID NO: 63229 - DNA, 107 bp, Triticum aestivum
  Clone ID: PAT_TA_63229
ttctagctctctcctagcaccagagtcatctttgctagttcattgctgcagcatccgtcgaggaagcaaatggcggttactctgaagctcaggatcctcgccgtggc

SEQ ID NO: 63230 - DNA, 219 bp, Triticum aestivum
  Clone ID: PAT_TA_63230
ttatgaggaagaggaggtcctgaacatttctcccgcacattgtagataccaccaccgccgccttgtaggaattaagctggcaccgttccacccttgtgtatttgtttttgattgtatgtgcacttgttggatgtgcagacgtgtatttgctcttgtgagtatgtgactggatgatttctggatttaatcagttaattgagagatttattgatttttttc

SEQ ID NO: 63231 - DNA, 453 bp, Triticum aestivum
  Clone ID: PAT_TA_63231
tttttcagtcaatgaaccttctcttgataattgctttgtctcatcgagttatgatgccactactcactttgagacgactgtgacagatgttcttaatatgtacacactgattactggaaagactgttgatcttagcgttgatctcagtgctgccagcgctgcagaagagtactagatctcaaacccagaattttcttcaagacatacttcctggaggacgaggaacaccaccggaatcctactgtgtgatggtcacgtgtgacatcagctgcgtactgcgtagggttccaggtccacgcctgctaccagcactatgcgaaattattatctttggaatggtgctgggttccttcgttaacttccatattgatccactgggttgtaaacgttattctatcataacgatggctttgacatgttaatgttccgcttgtcgatgtattctacagttat

SEQ ID NO: 63232 - DNA, 245 bp, Triticum aestivum
  Clone ID: PAT_TA_63232
tctgtttataggccaacttagcacaaggcctatttaccactgagtgttttctcagttgcctgcagcagtcgacttgtcaggtgttcaagtggtgccagagaggattcttgaacgcaagatggtgaaacgccacaacaaggtgcaggtccaagtgttgattcagtggtctggtttagcagctgaagcagccacctgggaagactatgatgtcttgaagaacaggtttccggacgcaccagcatggg

SEQ ID NO: 63233 - DNA, 346 bp, Triticum aestivum
  Clone ID: PAT_TA_63233
ttgttctgaaattcaaacagccaaaaaatccaaaatgtgtcccatttgtaccaacaaacggggaaccgccaaaccaaccacggaaaccggaaaactctcgacccccgttccctccgatctgccaaaacccattgttccgagtgaaccggaaaaaaattctcgcggggttcgcgatcccaaggaccaatcgatgagcgtatccggcgagttacgggctcgtggtgcagggagatcctcttaacgatatatttttttttgcgttttcaaggagttcgataaggaactcggttacttcacgtttcaaaacccactatgtatgacacgcaccgtattaaataacacgtcg

SEQ ID NO: 63234 - DNA, 336 bp, Triticum aestivum
  Clone ID: PAT_TA_63234
tttcttacgcgtccggagaaaatatcaccaactttgaggaaaatgatttccagatcctacgtgtccttatgacagtcattgacacatcaaccgacaccactgctcttgcggttgcctgctatgacctctcacagttccttcagtaccacccttctggccgcttagtggtggcagacctcaaggcgaaggaccgagtcatgaaactcatgaaccacgacaatgccgaagttaggaagaactccctgctctgtgtgcagaggctcttcctcggcgccaagtatgctagcttcctgcctgatgtgtaaaaaaaaaaaattatacataaaaaataattat

SEQ ID NO: 63235 - DNA, 139 bp, Triticum aestivum
  Clone ID: PAT_TA_63235
tgttttgtatacatatgcttatatgtagcacaagttgagttttttttactagcaaggcgagataaacttcttatcgttcgagttgacgcccacctgtatatacaacccttgattcaattgcatttattgcttagatggg

SEQ ID NO: 63236 - DNA, 266 bp, Triticum aestivum
  Clone ID: PAT_TA_63236
tttcgctgacctggctagtaggttcggcgtctctatcggcatggaaaagcctccgacgctgtttaggaaaaccgccttcaagatggggttaaagggtgtaccaggaattcggataagaaaatgaataaccaagctacattttatctcccattctgtaattcgtcttatttctaattttcactacatcaagtctgaaactgatcgatgacttgttgactggctcaaacgaagaacgactctcacatttttcttacggccttacactc

SEQ ID NO: 63237 - DNA, 344 bp, Triticum aestivum
  Clone ID: PAT_TA_63237
tgtcgttcgcccacgcgtccggtgcaacagcgcggtgtggcgcgcgctccgcgacgtgccggccgtgtcgcccccggggccggaggagaaggcctgcaacccgtgggcggactgcgtcgccaagtacccgcccaaggcctacgtctgacgatacattactacgccgccgccgcatgactccacacgaagattacatgattcttttctcctatactttttctgcatttcgtttcccgtaggtggctgtaccttaggttccatgggcgagcagtgccgttgttttcagcttttgtactttaagtgtgaattataaacgacaaatatatacgacgaggtttcattcc

SEQ ID NO: 63238 - DNA, 325 bp, Triticum aestivum
  Clone ID: PAT_TA_63238
cttcaggcatcagtatcttgtgttctcgtatgctgccaggcgcaggcaaatgctgtcatccttcgctgcaacggtctgatgtttgtgatgaatatctgaattggcagcatgccgtggtcatattagcacaagcttgaaaccctggtctagcgcactgattgtacggccacagaatatgctgtgacaaatgagtaccatgtaaacttaaatcagtatactgtaatatattatttgctttttggggggttggctgccctgcctaatgatggcgatgacactgcgcttgcagaactctcttctatacataatacactagctttactgt

SEQ ID NO: 63239 - DNA, 202 bp, Triticum aestivum
  Clone ID: PAT_TA_63239
actccacccagcaataaggatttctagtggtcacgtacgtacgtcttttggtctgtagctagcattatactgtattagcgagctgcttggttggggttgcattggtattaagtagagtcagtcgagctaggtttgcttaatttagttggggtattgtatttgatctgattgatgagattactaagtcttccgttgatcctct

SEQ ID NO: 63240 - DNA, 231 bp, Triticum aestivum
  Clone ID: PAT_TA_63240
ttacgttcgctccgattcgtctgcccaccagtcagcagctggaacctacttgcgttcgccgtcgtcgatggcagggtttggcagtctggctcccacgacgactaacgtggaggaggcaggcgggctgactgggatcgcctttggggggtactactacaccatgtgggcagtgggcagtaccgaccagctgcaggtcaccatgaacaagtttgaggacctgatgaagaagga

SEQ ID NO: 63241 - DNA, 213 bp, Triticum aestivum
  Clone ID: PAT_TA_63241
tcgccctcgcgtccgcccacgcgtgcgcgcgcgacgggggctgccttcacaccccttgatttctcaggcgggtggtgggattatgcgccacctgctcctgccccggcgccttctcggcatgggtcccctctccgcttacgccgcgaccaaagccctactgctaaaccccgtccgaggccggctcccctactcgctcgcgtgcctctccgcccc

SEQ ID NO: 63242 - DNA, 225 bp, Triticum aestivum
  Clone ID: PAT_TA_63242
tttttttttagtgctagcgaacatggtaattctggactgggtaaggtttgatatcgggggctgaccgcttgagattagagaatggtatttgttcaactctcatgtaaatgagattagctggggacttgtagatatggtcattgatctgaatcggggtgatgaattatttgattctttacagtttgggttatgaataaatcgtgaatgtggattggtcgggtattc

SEQ ID NO: 63243 - DNA, 275 bp, Triticum aestivum
  Clone ID: PAT_TA_63243
tgttatttctgaaagaaatctagagaattggtctgtagcgggtggacacttgcgaatggaaaacgggggaagggagatgagtttgcgtgtctttttttatatatagaaaaagagagtgtgtgttttatctgtaagtgaagtgtgtacttgaagtgctttttattggctaagcctaaataattaaaaaaataaaaagaatcttcccaaccaagcaacaaactctattgataaaaatccatggtccaagagaaaaaacttgaaagaggagcttgatg

SEQ ID NO: 63244 - DNA, 191 bp, Triticum aestivum
  Clone ID: PAT_TA_63244
tgttatttgaaattgactcaagaagtgaaggaactgaactgtatcctgatgtaaagtataccacagttagcgagtatttggatacactggtttagaatgttggtgatctgtatgttgctcataagtaccaaccttttgtttcaattgacattttgaatgacgatgagagtgatgaatgtgttccaagttct

SEQ ID NO: 63245 - DNA, 372 bp, Triticum aestivum
  Clone ID: PAT_TA_63245
caggttcgttacacggccatctctgagattgctcgaatgtgagcccacagacttgagcttgagcagcctatgaatgcgaaccaggaagagggcaaggtgagcatcatgaataatgatcatggcagagtgaagcagtagtttcaaaactgaagatctatcacagtcgcggacaacaaatatcagaagctgaactttgaagcttttatgtaaactgaaattttctgtatgggagggcaagcaatgcttgccatgatgaaagtttaacttccccgcagtagagcattgtattatgttcgagatcgataagaacgaacgatcgaaagagttgtaaagtgaatcaagtcgtctttattgatagtgatggatccttat

SEQ ID NO: 63246 - DNA, 229 bp, Triticum aestivum
  Clone ID: PAT_TA_63246
gccgtgttagcagtagtagtagcttgtggtactcgcccaagtgaaggaaaaggcaagaaaagggtccaataccgaacttggatcgttgtagctagtgctgtcggaaagcaaaagtgtagcggaaaaataatactcctaccactactgctccatgtacgtatgtatatcgtgttattcattgtacttgcttgcaaaggaggatcaatatatatatatatatattattact

SEQ ID NO: 63247 - DNA, 297 bp, Triticum aestivum
  Clone ID: PAT_TA_63247
gtgtggttcacccgggcgaggcggtgccgatcatgccgcccatgttctactgggggccatggagggtggtgaacggagaggttccccgcttcatccagacgcccgaggaagctaagccggcatagagctccttcgagttcgaaggggtcatgggagtagtttgctcttctcctttttcttgatcggaggcctctcataagtaactcactgtttgctgtgtagctatggcattgctgcatttcttgtaatttacattctggtgattgggcagtgccgtggaatcataatggtcttttt

SEQ ID NO: 63248 - DNA, 132 bp, Triticum aestivum
  Clone ID: PAT_TA_63248
tttcgaatgggaggagttaaattttgtttcttttatgtagattattacagtagtttacatcattttcctccctaattactggagtagttttggtgcaacgatgcgaatgcgatgctgtggccttgtcgaggt

SEQ ID NO: 63249 - DNA, 287 bp, Triticum aestivum
  Clone ID: PAT_TA_63249
aattcattctccttttgaggccacccgccgacgccggctgcttcacgtggacatcagtccatccacagcatgtgtacacttcgtgggtgtgactccgctgacctagtagccgggatagacgaagctatcaaggatggggttgatgtgctctcactctccctcgcccctgtctgttttttatgttaaattcagtcgagacatgtctgtaactagtagggtttccatgtctgtaaaataattcaagtttggacatgtagcatccattcctctataactctgttactttg

SEQ ID NO: 63250 - DNA, 245 bp, Triticum aestivum
  Clone ID: PAT_TA_63250
cggttcgcgtgggcgaacggcacgagaagtggatggccgagtttggatccgcttaaaccttggttcccattgaagattgctggatcttgtccactcttttttgtttgtttgtgttttattcctggcatttgccttatttccaccttcccgtatattgtttcaacggtggcagtatgtatgtatgttcaactatgtttcctgagccggtagtttatgacaagaggcagaccgtaaactcggaacct

SEQ ID NO: 63251 - DNA, 257 bp, Triticum aestivum
  Clone ID: PAT_TA_63251
cttggatgcgtccatggcggcgacaaggctcaggaggttgctgacggactcacttggtggccatggtgtctaagtaaactaattggtcaagtattaagctcggctggaagatctgcagaagaccaaggggatggctggctgcgtctttgttcttcttaacataaacttaaattgtcacccgcaaaaaaaaaacttaaattgtaccttggtacattgtaatatcatacagtatgcatgcataaacacttttaattttt

SEQ ID NO: 63252 - DNA, 262 bp, Triticum aestivum
  Clone ID: PAT_TA_63252
tgaaataccacaccttcatctcaaagctgaaagtggaaggctactcaacggaacgacttctgtcgcattcgattgtatggaaggctcattgggtttatggtcccttggatgagaagaccaagtaggaggaaagagctggagatggccatatccacttgactaagtagttggttatgctagtggtaaattttgtgagaaggtgcatgcgaactgctgtgtaaacggagatcaccaaatcatatcaaagttgaaacggacatac

SEQ ID NO: 63253 - DNA, 135 bp, Triticum aestivum
  Clone ID: PAT_TA_63253
cgtgacgcgtgggttcttgtccgagtgactacatcagactatcaaggattgttatttgttatgtaccaatgtggagtcacataggttatttgtgcctgtagagtaagaattatattaatgtgatggactcctgtc

SEQ ID NO: 63254 - DNA, 231 bp, Triticum aestivum
  Clone ID: PAT_TA_63254
tcgctcagattgggtttgagagtgtgtgttgtgcctgtccgtgcttggcttctgaattttcttctcagctgtaattctccctatgaatgttcttgattgggtttgacgggtttggccatacacctcatgtttggtctgttttttgggggctcgtctagtctctagggcatgtaaaatggttctattttaagaatgtcacgtaggataaatgatgagatgatctcttagcac

SEQ ID NO: 63255 - DNA, 317 bp, Triticum aestivum
  Clone ID: PAT_TA_63255
cttttatctaatattcttgttaatatgctagttaagattggatactgtgctacttggtgctgcccatcacggcatgatcgttgccatcaagaacatcgatggcaagagcttgaataacaacctcgatagtttatatgttctgttgatgtaaaatggattgtactggttcataactctgttgtgtgatatattttgtcaatctatgttgtatgtcatcactttgtagaggattttttaaactgctgtgttgtagatacatacagatggctgtgttaaactttgtaatgtttcacaccttgcaaatattttttgttggg

SEQ ID NO: 63256 - DNA, 119 bp, Triticum aestivum
  Clone ID: PAT_TA_63256
atctctgcacactttcatgaatttgatgcaatcgaagtgacttgtgttgatgctaatttgagctttgcgtttggtcttaccatattggttggtttctttaccatccttcgacttactgt

SEQ ID NO: 63257 - DNA, 146 bp, Triticum aestivum
  Clone ID: PAT_TA_63257
gcttaagaaatgagtccggctacccacagctggctagaaaagtcagcggccggctgtccaaaaaaaagagaagaggctgactgcctgctagctgactggtaaaaaagagagaagtcaagggctgtgtgcccagccagctggctaag

SEQ ID NO: 63258 - DNA, 252 bp, Triticum aestivum
  Clone ID: PAT_TA_63258
gatgtaaaccaacagaggtgtggtgcacctgcccggggaagctttggagctggtcgagagcgtcatgttatgctgtacttaggcttacctaatggcgtccctctttcagcgggatcctcaacgcgtaattccccatgttgacagtagctcgtactggtcctccatcacctgcaacgtcaaaataatcaacactgtaggtacttgggctttacctaatgacgtttcaatggcaatttcggcgctccgctgctg

SEQ ID NO: 63259 - DNA, 133 bp, Triticum aestivum
  Clone ID: PAT_TA_63259
ctgatcttttggtgtagccgtttagactccggaattcaacaaccctgtgccgcgggctgcgcttgtttcatgaacctatgcattgccgtgttctcccgtgttccaagcggggaggagacagatcattcgcctt

SEQ ID NO: 63260 - DNA, 248 bp, Triticum aestivum
  Clone ID: PAT_TA_63260
tcggtctgaacctcgacaatcgcgaggttctgaccgaggcatgtgcacgcgccgaggcctaacggcatgaacgccgcctgcgggttcttgcacgccgtcgacaccccgttcttgaaccggtccgggtcgaaccggtcaaccgtcgggccccaagaagcggcgtcgtggtgcatggaggataccggcacgaagaggtcggtgcccttgggcgcgagcagctggcccagccaaatgtcgcggaaccgcga

SEQ ID NO: 63261 - DNA, 290 bp, Triticum aestivum
  Clone ID: PAT_TA_63261
ggaagatggcgcacaaggccgagtgcacgcccatggaccggtggctcgacggcgccaacgcgaaccccaaccccaatgccgtcgcaggcgcaggcgacgccgcggtggccgctccggccctgtaaccgccgccgtgtccttgcacccgtttcttttatttttctggccagttctttcctctttttcttccttggtctttttccggacccttctctgtacatggtcgctgcggtaaaggttagccgagtctggttacttgcgaattgcttttagtaagaaaaacttttatt

SEQ ID NO: 63262 - DNA, 225 bp, Triticum aestivum
  Clone ID: PAT_TA_63262
gtttactggcgccgagctcgctctggcggagcaccaggggaagtacttcgccggcatcgctaagaagctcaagtccgtctgaaatctgatttactacaccgtaattcatgcaatgcagtgcaaagatgaactcgtcatatatgtatggagcaggatttacacaattctgtaacacgttcccgttcctttccactcttgtttaataataataataatactccctcc

SEQ ID NO: 63263 - DNA, 287 bp, Triticum aestivum
  Clone ID: PAT_TA_63263
ctggatcaaggcgctggatgcctcattatctgggaggatcagaagacagaggccatcttccctgctacactagaaaccatttcaaatgtcggaaaggttgtggacagtctttacatgaggtcggataagatcatggcttgaaagttgctaagcatgtgataggctgtttggtatgggttcagccttttcagttcctttgctttctttaagacatgtaatcctgcatattggcacttgattttgcatgttggtcgttatattggatcatagaaaaatacatcttgctc

SEQ ID NO: 63264 - DNA, 320 bp, Triticum aestivum
  Clone ID: PAT_TA_63264
tgtggttggtgcgcagagcttagcgaacgccattgatcgccaccgaaaccctccctctctctcgtctcggctcggctcgcctcgcctcgcctcgcccactagcccgcacgtccgtccaggcgacgatgccgccgatggcgaccacgacggcgacggcggctgcggccgactccgcggcgcgccgcttcgcctcggcctgcggcgtgctcagccagtacgtcagggcgtccggcgtctcggcgcccggcgtgctgggggccgccctccaggagcccggctcgccggcggacggggcgcaggagctgaccatcttctacggg

SEQ ID NO: 63265 - DNA, 120 bp, Triticum aestivum
  Clone ID: PAT_TA_63265
ttcacgcgtttgcccacgcgtccgctcctcttcgtcctgcaagcagcgccgccgcctttcaccggtccgagctccagccttcccttcaaccatggctgacgttgatgtcgaccccgaggt

SEQ ID NO: 63266 - DNA, 159 bp, Triticum aestivum
  Clone ID: PAT_TA_63266
tttagcctctctgcgcacctctgcttcacctctacccggtggccttggcttccccggcggctgtcagcgagcccccgacggagcaaaagcgccgccagcttggcttctgagctctgacctcgcttctcacccaccccgcacctacctaccccgtacatt

SEQ ID NO: 63267 - DNA, 408 bp, Triticum aestivum
  Clone ID: PAT_TA_63267
tgtttccgttgacgcgtgggcgccgagaaatgggggatgctgaggcagaagccgagggcgtgctgcggggcgccgggcgtgggggtgtacaacttcaacctgacgtccaagtgcggggagccgggagcgtacgcgtgcgacgacccgtccaaccactggagctgggacggcatccacctcacggaggcctcctacggccacatcgccaggggctggctctacgggcccttcgccgacccacccatcgtcggcaaccggaacctcgagtagtactgtagcagcagtggtacagggcttgtttttgcgtacatgccacctgcacatgggttttactactgtatgtagagaaagaaaggaaaacaagtcaaagaacacacatgccttgtgcagattaattgattgctaatt

SEQ ID NO: 63268 - DNA, 294 bp, Triticum aestivum
  Clone ID: PAT_TA_63268
gtctacggacgtaagcttgagcgccgcccagagcaggctcgtccgtggccgtcgagacctccatgagaggatcgctcgcgacccagcgctagcgcggttctttcaactcccggaggtcgaatgaacgcgccccgctacgccgtagccgcggccaagttgctcgccaagcacttgccggtagcgccttccgagccgccggctcgcgagcgtggcttggagacgatagagcgcgccatgcaggcgcgcgcttttcgtcgtcgtcgccgactcctgctcggcggcggaggcttcggt

SEQ ID NO: 63269 - DNA, 203 bp, Triticum aestivum
  Clone ID: PAT_TA_63269
catagggcgagccgaacaacccagcggcatcagatccctcccaccggcgccgcgctgcgcactgcagacggaaacggccaaaggagagcggcgtggggcggagcggggggcgatggggaagtacatgcgcaagtgcagggcggaggacgtcgcggtgggcggcgtggaggtcacgcaggccgtcggcgtccggacgcggtccc

SEQ ID NO: 63270 - DNA, 271 bp, Triticum aestivum
  Clone ID: PAT_TA_63270
tgtctaactctcagtctcatcatctcgatcagcatttgggtgatctgcgcatgcctagcctgaggcagtgcagcaccttagagaggcagctgctcggccacctctcagccacgaagatgaagatcgccaaggccccggtgctcctgaagaaggcggtgaccatgtgcaagagcaagaccggcgtgctcgcggccaggctcctcttcctcgcctcgctccggcgcaggatggccaccgtcggcgtgatgtctcacaagatacacgcgctcat

SEQ ID NO: 63271 - DNA, 408 bp, Triticum aestivum
  Clone ID: PAT_TA_63271
tttgtccgcttacgcgtgggcggacgcgtgggctgatctctgtagttatctgtactgcatgccatcagcaccaggtgtcgatatctatgtcgccatggaaattaaggagagcatggaccacttggcgtgtcagttgccccttggatacatgaccattattctttcatatcagagtggaccatgcttgcttgcattatcattgaaaattgagtccccatcggtggtcgagggatagccatgtttgaaccagtcttttccttcttggagtgagaaatagccgagttccctatttttagggtggaagcactcatattcatgttctggttacgcttactgtcaatcttatcatattggttaatacatcttgaacaattgatcttctgcaagattggggttgctctttatgac

SEQ ID NO: 63272 - DNA, 144 bp, Triticum aestivum
  Clone ID: PAT_TA_63272
tcggttaaacatagacctggggtaggtgttttaatctttatctgtttgaatgttaagattgttcgttggcaagagtatggcactgaaattgttctctggctccctcccctcacgcaacgcgcccgcgcgcgccggggggtgggg

SEQ ID NO: 63273 - DNA, 140 bp, Triticum aestivum
  Clone ID: PAT_TA_63273
tttccggccgtccctctggaagctctctgcacactgcgagccggcatggatactcttcttcagaagctgtaataaacttaaaaaatggtactgtactagaaggaataatcggcacaacgatataaatgtgggtgtttact

SEQ ID NO: 63274 - DNA, 132 bp, Triticum aestivum
  Clone ID: PAT_TA_63274
tccacgcgtccgaagaaatccaaggacatggaggagattccagcagctgtcaccgacgctagtgagaacaagaaaaagaagaagagcaaggagaccgaggagacccctgcagccaacaccgacggcgagaag

SEQ ID NO: 63275 - DNA, 435 bp, Triticum aestivum
  Clone ID: PAT_TA_63275
ctcgctttcgtccggcagcccgaggctgctcaagagcggcagcggcagcgagtggagcgtggtggcgcagaggaacgtcaagtcctcgctgctgctcctgctggccatctccacggtcgtcgccttctccatcctctactcgtcccggagcttgaccgtggccaggacggccggcgaggcgctgacgcagagccctctgctcgccgccctcgacctgagcagcaggatgccagaggatgacgacgatcaaagcgatgagccagcgttccctgcggacgacagcgtgacgcctgagcagagcacacctgcggaggtcgtctccttgccagctgctgctccgagcaccggtgaggcggccatgcagctcgaggagaaatgcgacatttccagggggaaatgggtgcgggagccgaatggcccggtgtacaccaacct

SEQ ID NO: 63276 - DNA, 205 bp, Triticum aestivum
  Clone ID: PAT_TA_63276
cccactcgtccggttaaaagggcagcgtgtgtgttaacttttcatgataaatttactgcctccattttttgggatcaactggtcctcgtgacgatagtccaagaaccaacgattggaatttcttatggtgtgtgtacggcgattcagaaagtaaaactcatgcctaggtggtcaccggtcagtaataagttctttgaattctctg

SEQ ID NO: 63277 - DNA, 214 bp, Triticum aestivum
  Clone ID: PAT_TA_63277
ggataggggcctaccatggtggtgacgggtgacggagaattagggttcgacgccggggcgctggtggagcagccgtttgccggggggcgtggcagcagacgcatacaaaagcaaatataagatagagccaaaaggtataaaaaagagaataaaatacacaaaaaaaaaaaagaagaaagccgtaaaagaaaaaggaataccacagaacggtgat

SEQ ID NO: 63278 - DNA, 441 bp, Triticum aestivum
  Clone ID: PAT_TA_63278
gttgttgacgacgatgacgactgccctgctgaccccagtggctttgggacaggtggcggcaccggatctggatccagcgaggcgaataatgatggtgatgcctcctacacaaatgcaaatgcttctggtaatggtggcggcgagggcggaggtaaaaatggtggaaccggcggtggtacatgcagtggaaactgatacggtgacgcaaacccttgaagcctattcgtgcaatcaaaacagagcaagagcccaagctattggcgttcgcttatttctatgtgcatttgttttgctcttacgtttccatgtattagggacaactaataaagggcttcattacataggtgtgtgctatgtaatgcggagactatgtattatctaaatgttgctccaacctttcattccatacttactgtgtcgatgagataacacttaactatc

SEQ ID NO: 63279 - DNA, 200 bp, Triticum aestivum
  Clone ID: PAT_TA_63279
atgataactaatatagcaaaaagcatactctcacttcattgtataacttcaaatatgtcttattctgtattatatttggacatgtataaaatactaatgctaaaatctataaaggggtagtagtgaagcaataaactaccctcatgttttaaacaacaaatctgttgagagcaccgtttggctattgagcttcttttttt

SEQ ID NO: 63280 - DNA, 238 bp, Triticum aestivum
  Clone ID: PAT_TA_63280
atttttgccatcatcacaaatccggatccatacaacccacttgtggagagcattgcacgtctgtacctgactgatagagctaagcatgatgaaatagctgctgaatggacattgaggtttgcaagatagggagtcctttgtgtaactaaataagaaaaattgactctgtaaatgaataatcttgtatgtatcctgagatataagttggaaaatgaccaatacattaatctgagttgtg

SEQ ID NO: 63281 - DNA, 307 bp, Triticum aestivum
  Clone ID: PAT_TA_63281
atttgttctcccaaatggatcaaaaggctgctcccgtcaaattcgcaaaagtcacaaaagtcctcggacgtaccggttcccgcggtaacgtcacccaagtccgtgttaccttcatggacgacgatacccgttccatcatgcgaaacgtaaagggccccgtccgcgaaggcgacattctgcccctccttgagtctgagcgtgaggcccgccgtctgcgataaactgcgcatgtggggtagaacatggtctgcgacgatgagcacattgagaaccagttagagcaaaataaaatcgacctttccatgtt

SEQ ID NO: 63282 - DNA, 128 bp, Triticum aestivum
  Clone ID: PAT_TA_63282
tgtatattttgttaggatcatgtacaccaatctgattgataaagattcggttagatctctctctttcttgattcccaaatatgtaaacctaccaaccttgtattcttggcctacatggctttgcccct

SEQ ID NO: 63283 - DNA, 295 bp, Triticum aestivum
  Clone ID: PAT_TA_63283
ctcgtgggcgctcgtcgcggacgtcccgtgccctgaccgcgccgtggtgctccaagtgcaccacctccccgccgtaccgccgtgcggggcgttcgcgtgggcgccgtcgctcctgacgctccaggaccgtctcaccgaggagggaaagcgcacggacaggcgcaatccctgcgggctactcaaggacatccacgcgctcgtgaagtgcgcgcagaggctcgccgctgtgtgcagcgccatgaaggacggtctggagccgttggaaaggcacgtcccggagggtttccaccgtatt

SEQ ID NO: 63284 - DNA, 261 bp, Triticum aestivum
  Clone ID: PAT_TA_63284
gtccgcccacgcgtccgtgtactgagtctactgtaccagggcagtcccttctccctcccctcccctccgttcgctcgccgtcacgtccccggccgacccctcgccgccggaccgcatctcctgccctaacctaccacctgcagatccgcgcgctccccgaccagcgtcggcgggaactttcctgcgagcttgatccatccagtggccggcgacagcgaccgaccgccgcgcggatcgatccagcgaccaacctggagcacg

SEQ ID NO: 63285 - DNA, 332 bp, Triticum aestivum
  Clone ID: PAT_TA_63285
tatacacaatgaccctctccaagtcgctggcgcttttcaatcttttgttcagcttgtctccttgatggcgctccctatgatgatggagatcggtctggagagagggttcaggaccgcgttgagcgactttgtgctcatgcagcttcagttagcgtccgtcttcttcacattctccctcggaaccaagactcactactacggaaagacgctgctccacggaggagccgagtacagagccaccggacgtggattcgtggtgttccatgccaaattcgccgagaactatcgactgtactcacggagccatttcgtcaagggcatcgagctgatga

SEQ ID NO: 63286 - DNA, 405 bp, Triticum aestivum
  Clone ID: PAT_TA_63286
tttgacgcgtgggttgaagacttgctttttatatctaagtatctttccagaagaccataaaattagcagagatcggttgataagaagatggatttctgaaggctttatccaagtaaaagatgaaactgatagccagcttgagcttggagatagctacttcaacgagctagtaaacagaaacatgatcatgccgataaacatacatgctgatggtagggttgaagcttgttccatacatgatatcatgctggatcttatatatgaattagcaagtggagagaactttgttactatactggatgttatcaaggaagacacacctttggaaagaagttccgcagattgtccctccagaagagcatgacaggtctcaccaatgctcatatggctaccacaagcatgtca

SEQ ID NO: 63287 - DNA, 341 bp, Triticum aestivum
  Clone ID: PAT_TA_63287
agagctttgagcgaaggggttttttcaacattttttatcacctttcccgcggcgatccttgtcctcctggccgtcctgttcacggggatcctcgcccagccatcgggctatttccccaagtgctgcgacaactgcaggtccttctcagggatcgacgtctgtgacgacgcccatcctgagtgccccaagggctgcttgcagtgccgcgtggtgcagacgagccctaccaagacgttcaggtgcgccgactaccgcggagactccgacgacacgtgcggcccgccctgcaagaaaaactgatgggttaagatcagatcacgaaatgtttcgcccaaaataag

SEQ ID NO: 63288 - DNA, 407 bp, Triticum aestivum
  Clone ID: PAT_TA_63288
ttgtttcgcgtgggggaagcgcaggtgcctccctctgtcttcctctgcgactcggctgcttcttgacttgcaggacgaggtcggacgacttgggttgcattggttttggcaagaaggaaggaagaagatggtcatgaggccgctgtggcacgcggcgccgcctatctagtctctgccccttacgtacctccgtgatcacagcagcttcatgcctcggtgaggtccctaatttgtaggaccaagctatgattctttcttacctatgtctgcaagctgttcgatgaaaatacaagcgagctacaaggaaagattcatctatgtaatatccaagctttgttgtctgcttaataactttttctgagatttagttacattcaacgatgacttgcatgtactacattataata

SEQ ID NO: 63289 - DNA, 351 bp, Triticum aestivum
  Clone ID: PAT_TA_63289
tcttttcggagggtcggccggcgaagccgcgccggaccccatgatggcggtggccgggcggatctgacgcactgctcggcggggcgcctcgtcaagcttcggctcccctgccggccgccctctgccagccgtgccctgcgccagcacgtccccggcggcctcgtacaccccagcccccgcctgacctcccttccaccggccgctgcgagctcctgccgccggcaaggtgcctccgccttcccccgtctccgcgtcagatctgtctgtcctgccgccggcatcctctctgctgacggcgccggacccgggattggggatggcgtgctcctttgctggtgtcgggcagtcctt

SEQ ID NO: 63290 - DNA, 385 bp, Triticum aestivum
  Clone ID: PAT_TA_63290
ccggccaccataggctcgcctcgccggcttgtttccaagagctttgagaaggttcgcgcttcttggggcttacttcctgggtcttgctgccgtgccgtcctccattccttgcttctcttctctcgtcgatttcttcgcctggactttcctctctccacctcggtgatttgcggcggagcggatcgagagcaggagtgaacaggggcgcataagcatcgtcattcaacccaagggtgtagagagctagctaactcgaggaatggatcgccggagctggccgtggcgccgcaagtccatctcggacaaggcccccgcccccaccgaaaccgacagctccgcctcctgcccatccgagactttaactgatgaacaggataccaccctc

SEQ ID NO: 63291 - DNA, 348 bp, Triticum aestivum
  Clone ID: PAT_TA_63291
ttcctctcaagctcctcgcttgctcgcctccctttttgaccggttggcagctgctggagcccgaaaatccaagaaaagcagcgggtcaagaaagagggaaagcaagcgaggagggtgatgatgatggctataagtcgccccatgattcaccgtatcatcccgtcgcctgcgcgcctctgctaaaagggcctcgccgtccgtgtacgctccagtgagcggtggaagagcgtgcggttgcttcgcgcagacggtcggacgccgccgctgcaatgccgcagtaccaggagctgccctgcggcgggcaggtgctcgacatcaacgccgcgctcaaggatggcatcctggggt

SEQ ID NO: 63292 - DNA, 445 bp, Triticum aestivum
  Clone ID: PAT_TA_63292
ctgttgctggcagcacaactaaagattgtgagtttcctgctctccagttgaagagaccaccaaagcctgctagccgaaaagatgaacggcaagtgagcgtagcggaacagactaatggccgaaccaatgcagctctcagtcaaggacctgtagctgaaaatgaatctgagaaggtgagcaaaaatatgagtagtgaaactgctgatgggaagccctttctacagatcgggagcaacatggtgccagttactgttggaaatgagactaaagaagctgctcaaaccgtacaacagtttgtagtatatgtgggatttgagcatgagtgctcgtacggtcaccgtttcttactgtcagagaagtatctcaaggagattgattatggaagatcttatcaaaacaatgaagcagaaagtaagcacagttcacaaaagttgcccccaaatgc

SEQ ID NO: 63293 - DNA, 289 bp, Triticum aestivum
  Clone ID: PAT_TA_63293
tgggcggagccgccggtgtccccggaggtgggggtggcttcggcagagggggtcatgcgaggatggccgctggggcgaggaggcggagccgatgaccccggcggtggcagcgacagagggggtcggcgatgatggtcgatggggcgaggaggctgagccgatgaccccggcggcggcggaggggtcccaggggctcgaggaccgacgtctgatgcagtcgtggttcctcgtcgtcaagagctagatcgagcgcccgacggtgtagccgtccagaggaagaggaagaaca

SEQ ID NO: 63294 - DNA, 328 bp, Triticum aestivum
  Clone ID: PAT_TA_63294
tctttaggatcctgtcaaatgtttgtacaggctttgaagtaaccaacaagtagctcgatcagaaatcattcgcgcctaagaggacgtttatgactggatggtttttgaagactgccaactggaagagctcaccttgcatacacatgaatgcacggagcaaacgtcgcggctcttcattatgcttcattatgctgtggatgcttgtgttacccaacctctggataatatgcagcggcagtattcataaacacgttctcctgccagggttcagtggctcagaaatggattacatcgataacaatggaatatttctgctctctaatggatc

SEQ ID NO: 63295 - DNA, 225 bp, Triticum aestivum
  Clone ID: PAT_TA_63295
gaggctccttgcgcaactttgggctatctgggcaattatctcgcggagttgactttgaccgattacagctgcctgaaataccacccttcggtggtggcagcctcagcagagttccttgcaagatggacactcgaccaatgatacctggcatggaactgtactctcgagcattacacctgatacaaaagctgcgatattcaaggatgcgtacgcgatctatgggag

SEQ ID NO: 63296 - DNA, 284 bp, Triticum aestivum
  Clone ID: PAT_TA_63296
tgtcacgcgtgcggcctctctctgtttgctctggcgtccgccgagcccatcctcgtgcgcgcctgcgcccggcccgtgctcgctcgctcgccgactccctcgcctcgatccaccgcgccggcggcatggcggatcagctcaccgacgaccagatcgccgagtgtcaaggaggccttcagcctcttcgacaaggacggagatggttgcatcaccaccaaggagctgggaacagttatgcgttcgctggggcagaacccaacggaggctgagctccaggacatgat

SEQ ID NO: 63297 - DNA, 290 bp, Triticum aestivum
  Clone ID: PAT_TA_63297
tttttacgctccagcacctctcaacctcaagtgggggccactaccaacaacaccacgagaacacacatgaccttcagcgtctcgccggcgatggagggggggcaagggcacgagtacatgatccgcttcgacagccacttcgacgacccgtcgccgagcaccgccaccgccgagccgtcgccgtttgccggaaggtcgatctcgccggagcaggagcacggcgccatggtcgccgcgctgctgcacgtcatctccgggtacaccacgcctgcaccggacttcttcttccc

SEQ ID NO: 63298 - DNA, 204 bp, Triticum aestivum
  Clone ID: PAT_TA_63298
tttttcgcgtccgcccacgcgtccgccaagatgcgcataccttgttacttgttgttggctaccaaagtcaacccaaggatgaagcagatcgctgccgatatcgagagggtcctcaagggcatcgtggccaagagagagaatgccatgagagccggcgaggccacgagcgacgaccttctcggtgtgctgctcgagtccaacatg

SEQ ID NO: 63299 - DNA, 326 bp, Triticum aestivum
  Clone ID: PAT_TA_63299
ttagcggctgatcgtggaggcaagccagggcggcgccgacgaggtgcgcgtcgacggcctgcccggcggcgcgagggccttcgagatctgcgccaagttctgctacggcatggtcgtcacgctcaacccgtacaacgtggtcgccgcgcggagcgcggcggagcacctgggcatgacggaggacgtggacaagagcaacctcgtgttcaagatcgaggtgttcctcaactcgggcgtcttccggagctggaaggactgcatcatcgcgctgcagagcaccatcgcgctgctgccgtggtccgaggacctcaggctcgtcgcgcgct

SEQ ID NO: 63300 - DNA, 353 bp, Triticum aestivum
  Clone ID: PAT_TA_63300
ttgttttattagttgattggcatatatggatctctccatgtttattagttgatctccaacccctactctgctgtggtgttgtgggagcaagaagagcatgcatgctttctctctacatctagggtccatacggccagattgacgggcctaaactctggcttcactcggatttatgtgaatataagcgtaagaggtctagtggcaatgctacaaaatcattgcaggcgtgagtatccggattgcactactgctggccgtttcttgcgattgcgtacaacaggcttgtgacaaagccaagtcatggcctcattaggccccttttttcagccaaactgaaagcacttcatgttagc

SEQ ID NO: 63301 - DNA, 273 bp, Triticum aestivum
  Clone ID: PAT_TA_63301
ttcttgtcacgcgtccgcccgcgaccacgcctgcgcgcctccgttccgtgcctgcagtgccgccatccacgacctcggccgccggcgagagccccatgttgttgcctctgcccaagctcgctgcagcctgcagcgcctcctgctgtcgaccgtggacgagctatggcgaggggcgccacactggtgcggtcgccgccgcgagcatgggcacggttaggccgctccaccacggcgcgcgcggggaggggccggcgggcgcagatggcctgagat

SEQ ID NO: 63302 - DNA, 247 bp, Triticum aestivum
  Clone ID: PAT_TA_63302
ttttcgcgtgggcgcggccacaacctacggagcttgcctgatggcgtgcgcaactgctacacgctccggtccctggtgtccggcctcaagtacctgatccgcgccagcttcctgtatggaaactacgacggcctcaacaggccgcccgcgtcgtttgacctccacatcggcgtcaacttctggaagacggtgaacatttcaacgtggggggcagaccagggaaacactgcagtggtggaagccatcg

SEQ ID NO: 63303 - DNA, 315 bp, Triticum aestivum
  Clone ID: PAT_TA_63303
ttgtatcgatctacagcacttttcgcctcatacaattcttttcttcttcgatttttccatcaccagaaacgaatagcagagaatttcctgactacagcacaaagaaacagaaaaatttctgacttttttccccagtggattagctttctccggttgttaattccgagacgagatgccggcgtcggggtgcatcatcggtcctcctcggcccggtcctaccagcagccgccgtcggctcgggagtcgtcggctcggtggagcgtggaggccgcgcggcagccgccgtcgttccggtggcacagggaggtaagcaac

SEQ ID NO: 63304 - DNA, 390 bp, Triticum aestivum
  Clone ID: PAT_TA_63304
tgtttaccggtgtatgacacggaattcgccggggagaacagcttggaggattccgagaaggaaatcataaccataaacgatcattcatgcgaagccatttctgatgccaagagcagtccggaggtaaccactgacagagaattggttgtttcgtctcatcaagcagttgatgatactgagaggagcccacagccatcagagagggaacttgtcggtacgagtggtcatccacctgagcttgtttctcttgacagagaagaagcagccagtacgaatggtcagtcagacgctgatgacaagagaagcccagagcatccggagcagaaatttgttttggtagaaggtcactcgcatgaacttatatctgatgtttggaaagaaattgctggt

SEQ ID NO: 63305 - DNA, 339 bp, Triticum aestivum
  Clone ID: PAT_TA_63305
ttggaacatacatcttcagactttgttgagaaacaggagatagctcgcttcctccctgccctgccctgccctgctctagcaccggcctgagctcgcgcgtggtgttactgctgagtttggccggaatggggcggtcgccgtgctgcgagaaggagcacaccaacaagggggcctggaccaaggaggaggaccagcggctggtcgcctacatcagggccaacggcgagggctgctggcgctcgctgcccaaggcggccggcctgctccgctgcggcaagaagctgcgcctgcgctggatgaactacctgcgtgccgacctcaagcgcggcaacttcaccg

SEQ ID NO: 63306 - DNA, 315 bp, Triticum aestivum
  Clone ID: PAT_TA_63306
gtctcgaccatcaagcttgttatgacgcactttgaatttccgagcaagtcgcagccttttcagattcatcaacacaggttacatcagtagtcaatatggttcggatgcataatagtacgtacttcatttcctttttgttgtgtacggtgacctacaacatggatcatatgtaccggttatctttcaggttcagtttgctgtggcgaattcttcttgaatttgttgcggcaaacttgtggtcatgtatggtttttagttttgtaagcatgcatagtttagaagttagaaagctcgttcatgtattgttctaaactg

SEQ ID NO: 63307 - DNA, 175 bp, Triticum aestivum
  Clone ID: PAT_TA_63307
ttgttggcgtgcgtggtgtttgctggtgttgtgtttggtgcgttgttgaggttacctcgctgagtttgttcaacccgtcgcgggtgcggcgatgagcctttcgctggtcgctgttattttcacaacggcttattccattgcgcgctttcgccgtcaactcattcgcgctcagaag

SEQ ID NO: 63308 - DNA, 310 bp, Triticum aestivum
  Clone ID: PAT_TA_63308
tcgtccacgcgtccgctgaagttataaagtggatggagcgctttgattgcattgttgttggccccggccttggaagggactcatttcttatggattgtatcagtaatatcatgaggcatgcacgacaggctaatatcccaactgttgtggatggggatggccttttccttataaccaataacattggtcttgttgaagacaactcacttgccatcttaacaccaaatgtatacgagtacaagcgtcttgtgcagaaggttcttaactgtgaagtaaatgaggaaaatgcttctgagcaactgactgcact

SEQ ID NO: 63309 - DNA, 319 bp, Triticum aestivum
  Clone ID: PAT_TA_63309
tcgtacgtatgcaattgacacaaaaagctggcgtgagggatactcgcgaaatctgcctggagcgaccctccaaaatctgtatttacggaagagtatggctgattctcgatgtcaatcctcgacagaacatgggtataaattctgtcaagagtatacattacctaacaaacaaccacaacaacaatacaaactcgaagatccagagtgggtggcagatgatgcccgcctggctagagcacaagatcgtctacgcaattatttgcgttcacagcaacccgaagaatttgatgtctttccggaatctctccgtttggagtta

SEQ ID NO: 63310 - DNA, 186 bp, Triticum aestivum
  Clone ID: PAT_TA_63310
ttggacgcgtgggcagactcgcgtctccggggcccttgcaccggcaccgcacatagcgcgcgcggtcgagagagatggcgtacgcggcgggctcgccggcggtgccggactggctgaacaagggcgacaacgcgtggcagctgacggcggcgactatggtgggcatccagtccatgccgggcctgg

SEQ ID NO: 63311 - DNA, 370 bp, Triticum aestivum
  Clone ID: PAT_TA_63311
tatgaccgagatgcacattttggtccagtccaccatggcctcaaagtccaactcctccaactccaactccaactccaactccaacgggggcagcagcaagggcggtaacggcgggggtaacatcgcgtcaaagcagcataatgcatcactgtcagggacaaccacaaggggcagggagttcgaggaccccgagacaaaggcttacatgaaggccaacgccgccaaggctctgtggcacctcgccaagggcaatgcagctatctgcaagagcatcaccgagtcaagggctcttctatgcttcgcggttcttctggaaaagggggaaggcgatgtgcaatacaattctgcgatggctctcatggagatctgc

SEQ ID NO: 63312 - DNA, 250 bp, Triticum aestivum
  Clone ID: PAT_TA_63312
gtcttaccaattgcagagaggccattctaagctgagtcaaaattgcaacatcatgcagctgtaaatattgtgggtgatggcttcaattggaggaaatatggtcagaagcaagtgaaaagtactgataattctaggagctactatagatgcacaaattcaagttgcttggccaaaaagaaagatgagcattgtcctgatggccgtgttatacaaatcatatatcgaggagcacacagtcatgaaccaccac

SEQ ID NO: 63313 - DNA, 329 bp, Triticum aestivum
  Clone ID: PAT_TA_63313
tagggttctacatggagctggtgagattttataccctataatgaaatgactaaaatgccctcggcgtggcacgagaattacaggcggtggcacgagatcttttacagcgggaggtaactatttattgtagcagtgttaccgggtcgatccaacggccgaggtccttcagtggcctgatctgacggctgaaaacgcatcaaacaagagatccgacggccagaaatcgctgagctatgaggaggcccatgttctaccaacaaacatacccacatacacacacatgaatgattacgtagaaagaaatattccagggaatgtcatgatgcaca

SEQ ID NO: 63314 - DNA, 379 bp, Triticum aestivum
  Clone ID: PAT_TA_63314
tggaaatatccctccaggactcagtaattgctccatgctgaaactcctcggcgctggctacaacaacctcaatgggactcttccagacgagctcttcaaagttacctcgttagagcacctctctttgcctagcaatggcttagaaggagctatcaatggcatcagcaagctcacaaatctggtcgcccttgatcttggggggaatgagctcactggcagtattccagagtctattggtgagctgaagagattggaggagctgcatttggaacacaataacatgtcaggggagctgccatcaactctgagcaactgcacatatctcgtaacaattgacctcaagagcaaccagttcattggagaacttacccaggtcaac

SEQ ID NO: 63315 - DNA, 184 bp, Triticum aestivum
  Clone ID: PAT_TA_63315
atgtttgtgcaggagctccgtgttgtgctgccaaaggaggtcgaggctgcccgcagtgctgtggagaatggcaccgctgcgcatcagaaccgtatcaccgagtgccggtcatacccgctttaccggttcgtacgcaaggagcttgggactgagtacttgactggggagaagacacgatctcctg

SEQ ID NO: 63316 - DNA, 245 bp, Triticum aestivum
  Clone ID: PAT_TA_63316
tctcggacgcgtgggcctcccgcacgcttgtggtccgttctccgccccgcctcgagcagctcagggacgcgcacagccatggcgacggagaccgagaccttcgccttccaggccgagatcaaccaggtcctctcgctcatgatcaacaccttctactccaacaaggagatcttcctccgcgagctcatctgcaactcctccgatgccttggacaagatcaggttcgagagcctcacggacaagag

SEQ ID NO: 63317 - DNA, 185 bp, Triticum aestivum
  Clone ID: PAT_TA_63317
ttgcttgttcttcttcttgttgttgtctcaccgcagcatggagcagccagcatcgagggagcaacaatggcgatggcgtcgtcgagcgggctgaggagctgcagcgccgtgggcgtgccgagcctgctggcgccttcgtccaggtccggccgctccgggctgtcgttctgcgcctacgccaccac

SEQ ID NO: 63318 - DNA, 300 bp, Triticum aestivum
  Clone ID: PAT_TA_63318
tcccacgcgttcgcggacgcgtgggcggaggcgtgtgcagcgccactcacacatactacactcatccactcaagcaaaagctagcggcgttgcagctcacttgagtccagggggcatggcggctccgaggggtgcggcactggtgctggcgatggtgctcgcggccatggtggtggcgccgccggcgactgtgcacgccatatcctgctccacggtgtacaggacgctgatgccgtgcctgcagtacgtgcagcaaggcgggtcgtcggcccggggctgctgtaccggcatccagaacct

SEQ ID NO: 63319 - DNA, 412 bp, Triticum aestivum
  Clone ID: PAT_TA_63319
gatcccatcgtggccggcctagcactggcatccctccaccgtcgccctcgcacatcaagccaccgcagatccatccatttgccgccgccctcgcacatggagccgcctccgatccctgcgctacctcgacgggagccatcgatcgtctcactacaacttgaagctgcaacttgggcggtgccatggctccttgtgcagagaaatcaagagggggcgaggtcagggaggagctgcgggaggagtgaaggaaaagaaggcgacggagaaggctctgctcgccggagagctcgatcggcagcgacgaactccgagccgcatgttctggcgacggagggctggaaccggtccatggggagacctgtaggcgcgcggcggcggcggtttgggacggcggagaagctgcaactcggac

SEQ ID NO: 63320 - DNA, 361 bp, Triticum aestivum
  Clone ID: PAT_TA_63320
ttatctttgtttctgctccacatgatggcaggggttaatccacatttttagatcttcatttatatagtaaaaatagcatacacttttacaatccatatttcttgccatcatgatgtagatgcaaaattgccatgaactttttctttttcgccattgcataaaaaaaatctttttttaccatggcaatgtttttgcttataaagatgattgcatatttagtagaatgttttcatttttttatctagcacgacaaatttatttttagatcttttcaatttcttttcagagtatggcaaaatatggcctttttattcacaaccaaaagcggcctttcttagtcacagtaggtcttaggaaaact

SEQ ID NO: 63321 - DNA, 420 bp, Triticum aestivum
  Clone ID: PAT_TA_63321
ttctgggcattaccgccggagcgacgacggaggcggccatggcggagcggggggtggagtcggtcctgttccgggggaagaagctgatgccgcaaaccaacgacaagcggctggaccgcgtggtggagcaactattgttcggtgctgctattttccattcggttgtggggtggttctacttttcaccaatctggccaaggaccaaaagtaggtttgacctcaatttcgatgcaaacatggattgggatgtgatgcatgtacttgcttattaagggatttggatcttgccctcaattagagttcccaatctcaacgaagtggggtttatgaattttattattccttagcttgaatggactgtagcttcgcttaattgactgacagttgtatttgactgcataactggattaattgatttca

SEQ ID NO: 63322 - DNA, 369 bp, Triticum aestivum
  Clone ID: PAT_TA_63322
tctctgactccgactcggatggctccgaggcgacgacagcgctcgttcccgcccagcaccctcaccggcaccttcggtcgggccacagcgcgcgcgatatcttttgcgccacacccacacatgctgtgtttaactcgggcggggcgccgaggcggcaggtccgccagttgcgggacggccccgcccacgggatgatgccggccagaagcggttcgaccaagttcaccggggcaaagcagcggtgcaggactgtcgagcgccgggtgggcctgcagaagcgcgacagggcgtggtcgacgagtggtgccgggacatcggcgtcagcaagggcgtcttcaaggtctggatgcacaacaacaagcacaacta

SEQ ID NO: 63323 - DNA, 459 bp, Triticum aestivum
  Clone ID: PAT_TA_63323
ttctgacggaggagagcaaagctcttcttcccaagtaagtaagatagtgatcagggagggagggagggcatgccatgtgcttggccttccaagttaaaggagctagctctttagaccaggtgggcgagcgggaaggaccggggcgtctcccacgacgcagacgagaccggcggcggcttatggtggcgcggtcgatgaggacctgctggatctcgccggatctggtgggatggcgcgcagatctctctccgatcctttcccagatcttctcctgctacctagggttccccaccgcaggcgcacctcggcagccatcgaggcgaccactgccgcctgcaggcggaacgaggcggaggagaacctcctggtacgacgtgaggaggagacgtacggatgaacttaaagatcaggagagacatactggccgggacaatctttaaaccatgaagctacacaatc

SEQ ID NO: 63324 - DNA, 432 bp, Triticum aestivum
  Clone ID: PAT_TA_63324
ttcttcgcaaacccccgagagatcacagcatgttcggcttcggtcaccacggccaccatggccagaacccccctgccaacgctccggccgccggcggcggcaaccagcccaccttcaagatcttctgcaaggccgacgagggctcgtgccattcaacccggagtacctcgacgagtccgtgatgtggacggagagcggcgacgtcggcaagggcttccgctgcattcgcatggtgaacaacatccgcctcaactttgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgccccccgcggtggctccacagagcccaccgtgcg

SEQ ID NO: 63325 - DNA, 137 bp, Triticum aestivum
  Clone ID: PAT_TA_63325
gtcgttatcacgcccttgcacaagcgagcgagcaaccatgtcttctgcagagccgacgcgagactagagcgtctacatggccaagcttgcggagcaggccgagcgctacgaggagatggtggagttcatggagcgcg

SEQ ID NO: 63326 - DNA, 144 bp, Triticum aestivum
  Clone ID: PAT_TA_63326
tcttatgtttgagacacatctcattctgggatggactcggaaaaaagcggtgatggccgcacaagggcttacaaatttgtcgcctactcagcggtcactttctctattgtggctgtgttgagcgtcgtttgcacactaccaatg

SEQ ID NO: 63327 - DNA, 255 bp, Triticum aestivum
  Clone ID: PAT_TA_63327
gtttggtagagcggagcatagaggatacctcgacggcgccggccatggcatccgcctacgaccgcacggccgacctccgcgcgctggacgccacctgctccggcgtccgcggcctcgtcgcctccggcgtcacgcgcctcccccgcatcttccgcgttccctacggcgtccaccgaccacaaccacctccaccgcacgccccatcccaagaagcgccgtccgtgcccgtgatcgacctcagtggcgccgaccgcg

SEQ ID NO: 63328 - DNA, 264 bp, Triticum aestivum
  Clone ID: PAT_TA_63328
tctacgcgtccgcgcgcacgaaccccctccgccgccgacctcgcgtcttctcctgcgcatctcggaggtgcttcctagtttccacgatgaagctgatcgctgcctacctcctcgcctatctgggtgggaactcttccccaagtgccgctgacgtcaagaacatcctggactcagttggtgcccaggctgatgaagaaaagcttgagttccttctggctgaactcaaaggcaaggacatcacagaagtgattgcatctggaaggg

SEQ ID NO: 63329 - DNA, 116 bp, Triticum aestivum
  Clone ID: PAT_TA_63329
gcatgcaccctgcaaggcgcagctcggtgccgtgagcggtgaggagaggccggtccgtcgattgatcgattccgtttccatatcgctccccggaccccgagatgggattttgatgc

SEQ ID NO: 63330 - DNA, 205 bp, Triticum aestivum
  Clone ID: PAT_TA_63330
tgtaattactttactcggtagaccgacgcagagaagcatatgctaccatactgcattcagcaagcgagtatgtctgtggcgcaattgcagcagctcaaagcattcgtcaagcaggatcaacaagggactttgttattcttgttgatgacaccataagtgaccatcaccggaagggccttgaatctgcgggttggaaggtgagaat

SEQ ID NO: 63331 - DNA, 139 bp, Triticum aestivum
  Clone ID: PAT_TA_63331
tttgttacgcgtccgcctcaactggctgcagtgcgcgccctgcctcgactgcttccaccagaccggccccgtcttcgaccccgccgcctccgcctcctaccgcaacgtcacctgcggcgacgcgcgctgcggtctcgtc

SEQ ID NO: 63332 - DNA, 231 bp, Triticum aestivum
  Clone ID: PAT_TA_63332
cttatactaaaagagtgacactgggcatgttactcaagtaatatgttcgaccatagatgccaagtctcttgagaatgtcaactcagagaactcatttgacagtatcaaaattgatttgggggaccaaaatgtttcaagtagcttggatatcaaaaaaggcaattcctttgcagcaggtcagtcgtgctctgataataatgcaactgaagctttgaaccatcttgcaaatgc

SEQ ID NO: 63333 - DNA, 183 bp, Triticum aestivum
  Clone ID: PAT_TA_63333
ggtcgtgcgagcgagcggaggaggagggttcagagcagcttttttttacctacctttcttgcttggatccagccgttcccgatcgagatctgccccggcgggcgatgagagcatgacccccgcgcaggaccccttctacatcgtcaaggacgagatccaggattccattgacaaaatacaaga

SEQ ID NO: 63334 - DNA, 111 bp, Triticum aestivum
  Clone ID: PAT_TA_63334
ttgcctacgcgtccggagatatggaaagagccggctcaatcctgtgaagtggaagacaatgcatgaaattgtttgtggacgctcggggaaacctttgcatgagaacaggtg

SEQ ID NO: 63335 - DNA, 281 bp, Triticum aestivum
  Clone ID: PAT_TA_63335
gtgccttcaatgatttaaatataactgcaccgggggggagttctatgtaataatgtgatcatgtagttccccaccacgcagaaagagacatgcatgtacagctgtgtatatgagctgcccacatgatcaaactttgatccatgtcctcacactatagtatagaggatgcactacaattgttcaagcaactctgcacagatgcgaacaacaggtcaaatcagttccctctagataactctctaaccatgaaccatggaatttaatttgctcagagaattgta

SEQ ID NO: 63336 - DNA, 163 bp, Triticum aestivum
  Clone ID: PAT_TA_63336
tcgctgacgcgtgggcggacgcgtgggcgacctgggggagtacttcatgaggtcggacacctagttcactgacaactacaacagctggacgacaccgacgacggagcaggagccggaggaggagcagtactaccgcgaggagtacgtgccttcatacaggccg

SEQ ID NO: 63337 - DNA, 357 bp, Triticum aestivum
  Clone ID: PAT_TA_63337
tcgtacagaagcgtctggctgcctccgtgctgaagggctgtttgcgcatggtctggcttgtaccccaacgagtcgagcgagatcggcctcgccaactcgcgccagaacatccgcaagttggtgaaggatggtttcgacatcaagaagccgcaggtgatccactcgcgcgctcgtttcaccaagcgtaacgaggccaagcgcaagggccgccacaccggcatcggtaagcgccgtggtaccgtcaacgcgcgtcttccgttcaaggacatctggatgcgccgaatgcgtgtgcttccgtcgtttctccgcaagtaccgtgacgccaagaagatcgactcgcacatttaccacgagctg

SEQ ID NO: 63338 - DNA, 312 bp, Triticum aestivum
  Clone ID: PAT_TA_63338
tctttctatgcggcctttgggccataagactggaaagtatgtttttcgctaaaacggtgaccccaggagtaccgaaggaaaagggtggaagctcacggcgcgctaccctgccaggatgccactagatagttcatcatctgatttataactatttctgatcttcattagtgagtatagaggaactggagcacatatcagtttacctgtgtgcccacctcgctgccgcaacctaccgtcccattcggtactatcgtcaagttatgtagtctttatggacatggttaatgatatcttgtcaggaaaaaagattgc

SEQ ID NO: 63339 - DNA, 384 bp, Triticum aestivum
  Clone ID: PAT_TA_63339
ttcgttccctgccgcgcctcggcaccacgctgcactacaactacacggccgagggcaactcggtcgccgtggcgttccgcgcgccgcagacgagcaaggccggcgggtgggtggcgtgggggctcaaccccaacggcacgggcatggtgggcacgcaggccgtggtggcgttccggcattccaacggcagcctcgtcgcgtacccgacgatgctggacagctacgcgccgtccatggcgcccgcggacggtgccgagctggcgttccccgtgtcggacgtggcggccgagtacgccaagaacggcaaggagatggtcgtgtacgcgacggtcgcgctgcccgggaaggggagcaagttcacccacgtctggcagcaggggggct

SEQ ID NO: 63340 - DNA, 266 bp, Triticum aestivum
  Clone ID: PAT_TA_63340
tttatttgtccggcgctcccgtgtgtcggccgctcggggccgctcgctatgctccacccaatcctccgccacctcggcgcttacaccaaaccggtgacggggacgcgtgtctccctccctgtcacacacatccggctgctagaaccttcagcttggccgacctgggcagggtcgagcagagcagagcacagtttacgccggacccggttctcaccagatccgggtgaataaccgctgctctacttggatctgctaggagggggaga

SEQ ID NO: 63341 - DNA, 212 bp, Triticum aestivum
  Clone ID: PAT_TA_63341
tcttgttcaagcataaggaggctgtgaaggctgctttggacgcggttgaaaagaagaaggaagaggaggacgcttccaaggctggtgaggacgatgatgactaggatgatgaggatgcctatgatgaggacacggatgacagggctgggtctgatgtcgagtttgatgacgagaagcacgatgagctctagatggatggtgaggatgagagg

SEQ ID NO: 63342 - DNA, 118 bp, Triticum aestivum
  Clone ID: PAT_TA_63342
ttcgtttccgcttctctagcgagcgagcaagctaggcttggaggtgaccgaaaatgccggtcagtaggatcgccgtggggagccaccgtgaggtgtacgaggtgggcgccctcaaggc

SEQ ID NO: 63343 - DNA, 222 bp, Triticum aestivum
  Clone ID: PAT_TA_63343
cgggtcttgaatatctccataataattgattaagaaccgtactccacagggacatcaagccaggtaatgggatgctggatatggacttcactgctaaactgtgtgacttctgtttggtgacacagcttacacgtgccgcaacctcacgctcaacagataacattattggaacactaggctacatggacccattataccagcagaacggccaggttactaaag

SEQ ID NO: 63344 - DNA, 392 bp, Triticum aestivum
  Clone ID: PAT_TA_63344
tcgatcccatggacgcggctcagtcaaaatgggggttcctaatgcaggtgttcaagatgccaccggataccaaccggacaaagctcttcccaccggccaatttcaagatctctggcggctcatcgctgaacccagactatagctgtggccagccagtgcctgtcagccccaccgggttccctaatcccagcgggctcgactctacaacgctggcggttgcgacatggcaggtggtgtgcaacattaccacggccaagggggccaagcccaagtgttgtgtcaccttctcggctcactacaatgactcagtcattccctgcaacacctgtgcatgcggttgttctgtgaaccgccggggtcctacctgcagcacgactgctccatccatgatc

SEQ ID NO: 63345 - DNA, 271 bp, Triticum aestivum
  Clone ID: PAT_TA_63345
ttggtatcttgtccagagctttgcagtcaccggaggctctattggtacaaaatgccatcttatttctcaaagtcattggagcattcgatcagaatgaagagttcacagttctaggaaagcccctgtctatgcttccagttgagcctaacataggcaagatgctgatttgtggggctatatttaattgccttgatcccatattaaccatctgttgcatggacttatcggaagagatccattcatgacaccatttgacaagaaggatcttgcg

SEQ ID NO: 63346 - DNA, 162 bp, Triticum aestivum
  Clone ID: PAT_TA_63346
ttttattcctgcccaacctcgagaagatgaagtgggacatggtcaattccttcatctgtttctgatgaaacaacatttctcctctctctagtacgtagcatgcatgctgctgcctatacaaaaccaccgcgtcgacgcatcaatctgtgcatgtacccaaaa

SEQ ID NO: 63347 - DNA, 355 bp, Triticum aestivum
  Clone ID: PAT_TA_63347
tttgttccacacgagatttctgttctcgttgagctcatcttacgacacctgcgacaccacataaattacatggcccgccagccacacgcataatcctatttcacttgcaaaactttcgagtgcatgttgcaaatcgaatgcggctaccgggggattctctgttgcgccacttgtgaacgtgaggctgatacccggacacgccgtagccgccaaacacgacgggctcaaactcagccgctcacgtccacccgtgcgccgccgaatgccgaacacaaaaccccacccaccccacgcacgcaccgtgccggcgttggcgtcggcatccgcatgaagagctcggcggacaacgtggaca

SEQ ID NO: 63348 - DNA, 424 bp, Triticum aestivum
  Clone ID: PAT_TA_63348
ttgagggcctcggccgccacgtcgtctcctcgggcgccgtgcaggccaactgggacaagaagctgcaagtggcatggaagaaggcgaggccggccccgacgacgccggaggaagccggccgcctcgtggtgctgacgctcaagaaccaccagaaggcggacgtcgacggcctcctcgccttctacggcctcccgcacccgaacgaggcgggatcggcgccaccgccggccgccggtcaccacgctcctccggcccagcacagcgcccccgcgcacaagccccagggcgtcaagttcgagctgcacacgctcccggtggacgccaaggcggtggccgacggcgacacggtgacggtgtacgtggacacgaatgacgcccccagcgagatcaagaaggccgcggcggagcgcaccaaggcgcgcgc

SEQ ID NO: 63349 - DNA, 325 bp, Triticum aestivum
  Clone ID: PAT_TA_63349
attgtccacgcgtccgcccacgcgtccgggccctcggcgtggaggtttctccctcggccgagtcccctcccctccccttcctcgccgatctccgccgccgccgccgccgccgccgaggggaagccatccatggctctccgccgcgccatcgggtccctcgccgtccgctcgcaggcatcatactgcctccgccgcgccgccgcctcgccccccaccctcacgcctcctgcgcccccgcctacgtccttccgccgcccggtcatcgtcccacgccgctccttcgccgccccgccccagcacgtcaagaaggtggccaagcacgacg

SEQ ID NO: 63350 - DNA, 337 bp, Triticum aestivum
  Clone ID: PAT_TA_63350
ttgtacatctttgatggacttcacatggagagggggggtttggaaccaaaacaactccagcttgctaaccagctgcaagagtcgctagtacataagaggtgcttaattgtcgttgatgatatatgggataaggaaacatggaccttgattgaaaatgtttttgaggatagtgctggaagtaaaatcatcaccacgactcgtaaccgcaaatttgccgaagaatttggtggcatctacgagatgaaaccactatgcacagatgactccagaaagttactccgcaccaaagctaaagttaaaggccatgatactgaatttgatatattgtcagataaaa

SEQ ID NO: 63351 - DNA, 388 bp, Triticum aestivum
  Clone ID: PAT_TA_63351
ttgtactactacaacagcaacccttattatgtgccaactgtcccaacacatgatgcaatcactactactgagaccataaaccctgaagtagatttgtgggatgatggctccaactaccatgttatctgtgatcttccagaagttgctaaacataatctacatttacactgcactaaccaaaaattgattatttttgccgaaatcgaatcaaccaatgagtacaatcccatcacaaaccgcattcgcgaaagaagacacaaaagatatcgcagaagagtccgtcttccttcccaagttgacgaaacgaaaattgatgcaaaattggaaggtggggttttgaaggttgttttgccaaaaactaaggaacatcagggtgaaaataaacaaa

SEQ ID NO: 63352 - DNA, 444 bp, Triticum aestivum
  Clone ID: PAT_TA_63352
tgtggacgcgtgggttcaccaatatgttcccctgctttatttggacatccaaacattctgcaaagtctaatgtaatacagtgcaccatacccaacctccatgccagccttattatttgcatctatgtaatgaataagttgcagtatttatttatctcaagggaaaatggcattgcaaagatttttgctaccttctctcttgatctcagaagtaccatgtagtattgggcagcttcaaagctacaaagttttagtatatttgtgccacagaatatcgaaagccatacagttttggtctgtgtagtctcataaagagatccatttacgtgttcaatgcctaacacattccgtcttgtttgaatgtttgtactattcttataacccaatgaaagttgcatttttcccatcatgtcagctagaagggaaaatttattggtagtttgaa

SEQ ID NO: 63353 - DNA, 372 bp, Triticum aestivum
  Clone ID: PAT_TA_63353
ttgtcgcgtgggcggacgcgtgggcggacgcgtgggcggacgcgtgggcaaatcacaccaaccccccaaaacctccccgcatctcgcgcctctccgccgccgccgccgccgccgaggacaccgagcttctcccccgcccgatcgccatggccgccccgacggccttcgccgccgccaggttcctcccctccgcccacctcgactcctccgcgcgactcgccccgctcgccgcgattcgccccagcctttggagggaagaccggtcctgcctagagtggcttcgtggcagggagccccgttctgtggtgtacgtcaacttcgggagcatcactaccatgaccggccaagagctggtggagttcgcttgggggt

SEQ ID NO: 63354 - DNA, 383 bp, Triticum aestivum
  Clone ID: PAT_TA_63354
ttgttgaaaccagaataggtaccaacattgagaatactgatgtcccttcagtttcgcagcctgatatactgatgcaaggtgctctagatgtgtctggtcttcagtataacccgccatcagtttcggatcatgtgtatccgaacacaacacagccaagtataatggagagccaacaaggaaacgctcaagcacaacatctttcccatttttcaagcttgctggcacagcaagctaacactctgcaaagcaacttcttggggtcaaatcttacccagcaccgggattttgacttttcaccatttttatcagcacagtcagctatgaaatataacccagctgtgccaactaccagttacccaatctccatgcaggagaatttaaac

SEQ ID NO: 63355 - DNA, 360 bp, Triticum aestivum
  Clone ID: PAT_TA_63355
atcgtggacgcgtgggcggccgcccacggtctggggcgatttaaacgcaccgcttgcttgtgtccgaactaagccccaatcccgtcaccaccgccgctggtgctcggcgcgatggcgcagaaggacgccgccaatggcaacggcgccaccacgcgcccgccgcccactccctcccccatccgcttctccaagttcttccaggccaacatgcggatcctgggcaccggcggagctggcttcatcggctcgcacctcgtcgacaagctcatggagaacgagaagaacgagggcattgttgctgacaactttttcactggggcaaaagacaacctgaagaagtggatcggacacccaagattt

SEQ ID NO: 63356 - DNA, 416 bp, Triticum aestivum
  Clone ID: PAT_TA_63356
tttggacgcgtgggtcgtgctgctgtccagcatccggcaccggcatgtggtgtcgctaatcgggtactgcaacgagcaggcggagatgatacttgtgtacgagtacatgcagagaggctcgctgcgacaacacctgtacggctccggcgagccggcactgccggcactgtcgtggaagcagcggctggagatctgcatcggggtggcgatgggcgtgcactacctgcacgcaggctgctcggagaacatcatccaccgcgacatcaagtcgaccaacatcctcctgggcgacagcaaccgcggcatgatagccaaggtagccgacttcgggctgtcgctcaccgggccgtcgttcgggcacacgcacgtgagcacgattgtgaaggggagcttcgggtacctggacccggagtact

SEQ ID NO: 63357 - DNA, 250 bp, Triticum aestivum
  Clone ID: PAT_TA_63357
ttcttgacccccgcactcaacctcgccggaggctgcgatccgatgtacggcaacggcaacgtcttcagctccgacatcacgacgtgccagtccaacggcgttgaggtgctcctctctctcggcggtggcgccggcagctacggactatcctccaccgaggacgcgcagagcgttgccacctacctgtgggacaacttcctcgggggcagcgcgtcgcaccgcccgctcggcgacgccgccctggacggca

SEQ ID NO: 63358 - DNA, 363 bp, Triticum aestivum
  Clone ID: PAT_TA_63358
ttgttaccggtgcggcgagccgcgtggccgggggctctgaggccactttcgccaaagccggtatcgccgccgatacggccaattatgtggtggaacgtgttggcagcttcacgctgtacaacccgaagtcgacgcgtcgttggggcggcggttccaccaatctgtgcggcggatcgcgcgcgattcagtccaaagcgccgagcggtttgggtttctaccgcgaagtcgacttcaccgctccggccggttacgtcgagttccgcggctaagcgttgcgctgaacagtgctcaacaactgccgcagccgaaggcaaatcccagagcgccaacggccaaaccgccggcgcagtaaacagcggcgaa

SEQ ID NO: 63359 - DNA, 387 bp, Triticum aestivum
  Clone ID: PAT_TA_63359
taaagtgaagaactggaaaatgtctgcatacaagaaatttgaggagctggagaactcagggggtcttatccctgattatttcctgagtaacggccaccttgtcccagcagcgcctcccaacaatggtgccagtacttccaaaaatcaaactactgcagaatttggtgagcaacaaccatttctgcaggagagtggattcccactggcacagatctttgcaaaaaatgttgctgctccttcgaatcaagaaggaccaccatttacacagtgcagttacgaacaggttgcacatcaagaactatatcagcaggatccttctatactgtgtaatggaattcctccctatttgacccatggaaacatcaatggtcaggggatcattctcag

SEQ ID NO: 63360 - DNA, 432 bp, Triticum aestivum
  Clone ID: PAT_TA_63360
tttttagcaatccgccccaaatcggcgaccgcacgcacgccgtcgcggccatggcgaccgccaccgcttcctccccgtccccctttggcttcggggccactggtttcgggttctctcagcccgcggccacctcgtccgcctctcccctcttcggcgcacccgccacctccgccgcagcaaccacgcctagcatattcggggccgccacgaccacgcccagccccttcggcgcaccggccacctcgtctgcggccaccaccccgagcctcttcggcgccgtctcctcccccgcggccacaccaggtctcttcggtgcgaccaccgccgccgccagcacccccagtattttcggcgcttcttccgctgcgtccactccaggtcttttctctggcgccgccacgggcttcggcttcggctcatcggcatcaggct

SEQ ID NO: 63361 - DNA, 221 bp, Triticum aestivum
  Clone ID: PAT_TA_63361
ttgacgcgtgggctgagcccgagtcatggacctctctcgccgctgacggcgacgacgacgatgaagaggagctggcccctatgacaccgcctgctgccaaggcctcggccccggccgctgctctgccggacgtggtggtgaaggcgagcaagggatggcaggaggtgttgccccggcgtggtccgcgtcgcccgacgtcgctagcccctgcaatggctccc

SEQ ID NO: 63362 - DNA, 309 bp, Triticum aestivum
  Clone ID: PAT_TA_63362
tttcacgcgtccgctttatggtaatcttaaaagaatatgcgagacaaatcttggattgatctctcaatgctgtctcacgaaacatgttaaaaagacgacaccacagtatctcgcaaacgtcgcccttaaaatcaatgttaaggtgggagggagaaatactgtacttgttgatgctttgtcaaggagaattccccttgttagtgacagaccaaccattatatttggtgctgatgttacccatcctcatcctggagaagattctagcccttccatcgcagctattggcccgaggtcaccaagtatgctgga

SEQ ID NO: 63363 - DNA, 461 bp, Triticum aestivum
  Clone ID: PAT_TA_63363
tgtgccattttccgcagcatggcaatattaggtgtcgatggcttctcatcgctaccaaagaactgccttactctctgctacatattctttgttggagcaatcgttgtcaacttgataagagatcttgttcccaagaaggtatcaaacttcataccaatcccaatggcgatggcaatcccattctacataggatcgtatttcgccatcgacatgttcatcgggacagtgatcctttttgtctggcaaaggctggacagagccaaatcggaaacatttgcacctgcagttgcttccggcttgatttgcggcgatggactgtgggttctgcctcagtcggtgcttgctcttgccaaggtgaaacctccaatctgcatgaagtttctgtcaagagggatgaacgacaaggtggatgcttttatcacaacattatcgtagaatcttagggaaaaggagaagttaca

SEQ ID NO: 63364 - DNA, 219 bp, Triticum aestivum
  Clone ID: PAT_TA_63364
tttcagaacttgtgcttatccgtctctgtactgcacgtctgtttgtggggtcctcctggcaaacatgtcgagcgcttcgggacgggcggtttgacgagcaatgagatcgagcgctggtggggaggtatctcacggtaatggtgggcgtggcggagcggcgctggatttcgatggcatggagttcctactagagccagttgaccggttcccactcaggga

SEQ ID NO: 63365 - DNA, 291 bp, Triticum aestivum
  Clone ID: PAT_TA_63365
tgggacaggttgggacagttcgaagggagttattgtcatggacaatgagtggtggaagaaggcgagaaaggacattcctggatgtggcaagtttagaaaaaagcctcttcaaaatctggagcatctttccaaaatggttggtgatattttgaatgatgaacaagatcattggaatcccatgagtgacaaccccatcatacccccaagtcaagagaattttgttgatgttgataatgttgttggagttggagagaaagaaggttcatgacatccctgatgatattggtaatg

SEQ ID NO: 63366 - DNA, 451 bp, Triticum aestivum
  Clone ID: PAT_TA_63366
gtagaagtcaagtgatgagagcagcaaggagattgtctcaagtcagccagagggaagcagtcccccggagccagagaaagcttctgacagcaatagtgacggaagctcatctccgggcaagaaaacaagtggaagcaaactttcagcctcagcacctccattcaaacctggatcgctcttatcggtgtcccatccttacagcacagtggcaatatatgatgctagcgttgtgcttcagccaatcccaagtcaagcaatggagattctccctcatgctgtcgatacttagagtacctccgtggtcctcggtccaccttgtactatcgtactggacattctttccaaaggaaacagggttatacacagagccagagcactattctgaggggcagcacctcccctccaaccatgaacccccatgctgctgagtttgtgcctggaaaaactgtgc

SEQ ID NO: 63367 - DNA, 376 bp, Triticum aestivum
  unsure (1)..(376): unsure at all n locations
  Clone ID: PAT_TA_63367
tttggatcccggcgctgccccgccccgcccccacctcctctctcgctcccggcgccccgctgcttccacgcgccaccgccggccccctgcttccacgcgccgccggcggccccgctgcttctagccgccactgtcgggagccaccatagcgccaccaatcgccacgaccagtcgtccctaccgccgccttggcgacctacccccaccccccgcagggggccatcgcttcgtgtcaccgcatccggtggccacagcgtgccgtccaactcggcagtccaactgcttgctccacggntcggtcgctcaagtagctgcgtgcaggcaaacatctccacgggcgacaagttcttctttcacaacttgttgctgctgctgc

SEQ ID NO: 63368 - DNA, 149 bp, Triticum aestivum
  Clone ID: PAT_TA_63368
ttttgggccgtgcgatcacttacgacatgggctgaaggaggacctacgccgcgcttgtctactactcattctacaacgccacggagttcgcgaagactgcgtctgctaattaggtctagggcgaggatgctagatggaactgcaaactt

SEQ ID NO: 63369 - DNA, 212 bp, Triticum aestivum
  Clone ID: PAT_TA_63369
tcgcacccagctctgccccgccccagcgcgtcgccacccggcgccgccccaaacctcacccaggcgggaagggagcggcacatcgagccgcatctccccccaaaccgcgcccgcgacgagaggagctcctgcatcccgccggtgccgcctcaccctcccccggtcgccgccctccggtgccgcgccaaggaaaggtttattacctgcaggaa

SEQ ID NO: 63370 - DNA, 366 bp, Triticum aestivum
  Clone ID: PAT_TA_63370
tgtctccctgctgctcctctctccagttcgtcttcctccttcggatcgagaccttggagcctgctccatggatctgttcatggagccgaatggcgactcggaacagaggattagccatgggcagacgggggatactggtgctgcgcggcctatagagtcccaggcttctattagcgtcgccgagggtgacattcgccgtgtcggagacctctgtagcggcggcggaaatgcgtgatttgttggcgaggacccgctctgcaagtgtgttcggaggctacgagcggatggacacacatagtaagggatcaggaaagcccctccggagcgcgagttcaaccataaccggaaaagtgcgcttgaactatc

SEQ ID NO: 63371 - DNA, 170 bp, Triticum aestivum
  Clone ID: PAT_TA_63371
cgcacgcacgcacgcacacagccgccaccaccccccaccggcccacctcgcgcccgctttgccctgctctgcgcgcacgcgcactagcccatcgctcctcacagccgcgcctactgccgtgctgaccatgaaccgcccgacgccggcgcaccacaggggcatgccgccgc

SEQ ID NO: 63372 - DNA, 351 bp, Triticum aestivum
  Clone ID: PAT_TA_63372
tgcggacgcgtgggtcggaacgtggcctctgggcaggtgttgttcacgtcggaccagacactgatggacgagacgccgacgaccggcaacaagacagcggtcatggtagccgacaacgccgccaatcctatcacgtggatggtcaagttcgcggtggccatggtgaagatgggaggcatccaggtgctcaccgggaccgaccccggcgaagtaaggaaggtctgcttcgccaccaacaacgcgagctagaatccgtggagctgcatgtacgatgactaaacaaaagtgcacctgggcagctagagccggtgctcttagttggtttaatcctttttgttttggtttcattct

SEQ ID NO: 63373 - DNA, 339 bp, Triticum aestivum
  Clone ID: PAT_TA_63373
tccacgcgtccgggttgattggcagcggcggtggctgaaggtgaggcgctgctggagacagctgctgctacactggaggatgcgatgggtcggtgagggaggtaggttgaggacccatgatgccgacgccggcagccagtggaacactggtcagtggacgggtctcgtaagccgccatccttgttgacatatcatggagttgttcctggagggttgcaagttgctcttgatgcagcgcccatattttggtgtcaggaagcgtgaactgatactcggtggtaggttcggcaccagacatggaatctgataccaaattggaacaacccctgggtctgatgg

SEQ ID NO: 63374 - DNA, 290 bp, Triticum aestivum
  Clone ID: PAT_TA_63374
tgtgtaaccccgccttcgccatcgtcaacaaggccactggtctcgccgtcaagcactccctcggccagtcccacccggtgaagctcgtgccattcaacccggagtacctcgacgagtccgtgatgtggacggagagcggcgacgtcggcaagggcttccgctgcattcgcatggtgaacaacaatccgcctcaactttgacgccctcaacggcgacaaggaccacggcggcgtgcacgacggcaccaccgtcgtcctctgggagtgggccaagggcgacaaccagagctg

SEQ ID NO: 63375 - DNA, 140 bp, Triticum aestivum
  Clone ID: PAT_TA_63375
tggacgcgtgggtttggttcgggcttcgggggaaaggtaaggccggggcggggaggaaggcccacaagccaatttgggattctttttcttcccttcaggcccgggattccggcccttggcggctggccgaacgggctggt

SEQ ID NO: 63376 - DNA, 364 bp, Triticum aestivum
  Clone ID: PAT_TA_63376
gccgcctgctccggggctcccaccgcggacaccattgcagacaccagctgcgcggccgaggcgattgtttgcacgacgtccatggcttcgcctcagggcaccaacacaactcctgatagagtcgaatcaccacaccgacgaagccttttcttgcaagaattcaagaatcagttccctgctgtcgcaattccacaaacaaatggcatgcatgctcccggtcgcaggtacgggtagcaaaatccccctttctatcaacctgggtatcagacctaccgatcatccgcttcaacccagaaatcatccgtccaaagccaaaccccaatcgtcagtccgaatttccaaaaccgcagcacgaatcgtgaca

SEQ ID NO: 63377 - DNA, 210 bp, Triticum aestivum
  Clone ID: PAT_TA_63377
ctccccaaccagcgaggaagaggaagaggaagcggatcgagccggcgagagcgagggcgaggacgatggcggcgctccggctagcggggaggagattttgcgaccgcgcgctcgggagatcagcgggcattcacgagctcaaggctgccaaggaattccccgacattgatcctgggcatctcaaggctgccaggaaacaccccaaacttc

SEQ ID NO: 63378 - DNA, 244 bp, Triticum aestivum
  Clone ID: PAT_TA_63378
gggcgctcctccccgcctccggcagcggcggcgccggcggcggggagcgcttgagcatcgacgacgcgctggcgctgcacgcgggggagttcgggcggtggcagctgtggcacttcctgctggtgacggcggcgtggacgctggaggcgatgcacaccatggtgatgatcttcgccgaccgcgagccggccatgtggtgccccgcgggggaccgggcggtgccgcgaccgctgcgccggcgccg

SEQ ID NO: 63379 - DNA, 167 bp, Triticum aestivum
  Clone ID: PAT_TA_63379
tcaacgtttcttaagagagctgcagttcgattcaggccacaattggtcaagactgtcactgccaactatagtaccaggaaacctctgctgtggcgcctattcaccttcaaaccttatcctgaatctaactggagatcttttaaggtgcgttgggatgagccgtcaac

SEQ ID NO: 63380 - DNA, 305 bp, Triticum aestivum
  unsure (1)..(305): unsure at all n locations
  Clone ID: PAT_TA_63380
tccacgtgtccggctcccctacccacacccagacacaacaccacattggcgccgccacccaacgccccatctcccttggaggctcggaccttgccgccgngcccccccccccccccctacccaccccttgagcgaggaggaggtcggtaggcatccccagatctgttaagggattcgaactggagctctcgatcgctcacgcgccgggcacaacctccgtctgctcttattgctcgccggcgacgcgagcatggagcttcctccgtgctcgcttgggctcgggacaccgctgctagtcaagacac

SEQ ID NO: 63381 - DNA, 411 bp, Triticum aestivum
  Clone ID: PAT_TA_63381
gtgaatgtgctaatggagtcaaagggtggcaaaaagtctagcagtagtagttccctgatgtacgaagcacgcctcggctacagcattgaagaccttcgacctgctggaggcgccaagaagttctctgctgcatactcgaactgcgcgaagaagccatcctgatatcgtttttggcatccccttctcgtagtttaggattgttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttcttcgaggcatcaatcttt

SEQ ID NO: 63382 - DNA, 330 bp, Triticum aestivum
  Clone ID: PAT_TA_63382
ttgcaaggaaaaggagcgcggcttcatcgtcaagaaggaggaggcggcgaacgggacaccgacgtccggcaatggccgccggggccgcaagtacaggtacgaggaggacgacctggacgcggagaccgccaggagcagcaagctgatgatgccggacagcgaggagaccggcgcgcgcgagatgttcgacgaaataatgctggaggggtacgagacgtgcatgcgagggatagaggagctgcgcctcgccatggacagcgaggccaagaagaagaacgggaaggcggcgcgcgcgaagaaaagcgaggttgtcgacctgcgcaccatgct

SEQ ID NO: 63383 - DNA, 380 bp, Triticum aestivum
  Clone ID: PAT_TA_63383
tccacgcgtccgcccacgcgtccgcccacgcgtccgcccacgcgtccgctccagcacacaagcaccccagctgagctcgaagagcaatggcggaagcaggggaatggctgccgtgcgtctccacgctggcgtcctgcctcctcggcttcgcgctctacttctacgcgccctactggggagtccgcggcgtgccgggccctccggcgctgccggtcgtcggccacctgccgctgctcgccctccacggccccgacgtcttcggcgccctcgccaggaaatacggccccgtcttcaggttccatctggggaggcagactctgggtgatcgtggccgacccggaactgtgcaggaggtcggggtccggcagttcaagagcatc

SEQ ID NO: 63384 - DNA, 172 bp, Triticum aestivum
  Clone ID: PAT_TA_63384
cccacgtttccgcgaattctgtacattaggttgtcctttttcatttgttacaagcagctatatgtcatgttagattcgtttgagtgagtaatggaacttttaggtctacttggcatgccactgcaacttactgttaactcttactgcagttatatttcatgttagattggac

SEQ ID NO: 63385 - DNA, 340 bp, Triticum aestivum
  Clone ID: PAT_TA_63385
tcgaccttcgagccccccttctccacctcgtcactgtggtcacctagcttgagctcgagcgaaggagcgactcggcaggacgccggggggcaggggcagcagccagccgcgcctggccccgtgctctgcaggcgcccatcggcctcgacccggccgacggcaggaggagctcgagccgaagccgaggagcggggccttgatccggacttgactgcctactggagcagctggagagaagtggtggatccgacggggctggaatccctcatcaccgggcgtggaggatgtatgactcgcgaaggaggtagcagattgagcaaaatggagtggcctttcccat

SEQ ID NO: 63386 - DNA, 361 bp, Triticum aestivum
  Clone ID: PAT_TA_63386
ttgcaaatcaccgggtggttctattgtatgatgtccagacgcataatgttgatatgcagcttcctgataactccagcctgccaggttcaggccggggtgtacaacccattatacatttcagtccttcagatgatatgttgctgtggaacggggtcctgtgggatagacgaagtcccactcctatccatcagtttgaccagttcacagactattgtggcggtggctttcatccagctggaaacgaggtgattctaaattcagaggtgtgggatctgagaaagtttaagcttctgaggagtgtcccatccctggaccagacagtaatcaaattcaatggaggggtgatgttatctatgctatc

SEQ ID NO: 63387 - DNA, 398 bp, Triticum aestivum
  Clone ID: PAT_TA_63387
ttcccacgcgtccgctcctgcagtggatcaggtcattgaccaccgcccgatgcggcgtcggactagcggatccacgctgctcctccacctcccgaccaatgcccccggcccgtcctgctgctcacctcctcctcacatatgcatcaacaaaacatggcagccgctgcagtccacatcgttcaacagtagcaggtcaactcctccaaggtcacacaagctcgccgccaaaagcccacggtctattgagccagagatggcactggacgctgccgtggccggtcatctggatcggagccaccaacccacgtccgatagaggggggctggtagcagccccgttgaggggattgggcactatctgcagctacaagtggcatcgacctgcagctgcgggagcgt

SEQ ID NO: 63388 - DNA, 325 bp, Triticum aestivum
  Clone ID: PAT_TA_63388
gccagtttcacaaagattctgctcatcatgcacctcattgctttcatcgccctcacaatctttcttggagtccaggcttcttcccacccgaatcctacctacaagcccttcgcccacttcattccgctcgcctcttctgtgatattatctattatcgctgcctgcttttggactatccttgctgtcactaatcctgcaaaagccatcaaaacatctctctggacagctcctgtttccgcacttggctgcgatgtagtcatactccttgtcggtgacggcgaagcccttggcatcggagtgctcatagtgtgatcgccattgcagc

SEQ ID NO: 63389 - DNA, 262 bp, Triticum aestivum
  Clone ID: PAT_TA_63389
tgtcctcacaaggccacgggcagtgcgctggcctggagatgccttatcctgaggaacagactgaaaggtgctttcacctaccgtgaacagcaatacaatgcttatgcagagttatatcatggttgatggaaaggggcgcactgacaagacctaccctgctgggttcatggacatcattgccatgcccaagactggtgagaactacaggcttctttatgacaccaagggtggcttccgccttaactatacaagggatgaggat

SEQ ID NO: 63390 - DNA, 443 bp, Triticum aestivum
  Clone ID: PAT_TA_63390
tttacactgcccagattctgatgagaagcttgatggtaaaggaaggaactttttacatattgctgttgagtataagaaatggaaagttgtttggcatttctgtggtaccccagagctggaaagaatggtgaatgtcatggattatgaagggaatacagctctgcatcttgcagtcaagaatgcagaccagatgatagtgagccttctgatggcaaataaaaatgtactgccaaatatagtgaacaacaagggcctcactgccttagatcttgcggtactggcaactgacaaagggatgagttatacactgaatccacaggtcattatacttcgctgtttagcatggacaggagctgtccttactccgcgtcgcctggatcatttcatagatgagttccacattgggaaagcctctgggaacgagctaaagaaattcagcaaca

SEQ ID NO: 63391 - DNA, 415 bp, Triticum aestivum
  Clone ID: PAT_TA_63391
tatctcgtttctctcttcgcagcaaggattccccaagccgcaccagtgcccctctcaagttaatacacaacttgtggctccctcgcgtttcttaaatcatcagaaatggccatgccaagcctcatactaccgaaggaactaccatatgaatttttgaagaaaatcacggatgacttctcagatgaccgtaaaattagtgatagtccatttggaatactttataagggaattaatccagatgatggcaaagtgattgctgtgaagaaacttcaggaaaacgcaccgatgccacctaacaaagcatttgcgcaagaggttcagaatgttatggcgctcaaacatgataacatagtacagttggttggattctgcagtgaaacaacaaagagattggtgcagtttgataaaagatata

SEQ ID NO: 63392 - DNA, 321 bp, Triticum aestivum
  Clone ID: PAT_TA_63392
ttggacgcgtgggccgccgccggcgctttcccatccccatccccaactagtgagcgtgaacccgatgtgaggcgcgcgaaatccctccgccatggagcatagtgacggcgagaccgccgctaagcgagccaagctctcctccagcggcagcgaggacctcctcagcgcgctatccgacgacgttctcattcacatccttctcaggctccgcaacaccgccgtcgccgctcggaccagcgtcctctccagccgctggcgccgcctctgggcccttctcccgggcctggactttctccccgacaccaacccatacagcatacc

SEQ ID NO: 63393 - DNA, 288 bp, Triticum aestivum
  Clone ID: PAT_TA_63393
tgccacttagctatatatctacacgtgcacatatatacctacgcacggttccatttcggttgatgagctgagagcctgagactcgaccgaatctaggcgcctagatcgaagtgatcgagcatcacttgggcgcgcgctcgcaatggacagcagcagctggatccatggatactacggccccagcagcggcgccggcggcggtaacagcggcttcatgtgcggttacgccgacagctgcgtcgttctcgaagagctgcacaacaggaaggaggaagaggagcgcacgca

SEQ ID NO: 63394 - DNA, 196 bp, Triticum aestivum
  Clone ID: PAT_TA_63394
ttcgtctttggacgcgtgggttgtttttttttttttttttttttttttttttttttttttttttttttttttttttttttttttcaggaaaaactccaagggttttcatatgcatttatggggaactaaatcactcaaccgaaaaattttcatgaccgaaaaacaaaggaggcagtggtatatttgctccctggat

SEQ ID NO: 63395 - DNA, 243 bp, Triticum aestivum
  Clone ID: PAT_TA_63395
ttgacttgccttcgccgtcaccttcctccgcacgcgtttccaatccaagctagctagccaccgccgaggcgacccgcggtagctatataaagccgcggcgtcgccggcaagccgcaaacccaaaccaaccaccgcaaacatccatcgcgttcccggccacttctacaacctgctttgcttccgcggcgcgatcttgttttagctcggcctccatccccgcttggctccttgcgcaacagcttc

SEQ ID NO: 63396 - DNA, 205 bp, Triticum aestivum
  Clone ID: PAT_TA_63396
ttcggactcgtgggcggacgcgtgggtcggttgccgtcaccaagttccttgacgatttggccaagattgatttccccggtgccaagctggtgagcgacgcggtggccaagtccggcaccacgcccctctccccggccatcgtcttcatcttggacaaggttgcgcctttcgtccccgcgcccaaggaggagcccaaggccgagcc

SEQ ID NO: 63397 - DNA, 456 bp, Triticum aestivum
  Clone ID: PAT_TA_63397
tttgagagcgttggagacattccagatgctgaggtcaaaccaccagataatgtcttatttgtttgcaagctcaacccagtgacacaggatgaagatttatatacaatcttctcgcgttttggaagtgtgacatcagctgaaataattcgtgacttcaagactggggatagtttatgctatgctttcattgaattcgaggaaaaggaggcatgcgaacgtgcatattttaagatggataattgtctgattgatgatcggaggatccatgttgattttagccaaagtgtttcaaaattgtggggtcagttcagacaaagtaaacgaaatggaaataaagatggttgcttcaagtgtggtgctccagatcacatagcccgagattgtgaccaggatggtgagcagaaacctaaagccccaaattatgttctgaaagatgataacactcaacgaggcggg

SEQ ID NO: 63398 - DNA, 491 bp, Triticum aestivum
  Clone ID: PAT_TA_63398
tgtttccttggacgcgtgggctcgccgagaaatctcctccgatcgaagcgaagccaaggctctctcgtcctcctccccaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggtgctcaggctccgtggtggcatgcagatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacat

SEQ ID NO: 63399 - DNA, 263 bp, Triticum aestivum
  Clone ID: PAT_TA_63399
ttccactcgtccgaattgtgcaacgaaagagcacttgttctgccgtggctgcatcgaaacctggctgaaacaaggacatcaccagtgccccttggatcgaaaagaactcaaagttgacgatttggtgctgaacgaattcgttcggcattccatctttgcgcaacgcaccacatgcacacacgttccgctctgcgactgggttggtgtcattggaagactggatgaacacctcggctccacatgtcccctgcagaaaattgtct

SEQ ID NO: 63400 - DNA, 377 bp, Triticum aestivum
  Clone ID: PAT_TA_63400
tccacgcgtccgaagataagctatatacagagtggagaggtcacacaccagagctagatacagagaagcaacaccatgcgcgctccggcgagcctcctgcaccgcgtcgctctcgccaagactggtccgggcgagccatcgtcgtcgccgatgagtatgaaggctcctgagaaccagcagacggctcctgtgatggcagtgaactcagacatggtgctcatcctagcgtcgttgctatgtgcgctcgtctgcgtccttggcctcgccctagtctcccggtgcacaggccgacgccgccgctcgccctcattcttcgaccacgctcctccagccccaaagggcctcaagaagaaggccatacacgcgctccaaccgtc

SEQ ID NO: 63401 - DNA, 406 bp, Triticum aestivum
  Clone ID: PAT_TA_63401
tcacgcgtccgtcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaagctca

SEQ ID NO: 63402 - DNA, 393 bp, Triticum aestivum
  Clone ID: PAT_TA_63402
tcttaaagttgcacattgcaaactgcagatctcttacatctgttggacaaggacaaccaccaattagggcattcaaatcccttacattcctaatcattgacaattgtgagaacctggcaacccttgatggtcttctaacagaactatgtttgcctgccattcgaaagattgatgttaggaattgtggcaagttacagttcctttttggtgaaaggcctgggagttttccttcccttgaagatctgttgcttcatgattgccctagcctcaaatggccaagggaattagtgttaccatcatccctaaaaaagctccacttagttcgatgtggggatatttcctcctggttttcaagctgtctacagaacctcaaatctttggctgaactggctt

SEQ ID NO: 63403 - DNA, 433 bp, Triticum aestivum
  Clone ID: PAT_TA_63403
ttcttacaccactgtagatcagagctacaaagcaattacataccggtgttgtctttgtggtgcctcttcaaattctttccacttgttgcccactgacgaagttgtaccgagcagaggaaaagctgacctggacgattctagcttgaacatggataatgaggtttgcttcacaattttgcaaacattgattcttttactaagtttatcaacaagtcgatatagaatcagtaactgcagttctggaactatttacaggaatgtgcggctgcttttgtatttttcaaaactcggtatggagcacttgttgcgtcagacgttcttcagacatcgaaccctaccaagtgggttactgatccagctccagaaccaaatgatgtgtattggtcaaacatttggcttccctacaagcagctttggattcgaaggatagcga

SEQ ID NO: 63404 - DNA, 337 bp, Triticum aestivum
  Clone ID: PAT_TA_63404
ttctctttgctcacttgacaaggattcatgaaacgacgtcaggtttaggtcaggttgagaaaggagcacggcagcaacatgtaaaagcctttcgaagttgtgaatgagagaagagcaagcacctatgtcggcgaggagatcctcgtcgcggccgtggcagggcgtctgtgcagctgcacctgtcttgggaacagcacgtcgtcgtggccgtcgtcgagtgactcggcgacctcgtcgtcgcggccgtagtcggatgcctcggcggctgcgcagggcggcgacgtcgcggccgtcgtcggtgcggccgtcgtcagatgcctcggcggctgcgcatggc

SEQ ID NO: 63405 - DNA, 393 bp, Triticum aestivum
  Clone ID: PAT_TA_63405
ttcttcttgttatgctccccccggtcaacgcctttgcctgctgagcctgggaatgattgatccgctcatgatctacaagacgagaagcaagcccagttttgctcctagctagctgctttctcctcctcctccaatctccagcaacgaatgaaggagaagctggcaaccatattcatatccataatccatatctatatgcgagctattgcttgctagaaagcttcttgctcgcatactcggaaatgggcggatacgagttccagagggcggagctagatgcactggaagggcgtcgtacgcgatccaactgcggagccaatgagtctgacgttgccgcttctcaggcacataacaaatgatttctcccctgaatttgaaattagtaaagatgat

SEQ ID NO: 63406 - DNA, 346 bp, Triticum aestivum
  Clone ID: PAT_TA_63406
ttgttaacgcgcgtgagctcacactcaccgaacacacaaatggggcgcgccaccacctgcctggccaccttgttgctcgccgtcacctttctgtttgcctccgccgccacgaagtcgcttacggccatgcagacggaccaggcggggactaagagcgggtccaccctgccggcgcactgctgcaaacaggaggagaaagcggtggccaagcctcagcttgttgttggcgatctagtggacttggcatcagcggaggagcaaggccagaagcctagccctcaccggagtaacaaaaagaagatccaccaccaccaccatgacgacgacgacgacgatgatgatggtg

SEQ ID NO: 63407 - DNA, 412 bp, Triticum aestivum
  Clone ID: PAT_TA_63407
tttgctcggcatcgcctcgacgaacctgcgcaagcctctgccgatccgcgaggtcattgctcgcatcgtcgacgggtcgcacttctccgagttcaagcgcgactacggcacgacactcgtcaccgggttcgccagcatctacggccaccgcgtaggcatcatcgccaacgacggcatcctcttcgggacctcgtcccagaagggcgcccacttcatcgagctctgctcgcagcgcggcatccccctcgtcttcctgcagaacatcagcggattcatggtgggcaaggactctgagcgcgacggcatcgccaagcacggcgccaagctcgtcacggcgttcgcgtgcgccgacgtgcccaagttcaccgtcgtcgtcggcggcagctacggcgccggcaactacggcatgtgc

SEQ ID NO: 63408 - DNA, 337 bp, Triticum aestivum
  Clone ID: PAT_TA_63408
agataatccccataccatagccaaaccattccccgtacactagccacgcactatccatacaatagtcttcgagctttcagcagcagcaacggccgagcgcctgcgcccgcggccccgtggctgctcgtcgtgactcccacccgcggcgccggagccgctgcgccccggccatgtcacggctgcttgctccgcccccagcgcgggtggactgctgcgcccatgtgcagaggccggctgttccgcgcctgtgtcccgcgcgtcgggcctaatcccacgccgtctccgctcccggccggttccacgcctcccaggcgctggctgccggctccacgcacca

SEQ ID NO: 63409 - DNA, 411 bp, Triticum aestivum
  Clone ID: PAT_TA_63409
ttcttctcgcttcgggagactacgaggatgtccacgtccgcctcatgagggcataccctgaggtgtcggagtactggtactttggcgtgctcgtcgtggctgctgctactggcatggccggtatcgatacctacccgacctacactacaatcggcgtcgtgccgtatggcatcatcctagccttgctctttgtggttcctacgggcatcatccgagccatgaccggcgtggaggtcacactcaacgtgctggccgagttcattggtggcatgtgggtccgagggcaatgccctcgccatgaacttcttcaagtcgtttggttatgtaacatgtgcgcatgcactctcgttctccaacgacttgaagctggcccactacctcaagattgcaccacgtcagacttttgccgcg

SEQ ID NO: 63410 - DNA, 441 bp, Triticum aestivum
  Clone ID: PAT_TA_63410
tctttcttctctgttgccccttccgatcctctccgtccctccctccctccccaagaaggaaggccggcggcgccatggcctagacggcgtgggagctcgccgaactattcgtcctccgccccatcctcgtcgtcttcttcgccctctcattcatcctcctgagtacgtacgacgaccgcctccttttttttctttctttcgtctggctggtttccagattgagatccctcgggttggtatgtggcatggaggacggtgctggtgcacgtcccgctcgtgcaggaggtcgccggcctgcgcccgaagaagaagcccgccaagcccaagccccccaaccgcggtcgcatcggcaggttctatcagtcgcaagcacaagcacagaggtgaacgaagcctcttctcatttggaaattggcttgatgccaacaattggcaacatca

SEQ ID NO: 63411 - DNA, 475 bp, Triticum aestivum
  Clone ID: PAT_TA_63411
tcactttcacctcttttttctttctagtttatcctaatgtcaaagcaacaagataaacctgctttgaaacctgctgttttcactactgttgatcagttgagaccaggaaccaatggtcataacttgaatgtaaaggtagtgagttgtacgatcgtgattgaaaagcaacgagctgatggaacaaagatcagagtagctgaggctgtcattggagaccaaactggagttgtcactcttactgcaagaaatgcacaaattgatgtagttgtcccaggtagtacagttgtacttcgaaatgccaaagtagatatgtttaatggttttatgagactagcagttgataaatggggtttagtgaaagctgctccagaacccgctaagtttgaagttaacacagaaaatgatctttcaagtatagaatacgaacttgttactgttgatgatgctcaatgattaaacaagacaagaaatcatg

SEQ ID NO: 63412 - DNA, 468 bp, Triticum aestivum
  Clone ID: PAT_TA_63412
ttcttgctctgcccgtccgggcccgtcgtgcgccggccggtacgtgtacatgtacgacctgccgccccggttcaacgccgacctcgcccgcgactgccgcatgctctcggcgtccaccgacatgtgcaggcacgtggtcaacgacgggttcggcccgccgatcaccgacggcggcgcgctccccgagagcggagcctacgccaccgaccaatacatgctggagctgatcttccacgcccggatgtggcagtacgagtgcctcacgcccgaccccgccgccgccgccgcggtctacgtcccgttctacgccgagttcgacctggcgatgcgcatcgacaacagcgacatgtcggcgcggaacgcgctgccgggtgacgttgcggctggctggtgcggcggcccgagtggcgcgcatggggggccgcgaccacttcatgctagccagccggcccacatgggacctgctct

SEQ ID NO: 63413 - DNA, 402 bp, Triticum aestivum
  Clone ID: PAT_TA_63413
tgcacgccagtcgcccttcttccgtgccctcgcctcccccgtcccgtcccaccgcggcggcccccacttcgcctctcccccaccccgcctggccgcacccacctcccggcgaaaaccgcccccgccctcgcccccgcttgggtaagaaacgagagggaggagggtcccgacgaaacccgcccccgcccttgcccgggttcagctcccatggcggctcggcccccaccgcctactccgcctctcccgtcgcctccacgcctccgccggccccggctccggcgccggcgaaggcaaattgcttctacccggcgtctccagatcgatactaagcatggacaagtctgcctgatcccaatcaaaatagtgtgtctgtcaccaagtggacgagaaggagatgcatat

SEQ ID NO: 63414 - DNA, 350 bp, Triticum aestivum
  Clone ID: PAT_TA_63414
tgttttttcctcctcaacccgccgccgcttctcctcctccggaagaaaaacagagagcttcaagttctccggagcgagagagatggcggcgaagggcgatgggccggcgatcggcatcgacctcggcacgacgtactcgtgcgtcggcgtgtggcagcacgacagggtcgaaatcattgccaatgaccagggcaaccgcaccacgccgtcgtacgtggccttcaccgactccgagcgcctcatcggcgacgctgccaagaaccaggtggcgatgaaccccatcaacaccgtcttcgatgccaagcgtctcattggccggagatttaccgattcaactgtccagagtgaca

SEQ ID NO: 63415 - DNA, 421 bp, Triticum aestivum
  Clone ID: PAT_TA_63415
tgtttctcgtccgcagccatggagctcctcttcttttgcacaatagttctcatcctcattgtctcatccgtgtaccttctgggcctcttagccgacggtcgtcgcaacctgcccccaggtcctcgctcgcttccactcgtcggcaacctcctctcactgggcgcccaaccgcaccgctccctcgcgcgcctcgcggagagccacggcccgatcatggcgctccgtctaggcacggtcaccaccgtgctcgcctcctccgcagacgccgcccgcgacatcctccagcgccatgacgccgctttttccgggcgcttcgtcctggacggtcccacgtgtcggcgcactacacgcacccatggtctggctcccggccagcagccccggtggcgcgcgctacgcaaggtgtgtcgggtgagctctc

SEQ ID NO: 63416 - DNA, 385 bp, Triticum aestivum
  unsure (1)..(385): unsure at all n locations
  Clone ID: PAT_TA_63416
tttctttgctctgctgccgtgccaacaagggtaaaaggtaggcgccgcgccacgccatgggcgcccctcgcgcctgaccatgcactccaggctgctcaagaggctcgccaagaggatcatgtgagccgccgcgcgcccgtggaaatgtgggagatggacgcgctgctctactgcgcggtcgtcgcgctggcgcttcactgcgtcggctgtggctgctcggcgatcaaccttgaaggctcagcgctgctcaagttccagtccagggtggaggnaggatccgcatggcgccatggcaggctggagcgcgcgggacgccgaccttgcggttggaacggcatccgctgcgccgatgacagggttgtgatgctgaaccaaaagatctctc

SEQ ID NO: 63417 - DNA, 355 bp, Triticum aestivum
  Clone ID: PAT_TA_63417
tttgctgccgttgtcgacgcgaagccgcaagccgtggagaacaaatgggtgtcgcccaagagcacgctggacgcggcattctgggagtcggagtctgacaccgacgaggcggacgacgagccgtctcacggcgcggccgagaggaggatcagcgcattggcctgccctgcgtcggcgctccccgactgggactccgacgagggatggatcgacgtgctctccgggccaacggaagcagttgccgttcccgccaaggtgacgtgtggcatcatcgtggacgacgcgatcaccagtgaagaggagtcaatcgacccagagtccggtgctctcgacattaccgtggacgtggagtaca

SEQ ID NO: 63418 - DNA, 476 bp, Triticum aestivum
  Clone ID: PAT_TA_63418
tttttcgcgtccgcccacgcgtccgcccacgcgtccgcccacgcgtccgcaaattttaaaaagtttaaagagagatcattgagagcatagagctttatttaataaatttgcagatcgaataagtaaagagaaaaaaagaaatccaaaaaatgtaaatttattttttaaacgtatttgaaaatttgaaaaaatatacctaaaacaaagaaaaaatcctaatatattaaataaattacaaaaatataatcgacatttaaaaaaatttcaaaaattctcaaaaaaaaaaccatatattttattggtaaattgcgctaaatcatatacagataaagaaagtttaatggaacttttaaaagcttcagcaggactaaatccaaaagcaatagcagcatcataaaaaatatggattaaattgccggttcaatatattgaatttttttagtcaaaaggaatgaaaaatagaaattttagaacaa

SEQ ID NO: 63419 - DNA, 309 bp, Triticum aestivum
  Clone ID: PAT_TA_63419
ttcacgcgtccgcccacgcgtccgagcgagtctactcaaaaaagctaaggaaggatggtggagaagccggcgagccaggccgacgtgggcggcgaagtggaggcgcataaggagaggaaggggctgtggtcgccggaggaggacgagcggctgtacacccggatcaccaggcacggcgtgtccacctggagctccgtggcgcagctcgccgggctgcggcggagcggcaagagttgccggttacggtggatgaactacctccgggcggaccttaagaaggagcccatctccaagcgcgaggaggagacc

SEQ ID NO: 63420 - DNA, 394 bp, Triticum aestivum
  Clone ID: PAT_TA_63420
ttcttcacgcgtccgcattcctcctaccacctcggcaccaccagcccaagcagagccatggcgcccaacggagacaacaccgtggccaacgtccacagcggcatcgacagcaccaacaagacgctgctcaagagcgacgccctctacacctacatcctcgacaccaccgtcttcccccgtgagcacgagtgcatgcgcgacctgcgcctcatcaccgacaagcacccatggggctacatgcagtcgtcgtcggacgaggcacagctgctggggatgctgatcaagatggcgggcgccaagaagacgatcgaggttggcgtgttcacgggctactcgctgctggccaccgcgctggcgctcccggaggacggcaagggtggtggccatcgacacc

SEQ ID NO: 63421 - DNA, 350 bp, Triticum aestivum
  Clone ID: PAT_TA_63421
tgcatccgtcgccggccaagaagccgtcgccctccatccccgccacgcacccgcaccggtgccccaactccccgctaggcgtttttacgtcggtgcacgacgcgttcgccgcgcaacgctcgcccccgccggcgccgcacgtcccgttgagccaccagccgagctcggccacgccgaactccagcgtagccgtcccctccgccgtgagcacgaacaccgtggaggtcagcacgtcgtcgcacttttgcttctcgaccttctcccaccgcagaaactggccatgcaccgccgcggtggagtttggcggagcggaagcgacgcacgccacagcggcgggcgaggtgtcgctg

SEQ ID NO: 63422 - DNA, 350 bp, Triticum aestivum
  Clone ID: PAT_TA_63422
ttcctggcggatggcttgtctggcgttgatggcatcctcatcgatcttggcatgtcatccatgcaggttaacaggtcagataggggatttagtgtgctcaatgatggtccacttgacatgcgcatggaccctaaggcaactttaacagcagaagatatcttgaactcttggcctgagcttgaagttgggcgtatcctccgtgattatggggaggaaaacaattggcaatcccttcagaggcgaattgttaaagaacggaaaaagggggtttacactctactagcgagcttgtcaaacttatccaaagaacgtgcaccatttcaagaggacggcaaggctggattaaaact

SEQ ID NO: 63423 - DNA, 329 bp, Triticum aestivum
  Clone ID: PAT_TA_63423
gtgacatcaaaggaggtcaagatttgtggtgcccttggtccttgcatctcccttcacagacaaaacagctcggttagtcataaagaaattggtgagggtgggacaaattattggagaatgagtacattgaacagcaaaacctgtattgctttcttcttccgagctgattgtagccgtgataccgatcccccaactgtcttctttattcagttcatgacaagataccgacatggtgatggtagcaatcgcctaagggtaacgactgttgcgagaagatgggctggacctcgatctccagaaattgctgcagggtttgatcaggaagctgc

SEQ ID NO: 63424 - DNA, 465 bp, Triticum aestivum
  Clone ID: PAT_TA_63424
tctcggacgcgtgggtccacttgctgctgccgcctccatccttctaccgacggcaccggcagcgccccactccggctcgtccccggccccggccctggaagagccccactccgactcgtcgcctgcagcgacccggcctttgtcctgggcctccctcgccgacgaggacaacgaggatgacgaagaagagttggctccgctgacgccgccggcttccaaaagcccggtctctgctgctgacccgactattccatgcgttgggcacgaggaggagacgagtggtggatggcatgaggtactgcctcggcgcggtcggcgctgctaggcgtcaccaacaccggcatttgctcctcgtcccatctctgtctggctccacggtcgatgttgtcgatgcctcgcccctggacatcgtgcggcagtttgcggagatcccttatgatgctcccgttgcttggagaacggaca

SEQ ID NO: 63425 - DNA, 296 bp, Triticum aestivum
  Clone ID: PAT_TA_63425
tttcgcgtccgcccacgcgtccgaccaaaccgaaagcaaagaaaccccgtagtagaatcttacgagccaagcaagcgaccgagctaatggccatggcaccgtcagcatccgccgtctccttctccccccgcccatctacgggaacgactttcgggccccgcgccgcttccgcctctagctccgtgggcgccgggcgggtccgcgcggcgggagcccccgagggaggcaagtggttgggcgccgctgctcggctggtccgggcgggcggactacatcgaggccgcggcaccggcgcc

SEQ ID NO: 63426 - DNA, 368 bp, Triticum aestivum
  Clone ID: PAT_TA_63426
tttatgcgtccgggcttccagaaatccagatccaaatagcgacgacctccggctccgatcttgagagaggaggcagctggacaccctcaacacagaggaggtgatccagcttgtcgacggaattggcgtcggcgacgctaaccagtactgccggtgatgtcgttgacgcccattgatacagcccatgtcgatgccgatcacgagggtgggcgagtatgacgatgaagacaggaagcttaagcgcggtgctcggcccccaggatgccgatgtcatcctagtggccagggtgggcaactgcccgctccggccctcctcgtcctggtgccatggcaacgacgggagaggaggcctgctctgctccgtgtgc

SEQ ID NO: 63427 - DNA, 427 bp, Triticum aestivum
  Clone ID: PAT_TA_63427
ctccaggcggcggccgaaggcaacctccagctcttcaagaggaccgccagcgcgctggacggcgggaagggccgcctcagggacgcggtggaggctgtgacgctccaagggcgaggctccggggcgctgcacttcgccgcgcgccgtgggaggatggcggtgtgtgtgtacctggtccaggagctcggcgtcgacgtcgacgccaccgacgagacaggctatacacctctggttcatgcaattattgctggcactgtggacactttccagtatcttcttgatcacggtgctaatccagataaacccgatggacaagggtctacgcctctccatttggctgctgcaggaggaaattgtgaaatagtaaaagccttgctttccaaaggggtcaatgttgattcattgtgtcatactggaacaccactgc

SEQ ID NO: 63428 - DNA, 346 bp, Triticum aestivum
  Clone ID: PAT_TA_63428
tttttgagaatcgcgcccgcccgcctagggtttccgcctgccgccgccggagaggaggggaggggaggggaggggaggatcagaaccagggcgagatggccggtcggctcctcggccaactcctcgtcatgggcggcgccgtcgtcggcagggccgtggtccaggcctaccgtcaggccatcgtcaatgcacaaagaaccggagctgctcaggaagctgtgaatggtattcgaagggctagcaaggtcatgacggagcaagaagcccggcaaatattaggaatcggtgaaaagacgagctgggaagagatcgtgcagaaatatgataccatgtttgagaagaatgc

SEQ ID NO: 63429 - DNA, 102 bp, Triticum aestivum
  Clone ID: PAT_TA_63429
ttcttcacgcgtccggcctgtgctcgtatgctagattaaaagatgcatccacgcgtgtgcacctatgaaccatgtggaactgcgaaagggtgaatggctcat

SEQ ID NO: 63430 - DNA, 490 bp, Triticum aestivum
  Clone ID: PAT_TA_63430
ttctggagggcacaaggagaaacaaatcgaggagagtcctcatgtcaaaggttttaatttgaaggatccacgtataatggatggaaattggatacatgaacctaataaagatgtcatcagggattttttccgtctgctagccatctgccatacatgcatacctgaagtagatgaaactgataaagtttcatacgaagctgagtcccctgatgaagctgcatttgttatcgcagcaagagaattagggtttgagttttacaagaggacacagacaagtatatttattcgtgaacgcgatcctagccagaatgttgcagattatcagtatagaaaatatgagctcctaaatgtcttggaattcagtagctcacgaagacggatgtctgtaatagtgaaggaaccagagccagaggggaggatattactgtttagcaagggcgctgatagtgtgatgttcacaaggcttgcaccagatggaagaaaatttgag

SEQ ID NO: 63431 - DNA, 505 bp, Triticum aestivum
  Clone ID: PAT_TA_63431
gtaaaataccgcgcaacatttgtttgttacaaaggtggcattgctaggattaagcctgggcttaaagctcgaagaagacttgttgcgaagactggctgcaaagctatgatggtggtgaagtataacgcaagtgagaatcattgggaagtagtgtttgttgagctggagcataaccacccatgtaatcctgaaatggtcagattcatgatgtgttttaaggatctccctgactggcagagggagcaccgaccattcaatgcgaaaactagattgaacccaaagattcattctggtagaggcaggccacccaaccaaaacaaagatttcatggtgaggtccttcgctcagtctaattattcaattgaagcagctgccaagtgtgggaagctgagatttgcagagggtgacgttgaggcattattagtctttttcgataagatgcaagctcaaaattccaacttcttctacaactgggacatggatgatgaaggccggcttaaaaatg

SEQ ID NO: 63432 - DNA, 385 bp, Triticum aestivum
  Clone ID: PAT_TA_63432
ttttcacgcgtccgcccacgcgtccgcccaattttctcatccgcgagaggacgagcggaggctggacggtggcgcgggggtctgcaatccccggggtcggtcagcagccgacacgacaccagatcgagcgccaggcagggtcgggcgccgctcctccaggcggcacggtcgcggcagaccttcagttggatctgcacctcgtacagcttgcccgccagcctcctcttccactccttccccttcgacggcgacccctcaggttctccgacgagatccgcgtgtgcactcgccgcgtgatggagacatcaacatcaggggtctctccctcccgtccgcgtcaaggccggaggggactgccagcggtggactgcaagcgagcgagcgt

SEQ ID NO: 63433 - DNA, 365 bp, Triticum aestivum
  unsure (1)..(365): unsure at all n locations
  Clone ID: PAT_TA_63433
tcttttctttgccgtcgggttggcccactatgtcgtgctattcgtcactctctatcagcggctccccaccaacgcgcaactccccaaggagctccacccagtgttcttccttttcgtcgccgcacctagcgttgcttccatggcatggacgaggatttgtggagagttcaacgatggttccaagctcctttacttcgtctcgctattcctctacgtgtctttggtggtgcgcatcaacctctttaggggcttcaagttctcactggcatggtgnggcgtacacattcccgatgacgagtgtggccttggcgacggtgttatatgcatctgaggtagacaacgtgctgacacgggcactagcggtc

SEQ ID NO: 63434 - DNA, 263 bp, Triticum aestivum
  Clone ID: PAT_TA_63434
atcaccactctgaacggcgcgcgcacactggaatccacgggcgaaaccagcagagtggagaaggttcttccattccatggcttccacggccctcgcgagcgtgtgccccatcgcgtccctctccgggcgctcgtcgccggcgagctaccgggccgtgaggtgctggggcgcgaggagggggaggcggcggaggtcggcggggctgagggcgaggtgcgcgggcggccagccctccgccgtgaagcccggcccggagagccccg

SEQ ID NO: 63435 - DNA, 274 bp, Triticum aestivum
  Clone ID: PAT_TA_63435
tcttgagtttgtatactcgataaattaagcgggcgcggtgtgcgcgctcgcggcggtgtgggcggatgtgacgttccgcctcgggcgcgaggcgtacggcggtcaccgcagcccgccggggctgacgggctacggcgtgtgcacgtgcgtgctgcacgcgctcatgcgctttgtgccgcctctgcgcacgtccgcggtgctgaaccgcgcgttcatcgccgacccgcactgtgcggtgaccgtcacagcccccggctgcacccccggtgtggac

SEQ ID NO: 63436 - DNA, 302 bp, Triticum aestivum
  unsure (1)..(302): unsure at all n locations
  Clone ID: PAT_TA_63436
tttcaagtttcttttgtgtctagttaattgatcttgtgttgggacgaaaggaagggaataagtggactgtgctctagggatctgatattgtaggctaattagtacggtcattgaaacaataatcaggaggcaattccaattatttaatgaggtccaagattgtgatatggggtgaaggtaccactaacagttgccaagattaatctcgtgtataggagcttaggatcttcaatggtctcaacttcgacgattttataggtgcctgttactggcttgcagatnggcgtgccacgtatattaca

SEQ ID NO: 63437 - DNA, 299 bp, Triticum aestivum
  Clone ID: PAT_TA_63437
tctcggacgcgtgggcggacgcgtgggcgagggcgcgcaaggcgcggcgcgggcgcgttcggtcttcggcggcgtagatcggacgctggatcgggaatcgcattggcggcgcccgatccagatctgaaggcttccgtctacttcaaccagggctgcctccgatggtcctgctttcggcggcctttgtcgtcggagttgtaccggtttggcggctggaggtgggaaggtggctccggagaaatccgaggccagcagtgctggtcacgacggcggcgacgcccgagggcgccgtacccttc

SEQ ID NO: 63438 - DNA, 279 bp, Triticum aestivum
  unsure (1)..(279): unsure at all n locations
  Clone ID: PAT_TA_63438
tcccacgcgtccggttctttcacgcgatccagcggttccgcgagcccttcgagcagttctttgcgggcgaatgccctgatgccgtcgtcgccgacagccacttccagtggtccgtcgacgccgccgcggagcacggcgtcccgcggctggcgttcctcggcaccagcatgttcgcgcgggcctgcaccgacagcatgctgcgcaacaacccgctggcgtcttgccccgacgccgtcgtctccctgccggggctgccganccgcgtcgacatgttacgga

SEQ ID NO: 63439 - DNA, 306 bp, Triticum aestivum
  Clone ID: PAT_TA_63439
cccacgcgtccggtggtggtgcgagactccggtccagagcgggggcggccggccggcagaccgccaagaaaccagaccacctcccgtctccgtcctcggccaccaccaccgccacctgcccgcgcctcccctccaccgctcctcctacaagaacccccctcgcctgcctgcgctgcagcctacgccggcgagtcaacctctctctcatcttcgggtcgggggatctcgcgcgctcctcccggaatcaggcgccggcggtcggagggacaaagacacggacatggagggcggtcgcggcggccggtg

SEQ ID NO: 63440 - DNA, 312 bp, Triticum aestivum
  Clone ID: PAT_TA_63440
ttttctacggacgaaatacgttgaaatgagggcggtgcaaaaaaggaaaatatgtggtttttcaacacatgatactattcatcccaaaagtccatgactttgtccttttgcacagatcgcatctcaagattagaaggaaatcccctatgttcaaaagtcaatgatacatactgttcaaataagaaaaagaacaccacatctactgtgctcatcgccgtgatagttcctgtggtactgatatccctcctagtagttatgtgcataatctggaagttatgctggaaaggagagccaagagtccatgaagattat

SEQ ID NO: 63441 - DNA, 345 bp, Triticum aestivum
  Clone ID: PAT_TA_63441
tttggcggtcgtcaccgacacggcgtacgtcgggttctcggcggccacgggcgtcatcttcacgcgccactacgtcctcggctggagcttcgcgctcaacggcccggcgccgccgctcgacacctcgaagctcccctcgctgccgcggttcggccccaagccacggtccaaggtgctggagatcgtgctcccgatcgccaccgcggccttcgtcctcgcgctggccatcgccttcttatggttcgtgcgcacgcggatcaggtacgcggaggtgcgcgaggactggggagggtggaattcgggccgcaccgcttcgcgtacaaggagctgtacgactgcatgccc

SEQ ID NO: 63442 - DNA, 293 bp, Triticum aestivum
  Clone ID: PAT_TA_63442
tcttcccacgacgatgatgcaccgtgctacgatcgtcggcgtcgtcgcgcttatcggcgtccttctcgtcggcggcggggttcgagcgcagccgccgcagcggtttgactacccggcggcgagggcgcccacgacctgggccaacacggacgccggcctgccgaccacgtggtctacaccgacggctccgtggcgcgcgtggccctgctgcggcttaacccgggccggctacggcccctcctacgccttcggcttcttctgcaccggccacggcgcggccccgtgcgccgact

SEQ ID NO: 63443 - DNA, 338 bp, Triticum aestivum
  Clone ID: PAT_TA_63443
gcttatgttaggtggcaagcttttacatgcgttgttgtgcgcatattcttaacctgatagtcaaggatggtttggatgtgttagaagaatcgattgagaaaatccgtgatagtgttgcattctggactagcacacctaagagaatagagaattttcaagaggttgccaagatgctgaaagtagaccaaagtaaaaaattatcccttgatgtgaaaacacgatggaactctacgtactttatgctcagtgttgctttacgctacaagagtgtatttaatcgcttgaggcagcgggaaaagacctttacttgtgctcctagtgatgatgatttgatattt

SEQ ID NO: 63444 - DNA, 262 bp, Triticum aestivum
  Clone ID: PAT_TA_63444
tgttctcgtggatcggtctctttgtcggcggcatcgtggtcggcctgatcgccatgtcgctgtatacgacgagcatctttgttgctggcgcggctggcggtgtgctgctggcgttcacgatgcacacgacagtggcctacaagatcaaccagagcgacccgaacgtcgtgctcgtgatcctcgcaattgtgctcggcctgctgtgcggcgtgctcgcactgaagctcgagaagcccgtgctggtcatcgccacgagcttggt

SEQ ID NO: 63445 - DNA, 175 bp, Triticum aestivum
  Clone ID: PAT_TA_63445
ttctcacgcgtccgcggtcatagacatagagtgatacaaggtttttgttttctttgtacgtaaccttgcacttatcgccatgaagatcaccatgctctcgtccaggcccgtcaagcccgattacggcgcttgcggtgcacctccgggcagcacggacgacgtcgtcccgctcacc

SEQ ID NO: 63446 - DNA, 258 bp, Triticum aestivum
  Clone ID: PAT_TA_63446
tgttgtagagtgcctctggctctgaagactcagcttcacgttcggctttgtgcaactgggcaacatcgatcgtcaactgccacaaccacatcccaagcagcaaggtgatagtctcgttcctcaactcgcgcaaatctcctcacctggtgacgagcatccaccaagtcggcaggctcttcagcacattttatattgatcatggcggttagatatattgatattttattccctcccttcaatgtaccatagctaacctgt

SEQ ID NO: 63447 - DNA, 318 bp, Triticum aestivum
  Clone ID: PAT_TA_63447
tttttatcgtcaaggaagaaacggaaggcatcaaacaaatttgaggatgacacagttaaaggattccggcgtatgagagaccttattggatcaaacaggacgcccagactgcagttaggtgctggatcttattaacatgggtatcatgatttacctgatcttgaaagtgggccaagctttggctatgagttgcctagcacaaatggaataaacaaaaataagcagtctcattcgttgacaaaaaggaaacgctccaatattggtcaagcttatgaaaattcaagaaagaaagataagcgactttctttgtcaaagtta

SEQ ID NO: 63448 - DNA, 228 bp, Triticum aestivum
  Clone ID: PAT_TA_63448
tttttgcgtccgcccacgcgtccggttcagaaatacatgtgccgccgatttgccatgcccatgcaaatggtacacactcaggcagcccatgatgcatttttccagtctgatagagagccaagttgtagctgttggtcacctttcatgatatggttgtctgagttaagcatttgcaatattgccaactagtaggattgctctttgagaagaccttgcgttgctattctc

SEQ ID NO: 63449 - DNA, 362 bp, Triticum aestivum
  unsure (1)..(362): unsure at all n locations
  Clone ID: PAT_TA_63449
tttttctaacgaggtacactagtgatcaactaattaagctgtcctttgcgtagctggctagctagtgagttagtgaggatcaatggcatcccagctggagtcactcatgaagcgactgtggagctatcttcccccttctcttagcagttccaggagcgaccctccacaaccgattcctgatcccaccggtgatcctccagccgctcaagccggggacactcccgccggtcaggagctttcacccgctcttcaaggtgtaaactcaggactcagctacttatctactctcagcacacacgcatacgttacacacctntttttgctaatgatatcccccgaacgctgtgataataatctatggc

SEQ ID NO: 63450 - DNA, 348 bp, Triticum aestivum
  Clone ID: PAT_TA_63450
tcttggacgcgtgggcggacgcgtgggtccaaagtgtgtatgaagcaactccgggagctggtcttcgagatcgaagactggatcgatcaaaggccggagaccaacattctgttggacacagaagaaatcaaatacttcatgtctgagatcaagggagcgcgtgagcgcttcaaatggtaccgaagtcttctcaagatagagtccagtgagaccgatcttgctgttgttgcacccagcaaaatcaccattgaccctcgtctgcttagcgaggagaaatattgtcatggtattcttgatggtccaagggatgagcttgtcaagcatctgacagatcagacggaggagatg

SEQ ID NO: 63451 - DNA, 424 bp, Triticum aestivum
  Clone ID: PAT_TA_63451
atcggattgaattagtggtgcagatgataaaggagatgagagctaatcgctttgagtctgatctggcaacaagcaccatgctgatacatttgctttgtcgaagccatcggtttgaggaagcatgtgctgagtttgaggacatgttccgtagaggccacgtgccccagtatatcacttacaggatgcttatgaaagagctcaagcggctgggtttggttcaactggaagagaagttgaccgacctaatgcgctcagtaccacattctacaaagttgcctggcagctacagagaaaaggaaggcgacaatgctaaagaaaagagaaagttaatattggagaaagctcaggctgtttccaatgttctgaaggagtgtaaagatccgaaggagttgcacaagctgaaagatgatgaagaaactgatgt

SEQ ID NO: 63452 - DNA, 247 bp, Triticum aestivum
  Clone ID: PAT_TA_63452
cccacgcgtccgcggacgcgtgggcctagatctgaacccgtcaggcggcgacccttcctcctccttgccgccctcgccctggtccactccggcggccccttcgccctctttaaaccccagcacctcaatcacgtcttcactccaccgcccgcgaaatccaggccctagcgcgacttcgccatggccgcagcactcctcctcctggtgccgcccgtcggcctcctcgccgagctcgccttcctgaccc

SEQ ID NO: 63453 - DNA, 238 bp, Triticum aestivum
  Clone ID: PAT_TA_63453
tggcgacggaggaggacacgacgcggctgtgcgacctcccggaggcgtgcgtggcgcacgtgctcgcgctcacctccccgagggacgcgtgccgctgcgccgccgtgtcgccctgcttccgcgacgccgccgagtccgacgtcgtctgggcgcgcttcctcccaccggactaccgcgccatcctccagctgcacgaggcgccggcgcggcgcttccccctctcgcgctccggctccac

SEQ ID NO: 63454 - DNA, 337 bp, Triticum aestivum
  Clone ID: PAT_TA_63454
ttctttccgttcttgcacattgaggagattactttcctcaagcgtgcttgggtttggagcccacatgtacagtcacgtgttgcaaggctggaacacgattcgattgagaaaggtcttttgtaccatattccatcgaaggtggtgtgtgcagagcagcaggctgtggacgtgatgggcaatgcccttcgagagtatttcttctatggaaaaaagaaatatgatgagcgaaaggcggcctttgaacgtgtgattgcacgcaaaggtctgggtgactatttcccaggcttcgtctccttcgagacatgtgtagagacttacaagcaaggaagcgagcaca

SEQ ID NO: 63455 - DNA, 252 bp, Triticum aestivum
  Clone ID: PAT_TA_63455
tcttcctggccatgataccgcgagccgccgcgcccggcgggggcgggtgcaaggtcgcgtacgtctgcaggcagcccaaggacatggtggtctcgcggtggcacttccaccggcggctgcatcccgagctggcgttcgccgacgtcttcggggccgtgtgcagcggcttggtggcgtacggaccagcgaaaacatgttttagagtctatgcatccgggtacttcttattcaaccactcattcctgcatcacg

SEQ ID NO: 63456 - DNA, 270 bp, Triticum aestivum
  Clone ID: PAT_TA_63456
cttccctccctcctcgatctctctccctcggccgccacgaaccctagctccctttcctacgatcccgtggtcgctgccgctgctccatccgacctccctcatcagccgccgccgacactacggctcctccatccaccgactctgtctgtgcaagcgaccagtttccttccgccccgaccttctccactgtctcccagttcatcatccgtcccttgctgctcgaggtgctcatctgcccatgccgcgaggaagcaacgtgaggagggagag

SEQ ID NO: 63457 - DNA, 382 bp, Triticum aestivum
  Clone ID: PAT_TA_63457
ttgctgaggcaatagcggagggtatcaaatcaaatagtactttgatatcattatccttggcaaaaaatccgattagagacgaaggagtacactctttatgcaaggccttttcaaatttcccaattatcggtgatgaattaactgcacaaaggaaaaagaacatcgccgaacttgaaaaacaaaggaaagaattattagcaaataataatgcaaatccttttcaggcagatgaaccatttcaaataaaaagggagcaaaaccctccaaaaatgcactgcgaagatccaccatcatggattcacgaacaagtgaagttgatgtaaaaagaaaattagggggaccatcagccatgttgaacatgcccgtaagaagttaggaggcg

SEQ ID NO: 63458 - DNA, 399 bp, Triticum aestivum
  Clone ID: PAT_TA_63458
tcttctttgcatctttttggttcaggaatgaagaaaaagaaaaaaacccaaagaagtttccttttgcctatgtcccaaagggaaattaaatagaaattcaacatctagtactccatttgacttttaaagcgtaacaacatttgagtcatacttttggttgtgattcttgttgcttcgattcgatttgacttttttttgaagtgtaacaacatttgagtcatacttttggttgtgattcttgttgctttgattcgatttgacttttttttgaagtgtaacaacatttgagtcatacttttggttgtgattctttttttctttgatttgattcgactttttttagcttatgaacattcaagtaagattgtgtttctttgatttgacttttttgttattaat

SEQ ID NO: 63459 - DNA, 250 bp, Triticum aestivum
  Clone ID: PAT_TA_63459
gctgaccgcgatggctgagctgctgcagtcgggctgcacgacgtcgagcgatcacctatacatctacccgaacggcagccggctcgacgacagcatcggcgccgcccagcggatcggcatgcgctttcacgcgagccgcggcgcaatgagcgtcggccagcgcgacggcgggctgccgcccgattcggtggtcgagcgcgaacccgacatcctgcgcgacgcgcagcgcctgatcgagacctatcacgac

SEQ ID NO: 63460 - DNA, 217 bp, Triticum aestivum
  Clone ID: PAT_TA_63460
tgggtgttgttggtcaaacaaataattttccatgtttggacactcagttttctgcactttagtcatttgtatggtttgtgttcatgaataatcagtggctggcatcattttatatttgcaccgtttgagtgctgattacagtaggtctacattttttagtcaaagtgtttttatgttactttgttctttcagttttctgtcagtagtttgttcaact

SEQ ID NO: 63461 - DNA, 242 bp, Triticum aestivum
  Clone ID: PAT_TA_63461
ttccactcgtccggagacccggcccgcctccgcgtccacggagtccagccgcctcacggcggggtgcacgcgaagccggctccacgcagcgtcctcctttcgccaccaccacgtccccgtcctccctcccccacccaaaacccgcctcatccccgtgtcaaaacctccgagctcgccacagcgatcgccagctcgcctcgcccacgcccacgcccgcgaccgcggagctgacccatggagga

SEQ ID NO: 63462 - DNA, 299 bp, Triticum aestivum
  Clone ID: PAT_TA_63462
tgtacgacaggatgatgcggcacctgcgggcagcggtggacgcggagggggtggagcacgacgcggcggtgacggacggcgagcagctgctgcggcagctcatcgacgccgcggcggcgcaccacgtggtgctggcggagctcaagtccgccgtggccagggccgacgtgttccacctcgtctcggggatgtggctgcccgccgccgagcgctgcttcatctggattggcggctcccgcccgtcggacctcatcaaggttatggcgcggcatatggagccactgacggagcaacaggcg

SEQ ID NO: 63463 - DNA, 275 bp, Triticum aestivum
  Clone ID: PAT_TA_63463
tcgcttcgcctccaccacatcccgccgcgggtcgggctaatccgctacgactgccgggcccgcctccgcccggcgccccgtccaccatccaccatgcatggagatctccctggacgcgctgccgcccgtgcggtcggggccggggctgagggcgcggatgggtcggatgaagaggaagacgggttcgagttcgagattgggaccctggggaaatttatgaagcctcaggggactgtaaatgtctcggctacgtacaatacatggcaccacactgt

SEQ ID NO: 63464 - DNA, 269 bp, Triticum aestivum
  Clone ID: PAT_TA_63464
ttcttttcagaaaggatgagatcgcggaatggcaggtcaggccggaagggttcgtccaccacacagctgtcaggccagtcaaccttggcgcacagcttgtacctaccccatgtgtcgtggcgcacctgggtcccaccgcatccacgcttggcggtgccgcgtccccgtccgagctcgtcgccgccctgtccctgcccgcctccaagctgccgttcctcgcccgcctgctccgccagctcgccacggcggggcgtcttcacctccaccga

SEQ ID NO: 63465 - DNA, 300 bp, Triticum aestivum
  Clone ID: PAT_TA_63465
tttcttttcacgcgtccgcccacgcgtccgcccacgcgtccgtccacgcgtccgcccacgcgtccgcatgtatctccactccggccgggcagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctgcacgctcatcttcgtcttcgccgggcagggctgcggcatggccttcagcaagctgagccccga

SEQ ID NO: 63466 - DNA, 377 bp, Triticum aestivum
  Clone ID: PAT_TA_63466
ttccatgcgtccggttggatagtagtcatggagatcatccctggattttcactttaccgagggttatatgagtttggtcaatatgcattctctggaactgcaatgggaaccagtggtatggagtggactaatttgagtgacccggtcaatggaatgcgtactgtattgattatcatggttatcgaatgggcaatacttctccccttggcattttatcttgatcaagtctcatcattgagtggtggactccgaaagaggttggttgatctccttgaaatgctttaagaagcgagctgcatcatttcggaggtatagcttcgggcgactaggacctaaagtaacaatcgaaatggagaaccccgacactactcaagaag

SEQ ID NO: 63467 - DNA, 226 bp, Triticum aestivum
  unsure (1)..(226): unsure at all n locations
  Clone ID: PAT_TA_63467
tccactcgtccgccctcgcgcgctcctccccacccccagagccccgtcgcctagctagggtttttgactccccgccgacaccgccgcgcgcgcgcgagagagagaccacagcgaccaacccagccatgtcggtgcgtccgagcgagcgggccgacgcgcggcggaaccgatacaaggtgaccggtggacgccgatgagngggcggcggcggcgcgaggacaacatg

SEQ ID NO: 63468 - DNA, 309 bp, Triticum aestivum
  Clone ID: PAT_TA_63468
ttacgttcattgctcacaagactggtgcagacgcacggctccacgaatccacggaccaaggtgtggaggcaggctgcagtgccgcagtaggcggaagcaacatacatcatttatgtccatcaagtcccgagagaactactaatagctagctggaaagatgttttagagaatttgtttggaggccgacagcgggctcgagtctatctctgtctcacgaacagggtggacaggttcacgactcgactgattgactgaatcggagcaaacaattcagcaaacaccttatgggcagagcttggactggcagca

SEQ ID NO: 63469 - DNA, 234 bp, Triticum aestivum
  Clone ID: PAT_TA_63469
tttgtgcagcaacccctaacagacccacggaatcggcccatagccatcttggctaccgggaggaagagtaatcccctagagccctgaggcactggctggcgctaagtatttacactgtgcgtaaccatgtacttcacgcgaaggagatacctcattagaggtgaatagtgcctaaataagactgactggtacactttatggagctacatagactacaaagacgatgcgaataat

SEQ ID NO: 63470 - DNA, 219 bp, Triticum aestivum
  Clone ID: PAT_TA_63470
tgtggtagccacctcctcgccgtctcctccgccgccgtcggctgcctctaggcctcaggccgcctcccagacgcggccaatggaggcgccgacgggcctgcacaggctgcggggcccgtcgcccatcgtgtgggccatgcgcacccgcgtcgccccgccgccgcggctcgcgggcccaatcccccgccccgtctaccctgcccatcccccgccgcgggc

SEQ ID NO: 63471 - DNA, 329 bp, Triticum aestivum
  Clone ID: PAT_TA_63471
tcctcgcgtccgacggatacgggttcgtgccgcgtccgtacggcgacgtccaagatggttccgggaagaccctcgccatcatcatcggcatcgtggcggcggcggccatcatcatcatcttcctctccttcgtccgaagagcccgcgccgccaatggcaaaagctaagctaagggttgcagcagggatggtcgccactcgccactattagctcagatttggatcggtcggtggcttttggcttcggcgttgctttagtatctctccttttatcttttatggtctcttttgccgtgccagaaaaacaaagggaggccatgccgccactgt

SEQ ID NO: 63472 - DNA, 317 bp, Triticum aestivum
  Clone ID: PAT_TA_63472
tcctttcacgcgtccgcggacgcgtgggcagctctgttccatccagtcacgaagcagaggagagagctgtactcctacgtctgtaggctcatagctggggagatggtgctcaacggcgccctgttcttgctcgtctgcgcggctgctcgagctgctgcgtcgggcggagacggcccgctgctgaacgggaacttcgagcacgcgccgaacaggtcgcagatgaacggctcgagggtgacggggaagtacgcgatcccgcactggaaggccaccgggttcgtggggtacttcgagtgcggcgcgaagcaggaccacat

SEQ ID NO: 63473 - DNA, 248 bp, Triticum aestivum
  Clone ID: PAT_TA_63473
tgtgtcctcccgattgttcgtgccacacccccgtccgtcgtgagtcaagcagggagccaatcctctggttgaatttgaacatagcatcagcatcggccgttcaactgcgggcggtggtagtggttgctgcctttcggcgctggtgctatggatagattcaaccgaatggttgtgacatacccgattgaaagaagaagctttgctcccgcgcacatccaggccggtgggattagagtgccctggtggcg

SEQ ID NO: 63474 - DNA, 270 bp, Triticum aestivum
  unsure (1)..(270): unsure at all n locations
  Clone ID: PAT_TA_63474
taggttcacacgcacgcggggtgcaaattgcaatgacgcccaccttcgccgtgcgccggcgagaaccagtcctcgtcgtcccggcctccccgacaccccgggaaacaaagcgcctctccgacatcgacagcaaggagtctctgcgggtgctcatgccgggcgtcttcgtctaccgcggtggcccggcgcgcnggcgacgacgacccggtggacgtcatcggccgagcgctgtccgaggcgctggtgcactactaccccctcgccgggcgc

SEQ ID NO: 63475 - DNA, 193 bp, Triticum aestivum
  Clone ID: PAT_TA_63475
acgcgtccgagcaacggcgccaccaagggagcagttagttggctggacgatccgactggctactggctactggtagcagcagctgatcctgatcgagagcgatggggtgggcgatcgcgctgcacggcagcgccggggacatcccgcgcacgctgccgccggagcgccgggagccccgtctcgccacgctccg

SEQ ID NO: 63476 - DNA, 206 bp, Triticum aestivum
  Clone ID: PAT_TA_63476
tctcattcgtccggaggagagagacccagcgcagaaaagggacgccgcaaaagggcccccggggacagcgagaggtgtaggcagcagcagcagccagcggggaggctggttgtggttggtcgtcgcgggcgggatggagagcgagatgtcggacgcgcagcccccggcggctgcggcgcccgtcgccgagccgctcgccgccgtgg

SEQ ID NO: 63477 - DNA, 248 bp, Triticum aestivum
  Clone ID: PAT_TA_63477
agctcaagcggactctctccatcgcacaacttgctctctcttggcccatgcatctagatccatccatggcggcgataggcggccacccttactcgccaagtgacctggagctccccggtttcgtgccgcagcagctttcacccatcgaactcgtggtgcccctcataggcacttctctcttggtcatcacgggtgatctggcttgtctccggccatgtcctcaatagtggaagacccagcagactatc

SEQ ID NO: 63478 - DNA, 156 bp, Triticum aestivum
  Clone ID: PAT_TA_63478
tgtatctgagataccttcctgtccatcatttccagagcctaatgtccgaagaggcgcgtggtttgatgttattgctgtgaaacttccctgtacaagggtggctggttggtcaagagatgttgcaaggcttcatttgcagctctctgcggcaaaact

SEQ ID NO: 63479 - DNA, 370 bp, Triticum aestivum
  Clone ID: PAT_TA_63479
ttcctttcgtccgggtcattcttccaaactcttaggcagggccctcgcacacactgtatcatgcatgacctgatccatgatcttgcagtgtcagtttcaaccaatgattgctttcaaattgagcctggcatgacccgttctatcccctcaacggtgcgccatatctcggtcactacagatggcgtacaagacatcaatgctgccatcaacatgctaccgaaaaagctgcgcaccttgttagttctgagaactcgttctttctcctcatattgccttcaaggagacttcttagcgaagctcaagacttggcgggtgcttgatattagccactctgattacactgaattgccaatgtccatttcctgcttaa

SEQ ID NO: 63480 - DNA, 280 bp, Triticum aestivum
  Clone ID: PAT_TA_63480
tttctttcttccggaggagagagacccagcgcagaaaagggacaccgcaaaagggcccccggggacagcgagaggagaaggcagcagcagcacgcgacggggaggctcattatggtccacatcggccagcccgatatccaggtcgataacgcctgctgagagctctactgcctcgagcacggcatccagcacgatggcaccatgcccagtgataccacgagtcggaggttgcacacgatgcgttcaacacgttcttcagtgagaccggtgcgggcaagca

SEQ ID NO: 63481 - DNA, 108 bp, Triticum aestivum
  Clone ID: PAT_TA_63481
tacatgctgggcaactaccctaccgcttggtgctgaccgtccgtcggaacctgcaacagtgggaactctcgccgggagccctacaccgcggctcataacatgctgctg

SEQ ID NO: 63482 - DNA, 396 bp, Triticum aestivum
  Clone ID: PAT_TA_63482
tcgtaggaagcagcggagaccacacgaatccccccaccaccctcgcgcccccctcccagcgcggcgccaccaacctcgcctctcccggcgcgccgagcggagccgagcgccgccggagccggcggcgggtctgcgtcaggtccggcctcgtccgtcccgcggaggcggcggcagcgcagcgcgcgctcgcggttggagcttaatcttggttcctgaagctgtagtagggctctgttatggcggggtctgtcgcctcggggttcttccccacgccggggtcttccccggctgcatccgccagaggctccaagaacatgtctggtgaattacctgagtctttgagtgtccgtgggatggttgcaaagccgaacacgcctcccgcgtccatgcaagtca

SEQ ID NO: 63483 - DNA, 300 bp, Triticum aestivum
  Clone ID: PAT_TA_63483
gggcgcagtcgcaccatccaccccaaccttcagtgcaggtctgctcatgtctcctcctcgaatccacccctccggaatcactccagtagccgcagccgcagacgattcataggtttctttttcagtactttctttaccaagcaaacccaattcgccgacaccacttaggattcagattagaggcggggaaaagcggaaaaagcagatggagaagacgacagggatggcaggctcccagcccaccgacaccgagtcgttcgagtacatgctgctggagaaggaccccgaccactaccggac

SEQ ID NO: 63484 - DNA, 262 bp, Triticum aestivum
  Clone ID: PAT_TA_63484
tcccccgccgcgggctagacgcagaccaacccgggaagcgaggcgggtcgccgccgccctagggtttccgatggagcccgcggccccctccgcgtactcggtctcgccggccgcgtcgccggcggggaggcggaggacggcgccggaggccgcggagctgagggtgcggcggcggacgctcgagaccgtgctcgagcagtgccagcgcgcgctcgagctcatgcgcgacgccgagggggaggacggggatccggaggaggag

SEQ ID NO: 63485 - DNA, 365 bp, Triticum aestivum
  Clone ID: PAT_TA_63485
tttaatcgccatggcggcgccagcaccaacggcaaggccaatattaagaagcacggccacggcggcagcagctggttcatgctgcacatgatgccgtccttgtcgtcgtcgcgggcatcgtccaacgtaccctcggagaagggggacggcgacgaaagcgaggacgacgacgacgaggtactcatccccggcctgccgacccggttcacgttcgtcgacctggagacggccaccaacggcttcaagtggcagatcggctccggcgggttcggcttcgtgtaccgcggcgagctcccggaccggaccaccgtggccgtcaagcggatgaacaacctgtgcatgcagggccggcgcgagttcctcac

SEQ ID NO: 63486 - DNA, 358 bp, Triticum aestivum
  Clone ID: PAT_TA_63486
cccgaatcaagctgccatcagaccatatgtttcaaattgcacggtgtgagcattgaatatcccgaacacgtctgcagaccggcgtaggcccgctgatgccggggaagaagttggcgcatcatcagcgctgcatgatcaatcgttgcaggtgggaactgtcttcaaggcgcgcagatctcgaaataggttctcatccccctctatagataaagcagcggtcaacacgcacagatggttgaacaacgctgagatcatggtcatggaagagaacatggaagactcgggcggtattagacactctcatacagattaatattgaccacctgcttaattagttaatacattgtaacaccccctc

SEQ ID NO: 63487 - DNA, 360 bp, Triticum aestivum
  Clone ID: PAT_TA_63487
ttgatctggagcacccggagcgcccgaccaagtacggcaagtactggtgctggtgcttctggtccgtcgacgtcgaggtgctcgacctgctcggggccaaggagatggccgtgcgcgcctgggacgaggccctcaacacccagcccgagcgcctcatctggaacctcatgggcatgatgaacaactgctggttccgggtcaagatcaacgtctgccgcccccacaagggcgagatcggcctcgtattcgaccaccccacgcagcccgggaaccagtccggcggctggatggcgcggcagaagcacatcgagacgtccgagaccacgcagggcacgctcaagcggagcacctgcacgccct

SEQ ID NO: 63488 - DNA, 212 bp, Triticum aestivum
  Clone ID: PAT_TA_63488
gggccatctccgagctggcgcgcggagccgacgcgccctcggtgccaccggtgtgggggagggagatgctcatggcgcggcagcccccgcagacgtgcacctacccggacctggagtaccgagagcccgcgggcgggctggagccggacccgatgctcacgacgcccccaggcgacaaggggtgcgtccccttcttctttggggcacgggag

SEQ ID NO: 63489 - DNA, 426 bp, Triticum aestivum
  Clone ID: PAT_TA_63489
tcgtttcacgcgtccggagaatcgccacatcgctcgctccctccttcctctcctctccctcccgatctggaagaatcgaagagacatgagaatcgacgcatcgcctcatgcgcatccgcccctcccgatccttttcggtccacgatcgctagcagagggatcccctcgagagaggaggacgagcgatcggtcttgctgatccgtcggtgcgaaagggaagatgagggcatctggtcgccgcgactttgaggaccagggatcggtcagcttctcggctccggcaagccgatgctctgcaggaaacacaaaggtccgtcccgcccgccattgcggaccaggcctcgggcaccgaccctcgatctcttcttcctcgtcattccgggactcgcaattcactgacgtcgaccttactggccacctggcaca

SEQ ID NO: 63490 - DNA, 411 bp, Triticum aestivum
  Clone ID: PAT_TA_63490
atcgttcatttatggatatctcggaggtttccttcttgaattcggacgtgggttttctcgcctgaggcgggatcccatattgcgaaattggagcacgattcgattgagaaaggtctcctgtatcacatcccctccaaggtggtgtgtccggagcagcagagtgtcgatgtgatgatgaacgcactgcgcgaatatttcttctatggtcgtgaggtcttcgaagagcgtcgcgagaaattcctggcagtgattgtgaactgcggcttggtgccgtacctcacggaagtgccagcgtacgatacacttgttgaacaatatttggcatccagtgccaagtatgctccgggtggtcggtgcgaacaatgcagtgcttaggcgctgcgcgtggggcctaccttataaggtcccttc

SEQ ID NO: 63491 - DNA, 363 bp, Triticum aestivum
  Clone ID: PAT_TA_63491
tgcgtcatccgcagcagagaactccagggaattgaagctgggatcggaaaaaggtcggtcttttgccattttggccgggagcagaggagggaggagatggccaagggggagagggaggggcgcctccccctcttgctgctgctgctgcttgtcttgtgcctcttggcccagtccaggatcgccgtcgtcgccacccacccacaggatgcggctgctctcaaatccttgatgaggaaatggtcaaatgtgcctgctagctggaggaagaaatcgaatgatccttgcggcgacaaatgggatggaattgaatgcaatggtgccaactcaagggttacatcactaaatctttttggcatgaacatg

SEQ ID NO: 63492 - DNA, 242 bp, Triticum aestivum
  Clone ID: PAT_TA_63492
tgtggttctccgattctcctacgcggagttggaccaggcaaccggaaaattctccgacgaacagctcatcggcgtcggtgggacgagcaaggtgtatcgtggccagctcgctgatggcaaagtcgtcgccgtgaagaagcttcggcccctcggcggtgcggacgaagactatgagttcctgtcagagatagagctgctgtcgcggctgaaccactgccacgtggtgccattgctggggtact

SEQ ID NO: 63493 - DNA, 147 bp, Triticum aestivum
  Clone ID: PAT_TA_63493
aaaagaaacctcagagccttatggttcatacggccatgaaaatcgtaaggaaatatcggcaacatatggatcaaaggaccaaggaattcgcaaggaagcatcaggatcctacgggctaaaaggtgaaagggatttaaaagaaatctc

SEQ ID NO: 63494 - DNA, 308 bp, Triticum aestivum
  Clone ID: PAT_TA_63494
tctcctagctcattcttcaaagttcaaacacatattttctgtctctactctccttcctcattgcccataagctcctgcgtctgtgttcgtcctcttgcgacgctaatggcgtgcctgtcctcctcgccgtccggccggcgcctgtcggagctgctggaggagaggcaggagcccttcttccttgacctccacctcctggagaagggctgctcgggctggctcctcgatggctatgacaccgccctgtgctggccagccgcagccgccggcaacgacgcggcgtccgtgctcaagcgactcaccagcaa

SEQ ID NO: 63495 - DNA, 324 bp, Triticum aestivum
  Clone ID: PAT_TA_63495
ccctcgcgtccgcggacgcgtgggcgagaaggtgcaggaccttctcctccttgatgtcaccccactgtctcttggtcttgagactgctggaggagtcatgactgtgctcatcacccggaacaccaccatccccaccaagaaggagcaggtcttctccacctactccgacaaccagcctggtgtgctcatccaggtttttgagggtgagaggacaaggaccagggacaacaacctgcttggcaagtttgagctctccggcatcccgcctgcacccaggggtgttccccagatcactgtctgcttcgacattgatgccaacggtat

SEQ ID NO: 63496 - DNA, 288 bp, Triticum aestivum
  Clone ID: PAT_TA_63496
gtccgtgtgcttcttcttccttgtgtctcctactgtcttcttgattgcgcaacaacaatattcacggaggaatcggagtggccgcccttggcctacccaatacaagtcttctcttcaaggacatggagatgggaggagaggtcgctggcccggagaggagaggctgcagggaccatcgctgacatggatccatatagggattatgaacaccgttatgccgtctactggaaaggagcgatctatgtgcattgtcaaaatgactccattttacgcataaccttaacggat

SEQ ID NO: 63497 - DNA, 292 bp, Triticum aestivum
  Clone ID: PAT_TA_63497
aaagcctcctagatataagcagccggagtacctaataagcagactctatcaggcttctgtgctgaatggtgatactgctcaagcaaatgggcagatctgctttactagaaatacttcatcacttgtaaagcctcctaaatataagcagtctgaggatttaaaaagcagacacagtctaacaccgcagctgccaatcaattgccctgcggcttcgaagcctcttgtgcatcctataaccaatgagaacactctcaacactttggtctcttcattacctgttctagagcatgct

SEQ ID NO: 63498 - DNA, 187 bp, Triticum aestivum
  Clone ID: PAT_TA_63498
gcgcaccgtccacgtccatggcgtgcacgccctctttcgccgtccaccgcgccgtgtggaccttgtccccctccgcgccgcgccgagggccggcgaaatctgccgcctttgtcagcgttccggggggacggccccgggggcggcggccggtgctggcggcggcgctgggcgacatggacatgcgccc

SEQ ID NO: 63499 - DNA, 165 bp, Triticum aestivum
  Clone ID: PAT_TA_63499
gactgaaaggtggattggtcatatcattcatgaacatggcatcactggtaaacttggatttatcacacaacaatttgacaggagctattccagactaccaaataaagtcactcaaagttctcgatttgtcatataaccagcttgatgggccaatcccggattcta

SEQ ID NO: 63500 - DNA, 192 bp, Triticum aestivum
  Clone ID: PAT_TA_63500
ctatatatcaaacacccagataaagagtgtcaccagatcaaatgcaaagtaaagagtgacaaatagtcaatgtaccaagtaaggggtggcaaataatcaaattcccctcaataaacctacatctatggccaccttcacccgatcaccgctcccgccggccgaccccgagaaggagaagccgctcgcccgctc

SEQ ID NO: 63501 - DNA, 307 bp, Triticum aestivum
  Clone ID: PAT_TA_63501
cttagactgaactggacggggtctgcttgatattgctcccctgtccccactccctgcctgcaaactagccgacgatggaacttcacatgaagcttctgctggcctccctcagctgtgtacttctaatacaaggagcattctgtgataacactgcaggggggactggagccacaagccggacatgtgtgtgcgctgatcatccgcttggtgaatctaactccaatagcaatctgccatgcacctgcaactgctcgtgccattggctaccagatgaaaacggcggcacacggtcatggaactgctcgtg

SEQ ID NO: 63502 - DNA, 307 bp, Triticum aestivum
  Clone ID: PAT_TA_63502
ttttgcgtccgcatggtctcactatgctcctgctgggaacctataccctgctcctcaaccctcttcgcggggcggggcggcgcggcacagcacagcggagccggcggagatgtcgggagtgacggtggacgaggacaagaagcccgcggacgacggtggaggcgcccacattaacctaaaggtcaaggggcaggatggcaatgaggttttcttgcgcatcaagagatccacacagctgaagaagctgatgaacgcttactgcgaccgccagtctgtggatctcaactccattgctttcctttttgat

SEQ ID NO: 63503 - DNA, 451 bp, Triticum aestivum
  Clone ID: PAT_TA_63503
ttgcctttcaggttcacgcgccgcccggcagaaagaaaggagaaaggaagaggaacaaaggcggggagggtgccccggccccggcacagctgctggattcggggcggcgggcggcggtccacggaatccggccggattgcgcgtgaattcagagcagtcgaggcatgccataagaagagcagggggagcaaatgtggcgtctcttcaacgagctgtgggacgttctaggatccgggtttttctcgtccaggttcctataagcctaacaagtcagcgactcgcctctcccgtcgcatcaaatcaagtccatccatccattgcatcggtccatctggtcggtcggcatggacgaggaggattactcgtgggtgcggcggacgaggttctcccactccgtcgtccgctccaactccggcagggagcagttcggcgccttcgtcgagcagttcaa

SEQ ID NO: 63504 - DNA, 418 bp, Triticum aestivum
  Clone ID: PAT_TA_63504
ttttcgcgtccggtggagaagtgcctgagggatgccaagatggacaagagcactatccatgatgttgcgcttgttggtggttccaccagaatccccagagttcagcagctgctgcaggacttcttcaacgggaaggagctctgcaagagcatcaaccctgatgaagctgttgcctacggtgctgccgtccaggctgcaatccagcggtgaggggaacgagaaggaacaccaccatccccaccaagaaggagcaggtcttctccacctactccgacaaccagcctggtgtgctcatccaggtgtttgagggtgagaggacaaggaccagggacaacaacctgctcggcaagtttgagctctctggcatcccgcctgcgcccaggggtgttccccagatcactgtctgcttcgacattga

SEQ ID NO: 63505 - DNA, 351 bp, Triticum aestivum
  Clone ID: PAT_TA_63505
attacgcgtccgagccaggctcgctccccccgtcgcgccccagcttcccagcaccatccagatccgcgcctgctgccatggccgacccaggagacgagcagcgcgcgggcctgctcgccgcggcgtacctcttccccgtgcccgacggcgcgaccttctcctacgggacggtgggattccgtgccgacgggagcaccatggcccccgcggtgtgccgcgccggaatcgtggcagcgctgcgctccgtgaagctgggcggcgccgccgtcgggctggtcatcacggcgtcgcacaaccccgtcggcgacaacggcgtcaagatcgtggacgccgacggcggcatgatgtcgc

SEQ ID NO: 63506 - DNA, 248 bp, Triticum aestivum
  Clone ID: PAT_TA_63506
cttatgcgtccgctctcgaccaccccgccccagtaatattcttgttgctcggccttcactagccgcccaaccactccgaccaaggcgcaccgtaccatcacacgctcgacgggttccgacgtctagcgacgatcctctgctggtgctggtgctgcagggggctccgccccgcggctgaggggcacgaccagcatcaagaggggggcgacaacgcggcgggagctgcgacacatgcctctgcgggggac

SEQ ID NO: 63507 - DNA, 184 bp, Triticum aestivum
  Clone ID: PAT_TA_63507
tatcatagcactctggacattgcccaccgtgaggcccctaaagggttcctacagctattttctgcactcaacccaatgccctgtcagcttcgatgtatgcagtatgcacccagaagaaatatctctccagagtggcctcctatggagcgggcgctctctttggattgcttgatccttcgagcta

SEQ ID NO: 63508 - DNA, 220 bp, Triticum aestivum
  Clone ID: PAT_TA_63508
tttgacgcgtgggggacgcgtggggtccatgtcatgcccgcacgtgagtggcataggcgagctgcttcggcaggcgaggccggagtggaaccccgccatgatcaagtatggcctgatgaccaccgcgtacaacatggacagcgccggtggtgtcatccgcgacatgtgcaccggccaagtgatcacgctattcgcacgaggggctagacacgtgcacccc

SEQ ID NO: 63509 - DNA, 241 bp, Triticum aestivum
  Clone ID: PAT_TA_63509
ttcttctccgactacttcgagttcagcttcccccctggcgtcattgtgcagccgtacgtcgagagggtggtgctcgtgtaccacaacctgggcgagctctcggagaagtactacccgctccccggctacacctacctctcgcccattctcgggctgctggtctacgacgctgccaacttgtcagcggtggggttgtctgagctgagcatcgtcgcgtcagggagcccgatttctgtgagtt

SEQ ID NO: 63510 - DNA, 239 bp, Triticum aestivum
  Clone ID: PAT_TA_63510
tttctaaggactgactgccagcgcctgtccgtgatccaaatcctcccgggaaagttcttggttgatctcttcctcctcgaccgcctcccagggtatgctcccctgctctgattcttggttgatctctatggtctgttgctgatctgcagttaagttatgtattagggcccccttctagggagaggatctgtatgattatggatcgatcctgttcgtcttccgtggttctttcttaagcc

SEQ ID NO: 63511 - DNA, 380 bp, Triticum aestivum
  Clone ID: PAT_TA_63511
tctccagccaccactttcaagctcacaatcaagtcgatcacgacccacaggtcaagcaagcttcgttgctagcttgcttgtccggcgatttctgcttcatctagctaccaacgtgcggagatgccgaggtcgtccaagaagaagcagcggtcggcgtggggctcgctcctgggcagctgcctgggcgggggcggctggaagacggggaagcaggtccggcccggccccggcccgaggaagcgcgagtcgtcgtcggcggcggtgggggccggagtcgggcagcggctgtcgttcacggacgtgatgagcatgagcgcggcgtcggagcaggagctgtccgtgtcgctggttggctccaacctgcacgtgttcacggtcgc

SEQ ID NO: 63512 - DNA, 490 bp, Triticum aestivum
  Clone ID: PAT_TA_63512
tatcgtgttccagccaggagctatgcccaaggctgaacatgttgatgtcactgcacattgggcggttgtaaaagaggaagcatccggcaacaacggtgctgattggtttgacccaggcataggcatggggaacctgccgtcccttcggaaggttaaagtcagagtcgactctcataaaatgacggtcggggaggccaagcaagccaaggcagcgctggagaacgcactccgtgcccatcctaaccgtcccctgttttgcgtcgagttcaggtggtccataaaagaaggcgctcatgatgacgacctctgctagtgtggtcgcagcgaagaacgttcgtgcaggccgtcaatgtttactggagacgcgcttttgcaaactatatgcgtagcgcatgctgcaatattgatcaacgctcgttactcactgagcttatttcttggcttcacaaaaaaaatggaaaaattgtatgaaaaaaaaacaaacaaaata

SEQ ID NO: 63513 - DNA, 327 bp, Triticum aestivum
  Clone ID: PAT_TA_63513
ttacggaatacgggtggcgataaagcgggcgcagtccgggtcgatgcagggcgcgccggagttcaagaacgagatcgagctgctgtcccgggttcaccacaggaacctggtgagcctgatcggcttctgcttccagcaaggggagcagatgctggtttacgagttcgtcgccggtgggacgctgagggagaaccttgttgttagagggacgtacttgggctggaagaagaggctgaggatcgcgctcgggtcggcgagggggctggcgtaccttcatgagctcgccgacccgccgatcatccaccgcgatatcaagtccaccaacat

SEQ ID NO: 63514 - DNA, 284 bp, Triticum aestivum
  Clone ID: PAT_TA_63514
tacaaggaccccaacttcaataagattgagagtatgattgcaagggaagcactcattcaatgtgctgaggttctcgatatgtaatctaatggacatacagggccaaatgagtcacatttggcataatgctgagcccatcaacagatagccatgcctgtctcagcctcagtgctgctagattatgacataaaccggagatgacggggagcgcctccgacttccaccaaagcaactgtggccataagtcggcgatgtccacctcccggaggacgaggccagcggca

SEQ ID NO: 63515 - DNA, 373 bp, Triticum aestivum
  Clone ID: PAT_TA_63515
tcggacgcgtgggggccatagccagagagacccagcaaccggagcaagctccacaccggtcaagttcttgcaagagaggaaaaagaaatcgaagaggcagagatgggaagaaggagaagcccggctctgccgctgctgctgatctttggcgtcctcgccgtcgtcctcgcggctcttccctcctccacgcccgcccagcaccaccagcagcagcaccaccagcagcagcagctggatcgcgagcagtaccaccacccgccgtcgcaggagcagcagcagccgccgcatcagcagcacctgcaaatccaggtgcatcagcagcaggaggatgggggcggcggcgggggaaagggagcagcagcagcagcagcag

SEQ ID NO: 63516 - DNA, 372 bp, Triticum aestivum
  Clone ID: PAT_TA_63516
cttggtacttctgctctcactaactgaatacttctccccttcctacctttcgcccccgcgtcgccccgcaggggcggctcgggcggaaccctaaacgccgccaccgccgccccctctccctcaccccctctcgccgccgtcggcgctcgtcggtgggcaaagcccgttggcggccgacgacggcgggatctggcgctcgcgctggtcgggcacgcccctcgcagtggtgggtgttgtggagtttttggctgcgagatctggagctcgagtgacggcgcacggcagagcttcgcagtggggtggaggtgtgcggctggggctcgcaagaggagttggtcgcggcgcggtggtccctcctggagccaacgacac

SEQ ID NO: 63517 - DNA, 391 bp, Triticum aestivum
  Clone ID: PAT_TA_63517
tgtggaagagaaggtcttgttgacacagcggtcaaaacagcagaaactggatacatgtcccgtaggttaatgaagggtttggaagatctctcagttttctatgatcagacagtccgcaacgctagtggtggtatagttcaatttgtctatggagatgatggcatggatcctgtaaagatggaaggaaaaggtggcaatcccttgaatctggaccaattgtttatgaaagtcatggccacatgtcctcaaaggggacatgaaacattatctcctgagggaatctcacaaatgttaaatgataagctctccgaacaagacccctcagctggtggttgtagcgataggttcaaggaattgttaacaaaatttgtcgggaatcgcatcaaaatgc

SEQ ID NO: 63518 - DNA, 328 bp, Triticum aestivum
  Clone ID: PAT_TA_63518
tcccgctcgccgcacctaccctaccgcgagcgtcagagccgcacgagcgccgcggccaaagagagcttgcttgcttggcccgctccgatggcccgcgacggcgcgtcggcggagcggcgccgggtggcgctgcgggtcctgctcgcgcgcggcgagggctcctcgtcgtcctccccgccgccgcgggggcccgaggaggaggcgcggcggggcaagcagcagtggctcgcgctccgcctgcgcgacctcggctgcgcgtccgccgccgcctcccgggcccacgcgcccgtcgccgcctcggcctccgtgcgcccggccccggacgcgt

SEQ ID NO: 63519 - DNA, 400 bp, Triticum aestivum
  Clone ID: PAT_TA_63519
tcccacgcgtccgcccacgcgtccgcggacgcgtgggggtttgcactacctccatgaggaatgccatattgttcatcttgacttgaaacctcaaaatatattgatggatgctaccatggtaccgaaaattgcggactttggtttatcaaggatctttggtgagaagcaatcccaaatcatcactcaaaattgtcagggaacacgaggatacatggcaccagagtacataatccaaggcatagtctccatcaaggcagatatatacagtttgggtgtcataattatcgagatacttactggctctagatcatatcccctcagagaggacaatagtcgtgagtgtaccgacaagtctatccaacaattcaaagagcaaatacttgaaacttgggggaaaaga

SEQ ID NO: 63520 - DNA, 340 bp, Triticum aestivum
  Clone ID: PAT_TA_63520
tcgctctattaccagcttcggttccacgcgcgcccccggcgctgcgccagcgcccctcctcgccggtgccgcccccggtgaccgctggcccgggccggcagacgccgccttcgacacgtctacccctgccgccgcctggtcctccgcctgccggggcggtccgcctcggcgtctcgtggagccagatcgtccgtgcggaatcggcgggcagcgttcaaggccctggcttttcggtcccttttgagccggtggtgtcgtcggtgctctcgcgcacgctggtggatgatccagtggactgcgtcttcctggagtcaggtctggacttgtgggccctggagga

SEQ ID NO: 63521 - DNA, 313 bp, Triticum aestivum
  Clone ID: PAT_TA_63521
ttcttatggaccagattgcagtagttggtcaaaattggcctgatcaagccgaacaaaatccgatcttttatgaaattatgtggtggcagagcaggcaggcaggggtggtacctccaaggagaggatatacaggtacacctgagtcattatacaattttggaagaaacaacagagttcatgcacctggaaaaaaaggggccaaggggagctctgctaggggagattcagcaagtgccaccccatggtgcagggcgttggcgatggatgatcattactcctgagggggaatggggctgggcgtggcagcctgctc

SEQ ID NO: 63522 - DNA, 224 bp, Triticum aestivum
  Clone ID: PAT_TA_63522
ttcttcatgagaacctggtgaagctcgtcggctactgctccgactccgacagcaactagctgctggtgtacgagtacatgccccagggcagcctggagaaccacttgttccggcggggcagccagccgccgctgccgttgtccacgcgcgtctccgtcgccgtcgacgtcgcccgcggcctcgccttcctccactcccgcgacgtcatcttccgggacctcaag

SEQ ID NO: 63523 - DNA, 403 bp, Triticum aestivum
  Clone ID: PAT_TA_63523
ctgagcgccgccacgagtccttcaacaagctgcgcatcttccaggtgctcagcgtcgccttcctcgcgggcctcctctggtggcgcacgcccgcggcgcacctgcaggaccgcacggcgctcatcttcttcttctccgtcttctggggcttcttcccgctctacaacgccgtcttcgtcttccccctcgagcgccccatgctgctcaaggagcgctcctcggggatgtaccgcctctcctcctacttcgccgcccgcaccgccgccgacctccccatggagctcggcctgcccaccgccttcgtcctcatcctctactggatgggcggcctcgacccacgcccggcctccttcctcctctccctcctcgtcgtcctctacagcgtgctcgtcgcccagagcct

SEQ ID NO: 63524 - DNA, 343 bp, Triticum aestivum
  Clone ID: PAT_TA_63524
ttctcatcgccatggccgccgccgccgccgccgccgcgaggtcgcgcgccgccaccgccgccgcgtgggctcgcctgctctcccaccgccgcgtcgccgccgcagccgcgtccggatcgctgccccacctggcaggcccgcggatcgcgccccagcgccgccacttcgccttctcctccgcctcccccggcgccggcggcggggcgagggacagtgagccgctgttcaccgagcagaccgtctacgacctgctggcccagctggagcgggagcggcagaaggaacgcgaggatcggcgcaaggccggggccggcggcggcggcgaggggaagggggacgagga

SEQ ID NO: 63525 - DNA, 335 bp, Triticum aestivum
  Clone ID: PAT_TA_63525
ttcttgtcttacgctgctccattccatcatctcccccttgtattctccagagttgtgttcagtcagcacaagtcttgttcattcgttatcagcaactttgctccgtgtaagggtttatatctcgtgtgttttcttcgcaaaaaagtgctggtaactcttcctcttttaacattccccaagttgccaaatctagagctcaatatatagttgcaaatctcaacttgttagagaacaacaacgatcctaggttagtttgcaacgcttatcatttcgcaaggcacggttaactagaatactcgatcggctgcactaatttcccacgagcagattctcac

SEQ ID NO: 63526 - DNA, 301 bp, Triticum aestivum
  Clone ID: PAT_TA_63526
tgacagaggaccagctcacgggtttgaaagctcactctagttgggtcgaatcactggctatggacccaagccggtcatttgtgctggcagcatctgccgactgcttgatcaagctttgggactgggagaatgactggaccagcgttcgaacattcagtgaacactcagacaatgtgcagcaagtcatgttacaccagcaggaaaccaacacttttggcagtgtttcaaaggattgcaccgcaaaggactcgagcattacttctggtgattctttggccacattgagcagtaaatcacaaca

SEQ ID NO: 63527 - DNA, 250 bp, Triticum aestivum
  Clone ID: PAT_TA_63527
ttcgagatgccctactgtaacatacacacacacacaatttgctagctagctaatcgatcagccagccatgtcggaggagaagcaccaccacctgttccaccacatggagggcgaggacttccagcccgccgctgacggcggcgtcgacacgtacgggtactctaccgagacggcggtgaccgccaccgacaacgactgacatgacgagcggatcaccaaggaggagaagcaccacaagcacaaggagcac

SEQ ID NO: 63528 - DNA, 248 bp, Triticum aestivum
  Clone ID: PAT_TA_63528
ttccacgcgtccgcgggaaggagctctgcaagagcatcaaccctgacgaggccgtcgcgtacggagccgccgttcaggctgccatcctcactggcgagggcaacgagaaggtgcaggacttgctcctgcttgacgtcacgccgctctcgcagggcctggagacggccggaggcgtcatgaccgtgctgatcccgaggaacacgacaatccccaccaagaaggagcaggtcttctccacctactctgac

SEQ ID NO: 63529 - DNA, 459 bp, Triticum aestivum
  Clone ID: PAT_TA_63529
tttcggtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttttgctcccagcaaggatgct

SEQ ID NO: 63530 - DNA, 380 bp, Triticum aestivum
  Clone ID: PAT_TA_63530
ttctttaaatggtgtttgtgtatcatttaggtcttcttggaagtgtagcgccatgtgttctgtatggtagccatagtataggaatcttaaaactactgttggctggctcacacatgacatttttaatttttagtagacatgcctttgataagatgcattgttcagttctaattaagtaattatggaccttttgaattacgggccaagccccgtggtgtgctaaatgttgttatctacctaagcacctggacttttgtatgcagagggttatcagctattaaacagcatatgacaatcctgttctggccatctgatgtttgtatgtttgagttgttcgtgttcgttgtagtgcatgaggcgggatttattgtgatggctct

SEQ ID NO: 63531 - DNA, 205 bp, Triticum aestivum
  Clone ID: PAT_TA_63531
tctttcagtaaccctgttgatctgaaaccctatctgagctaagaccacagtagcttttatggtaacaccatttcttacaaacgccatagaagcttctatagtgacataaattttacagacgcctaagacacattcacgtgctgttagttctgagttggtcatttggacgatatctcgattctggacttggcctaccttgtttttt

SEQ ID NO: 63532 - DNA, 349 bp, Triticum aestivum
  Clone ID: PAT_TA_63532
ctccaagtctgggatagctcaagcgacggcgacatatccagtgggattcatttcatctcttctgcaatattggaggcatcagcacgcagaagccaaaggccccaagctggaggacttcctgagcgtcggctacggcaacgacaggagcagcggcagcgtctacgacgccagccacgccgaccagctcaagtaccaccaccaccaggacgtccatcacgcctatccaggctcgccctacttccagggcaatggctggcggtggcgccgtcatcgggctggacatcaacaacgcgccgtcgtcgtcacactgcaccggccttccggaccaccactacatgccggcgcacca

SEQ ID NO: 63533 - DNA, 244 bp, Triticum aestivum
  Clone ID: PAT_TA_63533
tcgcccacgcgtccgcccacgcgtccgcccacgcgtccggtgccgatgaagacgacaggagggggcagcggacaaccagccatgtccggacttgtgttcttcctcttcctcttttccctcttcactgccgctgcctcgacgaccaagcaaagccaggtctatatagtgtatctgggcgagcacgccggagccaagtcgaagggaaccatccttgatgatcaccatgccctcctctccgtcaagg

SEQ ID NO: 63534 - DNA, 198 bp, Triticum aestivum
  Clone ID: PAT_TA_63534
gcggcgcagttgctccgcgagcccttcgagcggttcttggccgacaaccgccccgacgccgtggtgtccgacagcttttggcactggtccgcggacgccgtcgcggagcacggcgttccgcgcctcgcgttcctcggcaccagcatgctggcgcggtcctgcaccgaaagcatgctgcgcaacaacccgctggagacc

SEQ ID NO: 63535 - DNA, 389 bp, Triticum aestivum
  Clone ID: PAT_TA_63535
tcgttgaagccgccgccggcgtcgccgtcctcgtcgagatcgtcgtcgactttctcgtcctcctcgtcgtctatggcgtctgggcaccaagaggatcgcagcagcgtggcatgcttgcccctgctccgcatgctcgaggaggggaagggggctggtggtgaccatgatcaccctgcacctccagtcaaggaagagatcatgggcagcggcgcggccgaggtgctggggcctggcgtggatctgaatatcggcttgccggttggtggatcttgcgatgatgacatcatggaggaggagagccaggaggaagatgatgaccacgactgtgacgaagaggaggaggaagagatggatgagttggaacctaaccatggcggttgcaaggtgga

SEQ ID NO: 63536 - DNA, 292 bp, Triticum aestivum
  Clone ID: PAT_TA_63536
atcggtgccactggacacttgactcgacggtcattgtccccgaaccttgatccacgtccgcccttctttctgggagggagggaggctgtcagccggccggccatggacactgcggaggcggcgtggggggtggcgagcctgcggctaggctctcgccggctaggctctcgctcctcgtaccgggagcgcggggccgacgtcttctcccgggcgttctccgcggccggggcgggctccgaggacgatgaggaggcgctcatgtgggcggcgctcgagaggctgccaacgcaca

SEQ ID NO: 63537 - DNA, 378 bp, Triticum aestivum
  Clone ID: PAT_TA_63537
acctgcatgcagccgccgccagcagctgcgcaaagggtccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttatcggcagaaggtttgctgatgcctctgtccagagtgatattaagatgtg

SEQ ID NO: 63538 - DNA, 318 bp, Triticum aestivum
  Clone ID: PAT_TA_63538
tgtcgtgattttctattgattgaagaggtagcaagtatggcttagaggcgaaattaggggagaggcgcctacggcggcggagatggctcccggcggcggagatggcctcggcggagcttgacgccgggagtgccttggagagggggagccgctgcccagagggagagcgcgttgttgaggggaggaattcggggaaccacatctcactactggatgtggacgacctcaaacgaagatggcttgccattacagagaaagctgggaagggagcaagtggtgcttcggcgaccgcaaaaagctgtagttggtaagatggat

SEQ ID NO: 63539 - DNA, 241 bp, Triticum aestivum
  Clone ID: PAT_TA_63539
tggtactcgtcgcgcgctgtgtgcaaatcaccgccatctaccagatgtttgattgtctttgattgcctctctagacatgctgtgatggcatacagacactctctcaattgatcattctcccctcggaggatgtcaaattctttgtgtgtgtttcggagtgctggggaaggggcagaggctggggcaggggagacacgttctttctcaatgccttgatgcatgagggtggtgtacatggtca

SEQ ID NO: 63540 - DNA, 271 bp, Triticum aestivum
  Clone ID: PAT_TA_63540
aatgccacgcgtccgccgcattcacatccacatccaaggatcaaacgcccgatcgaaaagcttctctccagcaagcagaggcaatcaggaagcctgcggcgatggcggtggggttccgtcgggcgctggacgcgctcacgtcgcccaagtcggccctgctggagtgcgcgcggcccaagaagctgtcctcctacgcgcgcgtccgctccatcagcctccccgtccgcctccacccgctggtggccgcgctgcacgactcggcgcgcgcgct

SEQ ID NO: 63541 - DNA, 320 bp, Triticum aestivum
  Clone ID: PAT_TA_63541
atcgttgacgcgtgggcggacgcgtgggcgagggtgggacgtttgctttgtattcactactctgcaggcatgcaaagatgagcctgcttccaaaccagcaagcggcagatgaagagctgtcaacatattatcagcctggggttgatcggactgctatgtcctcaccattcaaaaggtttctagagaagcacaagaagctgcggacatgtttgcttctttttgttctgcttggagcatgcatggtgataggtgatggcgtccttacacccaccatctccgttttggcagccttgtctggattacaagaccgaggcacaggt

SEQ ID NO: 63542 - DNA, 209 bp, Triticum aestivum
  Clone ID: PAT_TA_63542
tcggcggcggacggagcaaagcagagcgactcatcgagcgcagccgccatggaccgtgtgcagttcgtgctcctgggcctgcccatactcctattctgctccgacgtagtcacgctcttcgcgccgtatccgtcggcgggccccaagtcccaccggcacccccagccggtctgcggcgccttccagcctggcgactcctaccgctacgc

SEQ ID NO: 63543 - DNA, 400 bp, Triticum aestivum
  Clone ID: PAT_TA_63543
tcgcctacgcgtccgcccacgcgtccgcccacgcgtccgctcgaagtggtcatacagtgactagagcaggccctgttttaattctttttgggggcgaggataccaaagggaagaaactacatgaccttcatatgtttgatctgaagtccttaacatggcttcctttgaactataaaggtgctggaccttctccaagatccaatcatgttgctgcactttacgatgacagaattcttttgatttttggaggcgaatcaaaatccaagaccttgaatgatgtccatgctctagattttgaaacaatgttatggtcaagaatgagaacacatggtcatcatccatcacctcgggcaggttgctgtggagctctctgtgggacgaaatggtatatagcaggggg

SEQ ID NO: 63544 - DNA, 334 bp, Triticum aestivum
  Clone ID: PAT_TA_63544
tcgcttctcctctcccccagaaacgcccccgccgccgactcaatccgccctgctccgcccgcgactcagcccgccctgctatgcccgcgtctccagtctactttgcccgtggcgacctcgtgccgatctggccgccccgcggtcgggcacgatctggaggaccaacaggcggtggtgcacggtctgggcggcggcgacctgcgcggcccaggtgctgcaccgatgcctccttcctccgtcgcccaggtccaaggcggctctcttctagccaaccaccagccatgcgtcgccccctcctccttggccgactctctcctcctctagagaagtagca

SEQ ID NO: 63545 - DNA, 425 bp, Triticum aestivum
  Clone ID: PAT_TA_63545
ttcgttttcagatgctcagcttcaccctcgccatcaccattgtcggtgttcccgtcggtcttcctgccgtcgtcaccaccaccatggctgtcggtgctgcctacctcgccaagaagaaggctatcgtccagaagctgtctgccattgagtcgcttgctggtgtcgagattctctgctctgacaagaccggtaccttgaccaagaacaagctctctcttgctgagccttactgtgttgccggtgtcgaccctgaggacctcatgctcactgcctgccttgctgcctcccgcaagaagaagggtattgatgccatcgacaaggccttcctcaagtctctccgcttctacccccgcgccaagtctgttctgtccaagtacgccgtcaaggagttcttccccttcgaccccgtctccaagaaggtcact

SEQ ID NO: 63546 - DNA, 385 bp, Triticum aestivum
  Clone ID: PAT_TA_63546
cttttgattaatctattgatctgtctatggacaggcaggcatctatttggtttgacgctggtgttcaaccgttagttactactgtaccagcaaggccgcaaatataattttatgcattctaaaaatatatcatctagttcgagagctaggataaaatataccaacactgtagtttgttggttctttttgtgtgtggatcatctatgttgtgcgtttgcattttgagcttgatgcagtctatgttacagtcctgcaaattgaagcatacaaactactccctccgcttttgtttactccattattagttttgaccctagtccaactttataaagattgaccaagtttatagaaaatgatattaaatttcacaataactaatatatat

SEQ ID NO: 63547 - DNA, 157 bp, Triticum aestivum
  Clone ID: PAT_TA_63547
gcccacgcgtccgccacgcgtgcgcacaaacccattcaattcagttcctctctcacaatgaatttcgtacagatatacacccacattagagttagactcttcgggcttagttcgattgattttactgacatggcttcctcgcgtgccattatgatgc

SEQ ID NO: 63548 - DNA, 347 bp, Triticum aestivum
  Clone ID: PAT_TA_63548
cctcgcgttcgcccacgcgtccgctcattccttcctaccacccccggcaccaccagcccaagcagagccatggcgcccagcggagacaacaccgtggccaacgtccacagcggcatcgacagcaccaacaagacgctgctcaagagcgacgccctctacacctacatcctcgacaccaccgtgttcccccgcgagcacgagtgcatgcgcgacctgcgcctcatcacggacaagcacccatggggctacatgcagtcgtcctcggacgaggcgcagctgctggggatgctgatcaagatggcgggcgccaagaagacgatcgaggtgggcgtgttcacgggctactc

SEQ ID NO: 63549 - DNA, 192 bp, Triticum aestivum
  Clone ID: PAT_TA_63549
cctacgtgtccgtcgaaaaggagttaaatgatctgtattaccagctttgtcatgaaaggaatgaacggctacttgcccaaaataacccaggaggcttgccatctgcgtcctcagatgaccgctcgctgtcaacttgcatgtgtacatgggaagaacacatatcatcattgagggatttgaagtttggaggat

SEQ ID NO: 63550 - DNA, 106 bp, Triticum aestivum
  Clone ID: PAT_TA_63550
gcagcaccacccccacgtcacggcctcacgccacggagaacacaacgtcgatccggagagcggagcacgcaatggagcctgtggccgtcgtggcggtgccgttccc

SEQ ID NO: 63551 - DNA, 341 bp, Triticum aestivum
  Clone ID: PAT_TA_63551
tcgtgttgcccttcatacgaagctgatcggccacctctcaacaacaaagatgaagatagggaaggctcctgagctcctgaagaaggccgtagcgatgtgcaagagcaagaccaccaggctcctcatcctcgcctcgctccagcgccgcaggatgtccatgggcgttgtggtctctcgcaagatcggcgcgctcattgtggccgactgggagagagcggaccgccacaaggctctcgcgctacaaacggtggagaagagaccggtaatcatccaggagagtgacttggaggccaatttctctcgtcacttggcgatgttcggtcaagagaatggtcatggtg

SEQ ID NO: 63552 - DNA, 378 bp, Triticum aestivum
  Clone ID: PAT_TA_63552
ctttgcgtcagcatcagagcaaagaaaggatgcctccccctgccttggatttgatagccgctagctgattaagcttattacgctctgtcctaccagcagctagcacataaaaatatctccaagaaagagcggaaatcgcagcagcagcagcagcagcaccatcgtgctcagcttagtagcagtagcactgctatctctttcaggctttcagctaagcgggagagctcgctcgctagctgagggagtgccgcgcgccattaatggcggaggcggaagggcagctcgcggcctgctgggggaagcaggacgacgagtggaggaaaggcccgtggacaacccaggaggacaagctgctcctcgaccatgtcgcccagcacg

SEQ ID NO: 63553 - DNA, 201 bp, Triticum aestivum
  Clone ID: PAT_TA_63553
gtaaagggtccacgcgcgcaaggtcatcgtgtcgggggacgacgccgcgaggggcctggtccagctcgtcgacgaccatggcgttgccgagctcgtcatgggcgccaccgctgaccgcggatacaccaggaagttgcggacgccgaagtctaagaaggcggtgacggcgcatcggaaggccaacccctgctgcaggatctg

SEQ ID NO: 63554 - DNA, 179 bp, Triticum aestivum
  Clone ID: PAT_TA_63554
tgtctcggctgcaccacatggcggagttcaaggaggaggcccagctctgggtcgccgccaacgtggcgccgttcctcccggcgaccatgatcacgcacgtcctggcgggagacgacgtcctgtcaagctctcccggggccgcctactcgctggtccccgccatgctgaaccttcacgcc

SEQ ID NO: 63555 - DNA, 231 bp, Triticum aestivum
  Clone ID: PAT_TA_63555
gaaaaggacttatagtgtccgatgttccttatgccgagacatgtccattcagaaatgaagccatcaagaataacctagagcttgtgctacttacaacaccagccacaccagcagagagaatgaagaaaatcactagcgcttcagaagggtttgtataccttgtaagtgtcaatggagttacaggtccacgaccaaatgtgaacccgcgtgtcaaagatcttcttaaggaga

SEQ ID NO: 63556 - DNA, 248 bp, Triticum aestivum
  Clone ID: PAT_TA_63556
tttccttgcgtccggtataatattcacgtgaactgttcaagccttgcagatcctcccactgattactaccttgtctctgaatctacacaactgggcataatcatgcctgcttgtcactcggtaaacggccctctcgaggactacatctcccacattgtcgagtggctgtctcgaccacatgtgctggccataataatagcatgggctgtgacctttaccgctgattgctctttgatcctttgcttggg

SEQ ID NO: 63557 - DNA, 134 bp, Triticum aestivum
  Clone ID: PAT_TA_63557
ttcgtctggcaccgcacgacagacagcacgaggaaggcgagccaaccaccaccgccgcgagactagcaccacgagcgagctcggccgattccgattccgtctgcgctattaaggtttgtttggaggaaggggag

SEQ ID NO: 63558 - DNA, 219 bp, Triticum aestivum
  Clone ID: PAT_TA_63558
tttcccacgcgtccgtgcagcctcatgcctatgtggaaacggcagctggtaggaagccgcttgttggcgtccatggcgccctaggacataaggtgctcaggtggttcatggacgaccataaatgcgacactgttaaaatcatctccatggttggacccgttggggtggggaagacagctattgccatggaggtctaccgcagactccaaagtagaggag

SEQ ID NO: 63559 - DNA, 194 bp, Triticum aestivum
  Clone ID: PAT_TA_63559
tgtggagcaggagcaagaagaacctgggcagcaggagcaggaccgagatgaacggcatgtacccttctcagcgtttcagcaacgtgatagtcggctacctcaacctggtcacgctactggcctccatcccgggcatcggggcggggactttgctggccaagggcttcacgacgacatgctgctccatgctgcag

SEQ ID NO: 63560 - DNA, 394 bp, Triticum aestivum
  Clone ID: PAT_TA_63560
ttcgttcggctcaccactcatcaggttgctgccgcaagtatgtcaaacttgaggtgtgttactctgtttagaacagatgacaatctgatccggtcctctttcaagcctccaactgctgcgtgcgttggactctatcaggttgtgatcttcggaaaagtagctaccaaatctgatcttaggtgtatggagaaattattacacctgaggtacctagggctactagatacacgggttgatgctctccccattgaaataggaaaacttcaatctttgcaaacattggacttcaggacaagtaaatctttggaggcaccatcaagtgttgttcggctaggaaagctgatgtgcctatatgttaatgagaacatgaggttaccggttgtgatagacaact

SEQ ID NO: 63561 - DNA, 162 bp, Triticum aestivum
  Clone ID: PAT_TA_63561
tgctaggtcgaagacaagatagtctccgtgctcatccatcatcttccatggcgccgctgcacttcctggtcgtcgcgttcccgggccagggccacatcaacccggcgcgcgctctggctgagcgcctcgcgcgggccacgccgggcgcgcgggtcacgctct

SEQ ID NO: 63562 - DNA, 227 bp, Triticum aestivum
  Clone ID: PAT_TA_63562
tggattgcctttgtggcctccttggtagccatcatccttgtccagacggatattctggtcaggcaccacgtgctggaggcagccatgatactcgatctgtttggcctcatcggcgcgtatgccgccgggagctgccgggacgtgaacacctccatttatgccatagctttggcaggcgccgtcctggtctatgtggtgatccatatcgtcttcttcacgctggacca

SEQ ID NO: 63563 - DNA, 227 bp, Triticum aestivum
  Clone ID: PAT_TA_63563
tgcatggacctcttgaggaagcgcatggagccagaggagaagtgcctgagggatgccaagatggacaagagcactatccatgatgttgtgcttgctggcggtcccaccagaatccccatagttcatcagctgctgcaggacttcttcaacgggaaggagctctgcaagagcatcaaccctgatgaagctgtggcctacggtgctgccgctcaggctgcaatcctcag

SEQ ID NO: 63564 - DNA, 189 bp, Triticum aestivum
  Clone ID: PAT_TA_63564
ggagcctgacacgagggccctcaactaattgcgagtggattgatggctcacgggtgaactctgaagtggagcctaaactgaggagtctcctactcgagatgggaagcgacaaaattttgggactacaagtatgtgcatacaaagacggaaaggtcataatagacaccgctgctggtacattagggaaat

SEQ ID NO: 63565 - DNA, 240 bp, Triticum aestivum
  Clone ID: PAT_TA_63565
tgcacaacgagccacacaaaacaaacacacacgagcattagttagcttgggtgctccagcaatggcagtgacggtggagatcacgcagagaacggtgctcgagccctcacgggactcggcccgcggcggcggcaagaaggtccctctcaccgtcttcgaccgcgcctccacggacggctacatcccggccgtcttcgcgtggaacgcaccggcgccgaccaacgacgcgctcaaggccgg

SEQ ID NO: 63566 - DNA, 147 bp, Triticum aestivum
  Clone ID: PAT_TA_63566
ttgttttatgggggtccctcaccgttgaccgttcccttcaactaaaatagttccacatgtgtactgtttttagataacatggaaaataacattttatgtaccaagcaatattgctttgctgtcacaaattaaagatcatttcacgtt

SEQ ID NO: 63567 - DNA, 305 bp, Triticum aestivum
  Clone ID: PAT_TA_63567
ttcgtttgaccagaagaagatggagacgagccggcgcggcgggttcgcggacgaggccctggcgcccaccgagtcggacatcgacgagaccttccagcggatggtgggcgggctgggcaagacgccccaggaggtgttcgacgcgctcagggcgcagaccacggacctcgtcttcaccgtgcaccccacccagtccatccggcggtcgctcctggagaagcacgccagcatccggacgtgcctcacgcagctgtgcgtggagggcgtgtccgagaacgagaagcaggagatcgacgaggccctgc

SEQ ID NO: 63568 - DNA, 288 bp, Triticum aestivum
  Clone ID: PAT_TA_63568
tgcccacgcgtccgcccacgcgtccggccagctgtcagaaaaaataggcaatctgaaatccctctcattcctatcacttgttaacaacaatcttacaaatatcacaagtacacttccgatacttgcaagatccaagagtctcaccacccttcttattgggctcaacttcatgaatgagaccatgccagacgatgacatcattgtcagttttgagaatcttcaggttctagcaataacagattgctcactgttggggaaagtaccacattggttatcaaagctgacaaa

SEQ ID NO: 63569 - DNA, 408 bp, Triticum aestivum
  Clone ID: PAT_TA_63569
tattgatttcagccacaagaacaagcttggccctatagagagcctgaagaactatcccagacaaaacgggccaaagcttacaatgcagaacatgcatgaggcaaagggggccaacacagaaattagcacccatgggaataacgaggccccaggtgtcggaaccgttagtagcagtctgcagaatgccgtggcacaaaataactaccagagtatgctgagaagctcaagtgcaaaccagggtttgcttcagcaggaggcgtcacagaatgccgcagcactaaacaattaccagagtatgcttagaagctcaagcgcaaaccagggtttgcttcagcaggaggcgtcccagaatgccgcagcactaaacaattaccagaacatgcttagaagctcaagcgcaaaccagct

SEQ ID NO: 63570 - DNA, 149 bp, Triticum aestivum
  Clone ID: PAT_TA_63570
tgctgccatccaaacagcccccaaatgcgcgcgcctctcacatgccagaccgctgctgagcctggccgacatggccaccgcctcgatcgccgtccgctcggccttcggtgtcgccctggccgccttgatcgcggagcgtgccccccggc

SEQ ID NO: 63571 - DNA, 344 bp, Triticum aestivum
  Clone ID: PAT_TA_63571
ttcccgctaggtccagatccacgacgcagagaaaaggaaacaatccactcttcacggtcagtgcgcttggccaataatcagcttgtccatttgcagcttcctatttactgtcagtgcattcagcaacctgtcctccatgcacagttgactgaccaagctctgagctagcatggccatggaggcggctcttgtcagcgtggcgacgggggtcctcaaacccgtcataggaaagctgaccactctgctcggcaatgagtacaagcgtttcaagacagttcgcaaggagctcaagtccctcactcatgaacttgctgccatggaggcttttctcctcaagatgtctg

SEQ ID NO: 63572 - DNA, 362 bp, Triticum aestivum
  Clone ID: PAT_TA_63572
ttcgattcccgccgcctacgccctctgccgccgcagccgttgccatgggcgcgtacaagttcgtgtcggagctatggaggaggaagcagtccgacgtgatgaggttcgtgcagcgcgtgcgttgctgggagtacagacagcagcccgccatcgtccgcatcaccaggcccacccgccccgacagggcacgccgtctcggcttcaaggccaagcaggggtatgtggtctaccgtatccgtgtgagacgtggtggcaggaagcgcccagtgcccaagggtattgtttatggcaagcccaagcaccagggtattacccaacttaagttccagaggaacaagaggtctgttgcggaggaaagagct

SEQ ID NO: 63573 - DNA, 385 bp, Triticum aestivum
  Clone ID: PAT_TA_63573
ttcagcactgtggcctctccctcgtcctgtcggctgccaccattgctgtttgttccgggaggagctatgacgaagatgaccagccagccatatggtccttgatgtcatcggggagattgtatacatgattgatctgatcataacaagttgggtgcctaattcttgtccaagctctaagaggcttctgtctgtgttggtacatgtaacatgttgtcggttaaccaagagaattacttcaattgcctttttcacagagggcggaatgctgacttgaccaaaatgttagcaaacataacaagctggcacccaatagtgcttttaacagaacggaaggaggaaacaggaactatccctttacattttaacggaaggaggaacggaagga

SEQ ID NO: 63574 - DNA, 329 bp, Triticum aestivum
  Clone ID: PAT_TA_63574
ttcacgcgtccgatttcaaatcatcaattgtcccaacctgacaactttgcctgaaagcatgaagggccttacttctttaacatatctgtatataaagaagtgccaagaattagctgtgttgccacaaagcctagggcagctcattaccctgcaagacatttccatcatcaattgtcccaacctgacaactctgcctgaaagcatgaagggccttacttctttaacagagctttggatagaggagtgccaaggcctagctatgttgccagaatgcctaggacagatgatttccctgcaaaaaatttgcatcatcgattgccccaacctga

SEQ ID NO: 63575 - DNA, 302 bp, Triticum aestivum
  Clone ID: PAT_TA_63575
tccacgcgtccgcccacgcgtccggcacggcccatccgtcgagatgaaccacgtgaagtcggctcttctgtgaggccaccgcgcgcaccggctcgcggcggcggcgccgcagcagctggcggccaccgcgtcgttccactccacgcctcccctgcagcggaagcgcaagacccagtggcggcacaggttcaatctttatgcaaaacgcatgagaaatagagacacaaaatgaacaatgatacggaatatgcctgagtatgcggagcagctcttcaatagttggcgtgatgaagatgagaaaa

SEQ ID NO: 63576 - DNA, 389 bp, Triticum aestivum
  Clone ID: PAT_TA_63576
tctcaatgcgaggtgcaagagagcatgtgttgttctatgtctatcctgttaaatcctataggggaacgacattgtaagcttggttagtttgatgtcctacggagaagcaaaattgggcgtgcccaccgccagaagattcatctttgtactctcttctccatttatcagtgcaacgagaggcagagttagtcatggtgatgatcatattgtattcttatgatgcttgcagactgggagtgtatttatacttcatgcttatgagttatgatgaatcatttctatggcattacatacagtcagtgggaaaaggtcattagggactagcatgtttcactattgtgattacaaactaaaacttgtgcaagtatgataaatgggtgcattgatct

SEQ ID NO: 63577 - DNA, 306 bp, Triticum aestivum
  Clone ID: PAT_TA_63577
ttcacgcgtccggaaatggtgagtcgtcagcgcgccactcacacgcacggcctccgttgtcttaatctcgagattaaaccggaaagcaaactctaataaatcccccacccccggatcgacaaagcttcccattcctccgcatcggcaggcagcagcaaaacaacagcccaatcgagggtcactccacaccaccaccactctcttcccccaatcccctcctcctccccgaaaccctagctggaatggagcccaaatccaccacccctccgccgccgggccccgtgctgggcgcgcccgtcggctacc

SEQ ID NO: 63578 - DNA, 309 bp, Triticum aestivum
  Clone ID: PAT_TA_63578
tccgcgcgcggacgggtgcgcttgccgggcagaggaagtcgagagggcccacgatggggacatcgggcggctgcgcgcgcaggaggggagtggcctagaaggcacaaccatcgacgggtgcagcgcagccggctgcggaaacgcgcaaggcgcagtcagcacgagacggcgggaggcggcgagcagcggggaaaatcgatgctcgtagagaggcggagcggcatagaagcggcaagccggcttgtggagtggcgatgaaggcggcctgcgagctacggcgggttgggccaaggcgaggttcagcaacgc

SEQ ID NO: 63579 - DNA, 346 bp, Triticum aestivum
  Clone ID: PAT_TA_63579
taacactcagtctgatccaccgccgccggcgctagcttgcaccaacatccacgtcacttcagttcgtaaatcatagaatgcctagcgatgatgtgccaccatggcgacattggagacatgcattgactaccagagacaaggacctactcgacacatcctctggccctctgttcatgctgccaaggagagaggagttgcttggtccaacttgtttcggcctcagatctgctacggaaaacttgttgagaccctgttgtccaacggacttgtgtcggcctgcagaagtttggtggaacgaaaatgtacacctaaatgacagtgttgttcaagttttctttttggcagg

SEQ ID NO: 63580 - DNA, 395 bp, Triticum aestivum
  Clone ID: PAT_TA_63580
gttgccctctctcctttatcccgtctttggccccgccctcgccaactcccgacgctccgccgagtggagaaccaggaaggaggagggacgtgaagtggagaagagggggtgcgctggagaaggagccaagcctgcaggagagcacggagtgccggcgcgccgtgcccgccgcagctgctcgtggagatccggcatgtgctgcaccatggaggcgctcgtggagggtttgatgtcgaggaggttcggttcctacaccaatggttacagcgggctctgctgcagggagtggaagttttagaatgctgcggacaggttgagagcaatagatgttttttaagtcctaggacaatttgattttgggaggacaaaggtcaggcaaggatgagaatgggata

SEQ ID NO: 63581 - DNA, 345 bp, Triticum aestivum
  Clone ID: PAT_TA_63581
ttcgtctctgccgatacttcacacaagaaagatgagatcgccggcaactcttccactactatcttccgatcgtttggtcgccatggcgccgtgacctcgccgtgcttcagcgatggccccgcgctggacctctgatgaccagacaagacggaccgaccgcaccgtgactccgacagccactccgtggtggtaatcagtggagtgccgccaccgtcgatcaaaatctttgacctcccgcatccaccgccagttctgtctccctgcaagcaaatctcagccgccattgctcagcttctgagcagcggagcggatccgagatggagcccatccctctgctcacgccgt

SEQ ID NO: 63582 - DNA, 422 bp, Triticum aestivum
  Clone ID: PAT_TA_63582
tgtctcacgcgtccgcccacgcgtccggcagctcacaacctgctcatacttaatactacttgctgcagttattcagatattcagagttccctacatacttgctgcagtttcagaaaaatgcttaatgtcagagttgattctctgctcgctgctctgtgtcatctgcacagattagttacatgcttgtaggacaacacatggaaatttacatctggcttgtctgtactaaccattgaaaacaagcaacacctgaaacaaatatgcaattttactatgcatatgctcatctcgttatattcagagttcaatatatacttgctgcagatacagaaagtgcttcatgttagagttcagtatatgtatcatctgcacaaattggtttcctattcagattatatgcatctgctaggctttattatgta

SEQ ID NO: 63583 - DNA, 347 bp, Triticum aestivum
  Clone ID: PAT_TA_63583
ttttcgaagaagacaaaaatttccatgttgttctcaattctgttattgctggtcgttaccatgtcacggagtatttgggatcagcagcgttcagcaaagctatccaggcacatgatttacacacaggaatggacgtgtgtgttaaaatcattaagaacaacaaagattttttcgaccagagccttgatgagatcaagcttctgaaatatgtaaacaagcatgaccctgcggacaagtaccaccttctgcgtctatatgattacttctactatcgggaacatttgttgatagtttgtgaacttctgaaggcaaatttgtatgaatttcaaaagtttaacagagaatca

SEQ ID NO: 63584 - DNA, 275 bp, Triticum aestivum
  Clone ID: PAT_TA_63584
tccggcgtcagtcgccgtcgtcgtcctctgcatcgccgtgggcgcgctgctgttcttttcttcagaacgagcagttgcccgcttgcctgcatcttcgttgaccgagcacgatgccttagcactcacgtttgggccgcttctactccggtccagctgcctgcctcatccagcgcccccgtgggccttaggcaggccggacaaccgcgcctctcctctgcttcctgccgggctgaagcccatggtccgtcgggcgatgatgtctgcgcgacgaggac

SEQ ID NO: 63585 - DNA, 350 bp, Triticum aestivum
  Clone ID: PAT_TA_63585
tctcatttctctcctcctcctcctgccaccgatcccgatccagggaggaacccggcgcgaggcgggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcg

SEQ ID NO: 63586 - DNA, 410 bp, Triticum aestivum
  Clone ID: PAT_TA_63586
gggtgtgtcaccgccagcgctacgaccgacgcgacgccaccatgctggtcaagtacccgattatggatctgtcgatcacgcgcgactgcttcgcgatctgcggcggcggcggctcgctcaagtcgggcatccgcaacactgtggacatttacgagctctcggacacggacccgagcgggttcgagaagaccatcacggccgacacggggctcgagctggcctcgggcgtggcgttctcccatgatggccaactcattgccgtgtctgtgaacgcgtcgtgctggatctacgcgctggaccgcgaggcgaaaacgctcacgctgctggtcaagttccgctcggactttgccgacatcgagagttcccagacgtcagtgtgctttgtgggcaacagcacgctgctcacgggc

SEQ ID NO: 63587 - DNA, 387 bp, Triticum aestivum
  Clone ID: PAT_TA_63587
cttacgcgtccgggattcctgctccgcctcccccgccggggcggcggcggcggcggctgcgcctgctgctggtgctgctgccgccacggaccggtacacgttcaggccggggctgcggtggcagccggaagtggatgagtacttcgcctcggcgtacggccgcgagcacttcgcccgcatctcccaagccctcgcgcatccttcttgctactcttgcatccgtgtgaatactctaaagtctagcactgatactgtcatgcaaaagctgctgaaattggtaaatgagaatgaactttcttgtggatttaatggtttgaagatcggtgagcagaatggtggagagcaagcacatgaagggagttacctggtgcacaaatgcccatattc

SEQ ID NO: 63588 - DNA, 453 bp, Triticum aestivum
  unsure (1)..(453): unsure at all n locations
  Clone ID: PAT_TA_63588
gtttatctgtcctccggttggacggacggatggatggatggggcgggccctgagcgcttccatgtggttttcgcctgctaaactctgttggatctatacaccttagaccttgtatcgcagttttgccgctcgatccgtgactcatgattcatgagctatacaccttagaccttgcatacatttgcccctatcatcagtataatgattcaaccattgctacccatccattccattccagccaaaggaagagtactagtatgcatttcttgtggtcatataagtattgttgattgatgattcgactgtattcttcctgctagatttggtcagaacaggtgcgggctgataagggttgctcggggttaatgccaaaaacgtagtcatgtgctgagttgcgctacactnttctgtttttatttaccaatacatgtccccaaagatttactccatcac

SEQ ID NO: 63589 - DNA, 425 bp, Triticum aestivum
  Clone ID: PAT_TA_63589
gttgttccatgacaaagtgggtgcctcctctcggtctcaggttctcacttcctcctcctgctgctggcggcagtgattgctcccgtccatgcctatggcaagcttaaggtcgggttctacaggcaatcatgccccgacgccgaggccattgttcgcaggatcgtcaccatggctgtggaagatgacctaacggtcaccgcgccgctgctaaggctccacttccatgattgcttcgtcaggggttgcgatggatcggtgctgctcaactcaaccaagaccaacatcgcggagagggacgccaagccgaacctcaccctggacgccttcaacgtgatcgacgccatcaaggagaagctggagaagaagtgcccgggcaccgtctcctgcgcagacatcctcgccgtcgccgccagagacgcggtctc

SEQ ID NO: 63590 - DNA, 393 bp, Triticum aestivum
  Clone ID: PAT_TA_63590
cttttgtgtcatcgtgctctggttcccgctcggcattgagccgtgtgacatcaagtacaggaccgagacgtgcgcgacgatccagctcacgcgcgcggccaacatccggtgcggagacaaaccattcaacggcatgtggaacccgcccgagtggtaccactggtcggccggcatcaaggaagtccagtgcttccgcgagcccgtactcgcgcactgggtgtcgtactttctcttttacttggccgagttcatctcgatcatgctgggcttcatgtactatctcggcatgtggaagcccgtgcgtcgtggtgcccagtacctcaaggattttgcaccgcacttcccgccgtccaagtggccaaccgtcgacattttgctctgtcactacgctga

SEQ ID NO: 63591 - DNA, 377 bp, Triticum aestivum
  Clone ID: PAT_TA_63591
gtttggtgggccgaggcggggcggagacggcggagggaaggtggcggaggggaggcgggggcgtcctcgccggtgtttagcaacagagatggcgtgcgccgagtcctccgcgaggagagcttgtaagcaggaggcatgcttcacagtgccggctgcacgcaggtcagatgtcggtttggagaggagctcggcggagctgcgccgtcatgtccgccaccagcaagcttcagtcggtgggtgcgacggcagtcggcggcgccattggggcgcaaggaaggtgatcatgtttttattgagttcttctctgccaagaggaacaacagggacacaagccttatctaactatagtacattttctttatgtatagatgattcac

SEQ ID NO: 63592 - DNA, 271 bp, Triticum aestivum
  Clone ID: PAT_TA_63592
tttttccttccatccatccccatcgcatcgcaaccgccgcatcggcgagtgagccgcgccagcacggtgctccgagcctgcctgcctgggcgagcctcggcgcgggcggtggccgggttagagagggggaggggacgaggagatcgagggagagagggaggcgacgcgatggcgcgggagcggagggagataaagcggatagagagcgcggcggcgcggcaggtcaccttctccaagcgccgtcggggcctcttcaagaaggccgaggagc

SEQ ID NO: 63593 - DNA, 400 bp, Triticum aestivum
  Clone ID: PAT_TA_63593
tttacgcgtccgccgtaccattcttacctcaaacaaatccatcgactctgaatcccatcgctccaccatattaatttgcatctctgtggtgttggcgatgccatcaagcgccagggaggaagatcgtaacgcacccgttgtgaggaatgctgctcctccactggttgcctcagaagccaagatgattgtggccataggccatgaccattgccagcagttgaaggatgtgttgagcaaggaggatccttcgaccatggtagtggtgatggcctcaagcaaccagactcctaagccgcccaagcctcgctcgccggtcatggattccagactgctagcagtggcctgctctggttcgtggaagaaactgcaatcatttctcagtggggaagaccgtcaaacc

SEQ ID NO: 63594 - DNA, 487 bp, Triticum aestivum
  Clone ID: PAT_TA_63594
ttcacaatcattgccatattagccagaggcgctatacttactataaatgctggtatttatgggtgagttggttaagcaatagttcagctatcccattgagtgtggcacaatcatttcactgtaacacattatacacatagtacaaacatacgtagattatcccaagttattagtaatgtcccaacactgcaaataacagtttttacctgtaactgcatctgtggtatggttttaaatgcgggaccagtccttaaaatgtacatccacagtcccttttgtgcctatattccgcacatcacccttataaattcttctggccacagaatcaatcccaaagttattaataatgactcaacactgcaaataacagttttcgcctgtcattgtgattgtgatctggtttcaaatatgatattagtccttaaatatacatccgcataattttgttattagccctctcgtgcatatatgctgcacatcattcttc

SEQ ID NO: 63595 - DNA, 373 bp, Triticum aestivum
  Clone ID: PAT_TA_63595
ttcattcgtccgcggacgcgtgggttccttccatcgaggcaaggcagatccagagtcacggagagatatatagaagtagaaagatctcagctgcaaacggggagtagtgatagtctagattctagaggacatggcggcacttgtcactccggctgcttcagtggtgtccgggctggtggtgcggggccgggagtccgccgccctcctcgaggccttgctccaggggggctcgccgcaggagcacggtgggatccgggagctcgccgcggagatccttctctgctgcgaccgcgcactcgccgcgctccacggccgcgacggcgtgcacgcggacgcgctcgccagcaggaagcgcaagtcgtctgagcccgac

SEQ ID NO: 63596 - DNA, 409 bp, Triticum aestivum
  Clone ID: PAT_TA_63596
ttctttgaaggaggaggagagcatatgcctacgtttgtctgtctggccaaccaaggagggagggaggatgcagaggtacaccactagggacatatgggagatggaggaccgccagagcccgcgcatggggtgcagcgtcgtcctcggcgttgacggcggcgccagcaacaccgtctgcgtctgcatcccggccgtcatgcccttcgccgacccgctccccgtcctcgcccgcgccgtcgccggatgctccaaccagaactccgtaggagaggacaaggcgagggagacgctggagcgagtgatggcgcatgctctccacaaggctcgccggagacgatcaaacgtgagcgcggtctgcttggccgtagccggcgtcaaccaccccatcgaccagcacagaatgctggac

SEQ ID NO: 63597 - DNA, 225 bp, Triticum aestivum
  Clone ID: PAT_TA_63597
tttcgaaaaacacaccagagctcacctgtgccctcgctttctggcgaaaatgtcgactgaagtggctgccggtgacataccggtgcctgaggtggaggtagcctccgacgccgacggtgacacaccggcggcgaagccgggcaaggcgcccaaggcggccaaggccaagaagtccactggcccgaagaagccccgcgtcaccccggcccacccgacctacgccga

SEQ ID NO: 63598 - DNA, 388 bp, Triticum aestivum
  Clone ID: PAT_TA_63598
caaaccgcaaaaaccattggagcatcctctgtcttcctcctctgcctcctccttcctctacgtcttcctcctccacccccttcctcatctcaaccccacttcaactacagatccacctcgacctcgagcggcttcccatggcgtcgccctccggaaaccctaatcccaaccccaaccccaacgtccccttcgagctcagcaggctcttcaagcctcccccaaaccctaaccaccccacaaccgtgccgacccccactggcatcttcccgggcgccccgcccggcgcgccgatggtcaccgggccgccgggcccctactcctacccgcccgccaccccgcccttccaccgcaaccagtacctcaactaccccaccgatcccaacgccgt

SEQ ID NO: 63599 - DNA, 427 bp, Triticum aestivum
  Clone ID: PAT_TA_63599
tcgttcgccggccgcagtcgtgcagcgatttgcttcgcggcgccagtccagtctgcagtctgcatggcgtccacggccgcgggcctctacggccggctcaacaggaccagcacgcgcgcgttcctcgcctacgtcgccgccgggggcgtctgcgccgccgtcctcgcctgcttcgtcgtctcctccgccgaccccgccgccgcacccaatggcgcgccccgcctctcctcgcgctccgcgcgcgtctggcccgatctcgagttcaactggcggctcgtggtggccaccgtcgtcggcttcctcggctccgcgtttggcaccgtcggcggcgtgggcggcggcggcatcttcgtgcccctgctcaacctcgtcctcggcttcgacaccaagtccgccgccgcgctctccaaatgcatgatcatggggg

SEQ ID NO: 63600 - DNA, 277 bp, Triticum aestivum
  Clone ID: PAT_TA_63600
tggacgcgtgggtttcctctcccctcctctcctttcgcatccctccttccatccatccccatcgcatcgcaaccgccgcatcggcgagtgagccgcgccagcacggtgctccgagcctgcctgcctgggcgagcctcggcgcgggcggtggccgggttagagagggggaggggacgaggagatcgagggagagagggaggcgacgcgatggcgcgggagcggagggagataaagcggatagagagcgcggcggcgcggcaggtcaccttctccaagc

SEQ ID NO: 63601 - DNA, 283 bp, Triticum aestivum
  Clone ID: PAT_TA_63601
tcgttgacgcgtgggcggacgcgtgggcggacgcgtggtggaagctggctgagagtgacggagtctgtcctctcttcttcttcttccacctcgcacctccttcttgttgttcccgtcacggtgcagcaagcaaacaaaccaacagatcgacacagatccggtggcctcacctcaccggatctccccgttccttctcgtcttgctctcgactcgactggagtggaagcaaagcaaaggaaagcaattatcttgactgattgatggggaagaagcccaagtggct

SEQ ID NO: 63602 - DNA, 106 bp, Triticum aestivum
  Clone ID: PAT_TA_63602
tatatgtccggccgtagcgggtgatagccccgtacacgtagaacactcattgtccttgagtaaggcgggacacgtgaaatcctgtctgaacatggggagaccactc

SEQ ID NO: 63603 - DNA, 380 bp, Triticum aestivum
  Clone ID: PAT_TA_63603
ctccaggcattcttttttcacaatgaataatgtctgctcttcgactggagcagttcttccctgttggtaatcagaggatacatgctactaattcttcaactgaaattaattttcagtttgatccaagagcaaatcatgaacctcaagttttcttagcacctatgccaaagagaagaagattgttgcttctggttgtgagtgaatctaagagttaacatggtacaatatcttctcgaagatgatgtattccttcataaaaaaggatgttcgagaagttattattgaagaggagttcagtctcatgtgattctcaagagctaaaatggaacaagaagtgcaggcctgtcatgtctacactaactaatcagaaaaaacgtggt

SEQ ID NO: 63604 - DNA, 309 bp, Triticum aestivum
  Clone ID: PAT_TA_63604
tcgtttgcaggcaactccactaccctctcccgttacagtcggcggcgcgatggccgagacggaggacttcgcgagcggtgacggggaggtctggcgtgcggagctgggcgcgtacgaccggcggatcgcggtgctggacaagcccgacctactggacgccgactacttctaccgacacgacctccccctcctgctgcacggtcgtgacccggacccctacctcgccaagcccgagctggtgcagttcatgcagtggaagctctatcgcgggaagcggaggccgaggctgatggatttcgtgaaaagctt

SEQ ID NO: 63605 - DNA, 218 bp, Triticum aestivum
  Clone ID: PAT_TA_63605
tcgttggctgagggtggtggcgtggagggctgctgggccttgcggggcatggtgcttgggggctggcgtgcttggatgcggtggtgggtgcgctcggagtggcggcgagggtttcccagatctgatctggacggtggtggatcctccggccgcttattcgcgggcggcatgggctgcggcggattgggcctgccagcggcgcgcgggggttgctacgc

SEQ ID NO: 63606 - DNA, 280 bp, Triticum aestivum
  unsure (1)..(280): unsure at all n locations
  Clone ID: PAT_TA_63606
gcggccagaactaaaangggcatggttggatttgaagaacatgtcgatgcgtggacgccgtttcttcctgaggagaaggaaacgctatcatctacagggagtaagagggagcatgaacggggaatcaacacggccatggatgatctgctatctagagggagccctcttctacaggttccatcccaaggtctgcatatccagtatcctctccccacgcacacaaggtgtgcgtccatctgcctgaaggcaacgatggaggcagaaaagagccttcaggagg

SEQ ID NO: 63607 - DNA, 332 bp, Triticum aestivum
  Clone ID: PAT_TA_63607
ttaatatttggtggagaaggagcaagttcagagaaccagtctgctgaggtgactaacaaaattttaaagaaatgtggtggtgtgcctttagcgatcattacaatagctagcttgcttgttggtaaacgatgtgaggattggtctaaggtgtatgatgccattggttttgggcatgaagacaacaaagttgctcataacacaagaaagatattgtcttttagctattatgatctaccttcccatttgaagacctgtttattatatctaagtatgtctcctgaagatagcttgattgggaaaaggacactgatttggaggtgggtctgtgaagg

SEQ ID NO: 63608 - DNA, 253 bp, Triticum aestivum
  Clone ID: PAT_TA_63608
tttcctaccacgcgtacgcccacgcgtccgaaagaaagaagattgcgaaggctcagaaaatgacaaggccaagaaagggaaagataagaagagcgagagcaaagagaaggataaaaatagcgccaaggagactggacctgatgcagatgacagttgccccaagaacaaaaagaaggataaggacaaggcaaagaagaaggatgaaagcgatgaaaaacaagagaaagacaaagactaggtggaacatgagaac

SEQ ID NO: 63609 - DNA, 297 bp, Triticum aestivum
  Clone ID: PAT_TA_63609
gactggcaagggctcaccattatttactcttcctaataaaaatacaaatcatgatctacatctgcaatcgctctaacccttccatctagctacatttctaactagccctatactaaagacaagcagacaactacactaaccacattagcttcgtcccagctaccatcggtgtcaggtactccgacttgatacatccgtatttagacaaatctaagacaagaattttgggacggagggagtaacatctaatctaatttgtcgaaggcgccttctgctcgttactcttccccagcccca

SEQ ID NO: 63610 - DNA, 212 bp, Triticum aestivum
  Clone ID: PAT_TA_63610
ttcctcccgtgcccgaaccccagccccagctccgggcaggcgccccgcctcgcccacccgcgcctcgcgctctcccaccgcatggcggcggcaccagcggcgatcgccgggccctccggcgactccgagcgcgacctgagcgcgtccgcggtatcggtagaggcatttggggccgtcgaatcctcgggcgatggttcggggaggaaggagcc

SEQ ID NO: 63611 - DNA, 194 bp, Triticum aestivum
  Clone ID: PAT_TA_63611
gggctggcctaccgctacgtgggggacgtgcttggggacgcccaggtctacgccgaccacgcggacaagccccagctcgacgccgacgacgtccgcctcgccatccaggccaacgccaacttcttcttcttccagccgccgacccgcaaggttctacttgaataggcacgcagccggaacaagatcccgctgcc

SEQ ID NO: 63612 - DNA, 403 bp, Triticum aestivum
  Clone ID: PAT_TA_63612
tttcctgcgacaggatgccatcttctgtcagtaatgctgatgctagcacatcaggaacagatgctccattctatcaactgaggaaagatgctacaaaacttgttgcatatacatttgaaagggggcggagaaatctttggcaactggcaacaagtcgcctgtctgttttactggcttgttcagctgtttcttcaactagcatataccaatttctgaagaactatgaagatctcacaatatttattttggccggtgaagcattttgtgggtttgaagctagcgaattccgacagaagctgaagacagtctgtttgaactacatagtgacctttcaccggcaaaatatatacgcacttaaaatggtactggaaaaggagtcttggacaataatgtctgctgaagc

SEQ ID NO: 63613 - DNA, 180 bp, Triticum aestivum
  Clone ID: PAT_TA_63613
ttacctgttcggcaatggcggccacgaacatggtctggctgctgtagcgacaagggcggtcatgctcgtccgtgtcaacactctgctccaggggtactccggcatccgctttgagatcctcgagacggttgttgcgctttttaacgccaacgtgacaccatgcctgtcgctccggggcac

SEQ ID NO: 63614 - DNA, 321 bp, Triticum aestivum
  Clone ID: PAT_TA_63614
tacctctctctgcaagtctctttcattagacacacgcatacagtagtaagtgcacacgaattggagatggcgatggcacccagcaaggttgtggtgctcatggcgttcatggccgctgcgctgagctctgtgtcgatggccgcggggctgcagcacggcttctactactcgtcgtgcccgcaagccgaggacacggagaggaacgtcgtgcaaggcatgatcaacaatgaccccaccatgggcgccgcctttgttcgcctcttcttccacgattgctttgtcaggggttgcgatgcctctattctgctggacccgaccacc

SEQ ID NO: 63615 - DNA, 309 bp, Triticum aestivum
  Clone ID: PAT_TA_63615
gtctcagttcaaaccagagttctatgagagaactgacagcattatcgcccgctataagcagggacaggtgtgtatgccagtttttgtggagcacctcaaggatgaggtcattggcttgaagaaagtggaggcccagaagacacgagtattttctggtagtccagcggacttcgcagtggtgatgaggaagtatcttctcacgacagtgcgagtgatccaaaacaatcgatatgttttcgaatgtgctcctggaaccaatgcaacctcgttggagtggtgtgagatttatcactacctcatccaacatgg

SEQ ID NO: 63616 - DNA, 209 bp, Triticum aestivum
  Clone ID: PAT_TA_63616
tgtcagtcctcctcggtcctcgcccccatccaaatcccccgccgcccccctcgcggaggaggaggccggcggccatggaagaggagaggaaggggttccagccccacctgatgggcctgggcggcgggaggctgaggggcgcggcgggggcgatgggcctgcagaagcagaactcgtggtcgcccgacatcgagcgggacgaggcgtgg

SEQ ID NO: 63617 - DNA, 247 bp, Triticum aestivum
  Clone ID: PAT_TA_63617
gtcttcagcgagcggctgcagcggctggcgacgccgtcggccccggcggaggacgacgtggacgtggacgccgacggcgacagtaccacttaccgggacatccacccgtcgccggcgccggcgccgttgcggcagccgtcctgggacgtggccagccagcgctcgctgtccttctactgcgacgagcagttcatgtccagcagcatgggccgcgagttcatggccatggtggatgcggggggcgcgc

SEQ ID NO: 63618 - DNA, 117 bp, Triticum aestivum
  Clone ID: PAT_TA_63618
cgtgctgcaagccagttcatcctgcgagcactacttttacctgctgtacgaagcaggctagcaagcaactaggagctaaccagccaggcaggcgaggagagcatggcatgctaccac

SEQ ID NO: 63619 - DNA, 427 bp, Triticum aestivum
  Clone ID: PAT_TA_63619
tttctttatgatccaattcaatagcagcttgtctgcgattgttttttcctctgcgcgtgtatgctgcctgatctgtatttcttgatcagattgctgttgtaccgaatcattgagatagcaaatacatgtagcttagtgtcagatgtacttgatttattaccctgagctatgtttctcctagataataagcatttcaggcagcttggaaaccgaatccttagatcaatgaaatctgtagacttttatgttacatatgcatggacctatagtctataatatcttcaatgaaaatatatgctgctgccatagaagcttatcgaagctaggtttctcttagatactaagcatgtcaggcagctatgtagaatccaaatgaaatatgtagaaatttatgtactgtctgtaatatcttcaatgaaaaaatatg

SEQ ID NO: 63620 - DNA, 414 bp, Triticum aestivum
  Clone ID: PAT_TA_63620
gacccaaatgttagataaatgttcccttggttacttgggttggatatgtgatacatccctcatggcaccgtccggcatgcccctgcttccaagagatacaaatcatgactgtcctccggagttgaagcatttgtcaaaggaaatagttaacaagtgcaaaggcttgcctcttgttattgtgttagttggtagccttttgcgtgtgcgtgagaaaactgtggaagaatggagaaaaataaatgaccaattgggttgggagctaattaacaattcgaggttcgatcacataaggaatgttttgcatctgagtttcatgtatcttccaacacatttgaaaagttgtttcctgtactgcagtttatttccagaagactatattttcaaaaggaaagaacttgtacgattatggatagc

SEQ ID NO: 63621 - DNA, 345 bp, Triticum aestivum
  Clone ID: PAT_TA_63621
tgtgatagagagagaaccgatttgcctgagaagtgactcagtcccatgcttgtccccttcacttcctctatctctcactcacaggcgatgtcgacaaggacgagacggagatattgggtgcgaggggagctccagaaaacgatggaggtgtgcccgtcccgtcccgtggtcgacagggcgtggcactcctgtcaccaggaaagggattcaaatttagagtctggctatggtgagggccgtagtgcatgagggagaagctggggcgatggattcacgagaaactcacccaaacgccttcttcagtagctgcctgggcggacggcgccggctcgacctacagcgaac

SEQ ID NO: 63622 - DNA, 354 bp, Triticum aestivum
  Clone ID: PAT_TA_63622
gtcatatgccctttcaaactgctgatgagtttccggtgaacacagtatcaatcaggtttcctcgtctatagtacttttccttcatcaatcttgtacacaaactatctggtcgctcaatcaaacgccaagcttgcctcgaaagcaaagcctggttaaagaggcccatgtcacgaaaaccgagaccaccttgattctttgggagaattaatttttcccatgcaatccagtgtgtcttatgttttcctttctccacaccccaccagtacctccggaccatcttggtcagttcatcacacaccgacaatggagtttaaatacgctcataacatatgtcgggatagcattagcaactgc

SEQ ID NO: 63623 - DNA, 219 bp, Triticum aestivum
  Clone ID: PAT_TA_63623
cctacgcgtccgcggacgcgtgggctcctcagcatcttctcatctggcgacgaagaggcgacgtcggggcgctcctgctccgtcgcgacccccacgcccttctgacctatgtcggatcagggaatacatgctgcttctgttcgagacaccctctggctttgcagtctttcttttttgtgggtcactcattaacccacctagatctttggaggacatatg

SEQ ID NO: 63624 - DNA, 224 bp, Triticum aestivum
  Clone ID: PAT_TA_63624
tacgcgttcgagggatttcatctccaacggcgttgatggaatatggaatgatatgaacgagcctgctatgacaactactactaaaacaatgcctgagagcaatatacatagaggagatgctgatattggtggtgtccagaatcattcttactatcataatgtttatggaatgctgatggcaagatctacttatgaaggaatggtgatgtccaatacagaaaagc

SEQ ID NO: 63625 - DNA, 346 bp, Triticum aestivum
  Clone ID: PAT_TA_63625
cctctcgtccgcggacgcgtgggttcagctaagctaaaagtgagtgttgtcttaaagtgagatggagcaatatgaaaagcttccaaaaggagatatggtattagaggccctatacaacaactgcttgcaactggtggacacttcgctgagccatttggcaactgagccatcagttgacaaagcacacgagactcattctgtaccattttcattatatgctctctctagaatgggatttaacttgctgaagagaaaaaatgaaactgaaaaggagataagctcttgtgctgtttgtgttggtgcgacaaaatctgtggaggctgctgtgcaagagtcatttctttat

SEQ ID NO: 63626 - DNA, 165 bp, Triticum aestivum
  Clone ID: PAT_TA_63626
ttctttagcagaagcaaagcatccgaacttccgaggcgaggcagatttggttcgcggggcggcgtcggaggaggcaccgtcggcggtgagctcggccggctctaccgtgcgcgggaccgatacgtcgtcctccgccggcgcgagcaatggcggcggcgccgcggg

SEQ ID NO: 63627 - DNA, 225 bp, Triticum aestivum
  Clone ID: PAT_TA_63627
tgttcgaaagtcagctcagaaccaatccagccggaacgccgacgaccaacgatggatgtcgccgtggcgaagcaactcaggcggatccgcacgctgggacgcggcgcgtccggcgccgtcgtgtggcttgcgtccgacgaagcctccggagagctcctggccgtcaagtccgccggcgccggtggcgcggcgcagctggagcgcgagggcagcgtgctcaccggg

SEQ ID NO: 63628 - DNA, 105 bp, Triticum aestivum
  Clone ID: PAT_TA_63628
tcgttcacgcgtccgctttcctggaggcatgggttgctggggtaaaataccctccgtcgatggacccttcgtttgagctgccggagtccgaggtgagggagaggt

SEQ ID NO: 63629 - DNA, 429 bp, Triticum aestivum
  Clone ID: PAT_TA_63629
ttcacgcgtccgcaggaatgaaaataacaaaaaagttcaaaaagcatgcagggatttctcataagaattagcacaaatgcctagagggatcaacatagactctcccaagctcacaggcagagctcaggaccatgcatgcattctgcaaatctttatccccccaacgatgctatgtgcttgatgtcttgtacaaggtgggttatgtgctgctgtgttgtttctgtccagtgtgaaaaagtggaatgccataaataaaatagaagaatggaagttgatccccaggaaataaaagaataggaaaacatgcaagttggtagtattattgtatttccaaggctgtagctgtactgatttctgaatgttaaattactctatcagtcttcgttaccatctatctattatatacctatgacagaagacatgatgacg

SEQ ID NO: 63630 - DNA, 281 bp, Triticum aestivum
  Clone ID: PAT_TA_63630
gtcggcgtcttcgcctccgtctccgccgatggctccgtccgcgtctttgatctccgggacaaggagcactccaccatcgtctacgagagcccccgcccggacacgccgctcctcaggcttgcctggaaccgctatgacctgcgatacatggccgccctgctcatggacagcaacgccgtcgttgtgctcgacatacgcgcacccggggtgcctgtggccgagctacatcggatgggggatgcgtcaacgctgttgcgtgggcaccgcaggctgcaagacac

SEQ ID NO: 63631 - DNA, 325 bp, Triticum aestivum
  Clone ID: PAT_TA_63631
tcgctggatttactccctccgttccagaatataaggtgtattggtttccgtgcaagtcaaacttgcacttgtttgacttttcaaaaaacaaatacaccttatataaaggaacggagggagtattatttatcaatgaacgaatctatctagctgtgccgtcagacattttatccgcggatgatcgacgcaaatcggcagcaaggacagtttttgttttctggcctatgaaagctatgtctctaaaggaaggatcactaaagtggttttttcattaacccacacataggtgcactacttgaaagtcatgcaccctgagataaacatg

SEQ ID NO: 63632 - DNA, 202 bp, Triticum aestivum
  Clone ID: PAT_TA_63632
gtcgcgtggtgggaagacgagaaccttccaaaggccaaagcccataacccctaacctagggtttcgccgccatgggatccgacgcctacggcggctacgacgcagtgccgccaccgtcttctgcagcgcaaccacacggggccgcgccgtcgtatggggttgggctcgccggcatcctccctcagaagccggatggggatga

SEQ ID NO: 63633 - DNA, 291 bp, Triticum aestivum
  Clone ID: PAT_TA_63633
ttgccacgcgtccgaccacgatttcaacatttttttcaggagggggagatgagattcgtacatagacagcttgtttgtacttggcaatggagtggagatgtttggttcagctttttatgcttgaatttgggtacacttgtttttaagatcaatagcccctagatcatagtactagactactaatgcttgtgcaagttttccttaattaattgtgagacgtgctccttcagattgaagatggtcatgaccaatttgagtcgtgcaaaaccattcaacattgttggttgaatt

SEQ ID NO: 63634 - DNA, 203 bp, Triticum aestivum
  Clone ID: PAT_TA_63634
ttgttcttttctgccccggacagcagcactgcctaggtgtcgtgcaaaccaaaccaaaccaaaatctgctgaggtgtcctctactcgagcaagtgtgccaatcctaggctcgctcgcctgatcaatccttcgcgtcgccagcttcatctcgaggcgaggaggcggacgatttgaacccatggatatggcgcacgagagggact

SEQ ID NO: 63635 - DNA, 287 bp, Triticum aestivum
  Clone ID: PAT_TA_63635
tgttcttctctcgggacacttcccaacctagtctacctggatctaggcgttaatcgtctcgaggcaggaggttggtctttcttaacctcattgaccaactgcacccaactggtggaattattcttggatgcaaacatccttcagggagatttgcctagttccattgcaggcctttcaaagagcttagaggtattgttattaacagcaaataaaatatcaggcactataccacaggagatagagcagctcacaaacatcaaacgtctttacatggaaaaaaatctgct

SEQ ID NO: 63636 - DNA, 471 bp, Triticum aestivum
  Clone ID: PAT_TA_63636
cccacgcgtccggccgccgccagcagctgcgcaaaggctcctcaaaccctaaccctagtcctagcttagcttccttcttctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgtctcatcggcgatgccgccaagaaccaggtcgccatgaaccccatcaacaccgtcttcgatgcgaagcgtcttatcggcagaaggtttgctgatgcccctgtccagagtgacattaagatgtggccgtacaaggttattcctggccctgcagacaagcctatgattgtagtgcagtacaagggtgaggacaagcagttttcagctgaagaaatttc

SEQ ID NO: 63637 - DNA, 456 bp, Triticum aestivum
  Clone ID: PAT_TA_63637
tgcaactgggacgggtagcaatactgttcgctatactgcttggatgagctttgatgattttgaggtggaagtgccaattgtacctcagtcatcatataaaggtgctaaaaaggatattataaagaaatatcgtgttaatgcaatcagatcgaacttggactcggaggtcaatgagggcaagggtcctgtctctagtgtcctctctaatatttcctcgattgcttcttcgctctattctatccctatgttggcacctgttgctggcccgacagcctggatgaccaacttagcttctggcgttgcgtccgcctttggttggtgcaagccagtgttggactcccaagttatccgtgtctatcaacagcctcatgcttataatgctaacataaacgaatctgacgttactaatagtcttggcttgtttgtgacaataaggtttgcgttatgcctgatgtt

SEQ ID NO: 63638 - DNA, 411 bp, Triticum aestivum
  Clone ID: PAT_TA_63638
tcgtaaaaaccccgacgcccaccccactcccagcttccctaacctccccacgactacctctttgctgtcgcccgagcctctcccaccagcgcgccgccgccgctgcccgaggcccctccgaccagcgcgccgtcgccgcccggggctccttcccaccagtgcgtcaccgccgcccctaagcccctccgaccaacgcgccgccaccgtcctgatccccctacgaccaacgcgccaccgctgccccgatccccctccgaccagcacgccgccgccggcgccaagcccctcacaccagcgcgtcgccgccgccccgatccccctcccaccagtgcaccacggccgccccaaacccccttccatgaccatatcacccgcaccatcggccgcgcctccctcctgcatgccacctgc

SEQ ID NO: 63639 - DNA, 489 bp, Triticum aestivum
  Clone ID: PAT_TA_63639
tttttgcccacgcgtccgccacgcgtccgggccatttgcctatacaagtatctgtccactcaatcatcaggcgctcaatcatcacccaaacgattaacttattcatacaatcacccgcgaccaataatccactgatcagtttgccgcgtgtccacttgagttatctccacaattgcccacaggaccatcggcccattcactttgaccgtcattatcgcctaaactttttccggtgctgaacagcaaggtcctccatgaatccattcgcagcaaatactgccaaaacatttttcgacctcatcaagtcagagagggatctatattcgcttgaacctgatcgtgagccatcccaatctcagcttcgtttgtttgaacgaatatgtgtgctattgaatggggaacatacatcaaaatcgcgcagcactagaacacggcacgaaaaggaacaatcaagaatccagagaatgtacgaaaagcttccatccgatc

SEQ ID NO: 63640 - DNA, 400 bp, Triticum aestivum
  Clone ID: PAT_TA_63640
tggtcgccgcctcctccttccgcaggagctccctcctcgtatgcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgccttgctatggtcttgaagttggcctcaccaactatgcttgagcctactgcactggtctgcttttggctcgtcgtgtgctcaagaaccgtgatcttgatgagga

SEQ ID NO: 63641 - DNA, 278 bp, Triticum aestivum
  Clone ID: PAT_TA_63641
tctttcgctcggctactgcgacgaacgagaggagggcgttttggtgttcgagtacgcccccaacggcgacctgcacgagaggctccaccggagcggccagaagcgggcggcgctgccgtgggcgcggcggatggccgccgcgttccaggtggcgatggcgctggagtacctccacgagagccaggaccccgcggtcatccacggcgacgtcaaggcgtccaacgtcctgctcgacgccaacatggacgtcaagctctgcgacttcggcttcgcgcacg

SEQ ID NO: 63642 - DNA, 236 bp, Triticum aestivum
  Clone ID: PAT_TA_63642
tttttgaccacatcctccccccaatctcgctccctccctccctaccacgctggtccctgcgaggcggcgcggcgagcgcgagcagtcgggtccggtcaaagccaggcggcgatggcgtcgtcggcgccgggcggcggcagcgggaagatcgagcggctgtcgtcgatcgacgcgcagctgcgcctgctcgtcccggccaaggtgtccgaggacgacaagctcattgagtacgacgc

SEQ ID NO: 63643 - DNA, 245 bp, Triticum aestivum
  Clone ID: PAT_TA_63643
tgttgcccacgcgtccgcccacgcgtccggggacgctttgtttgcaaagaaatgtgatggattgccacttgcacttggagttttgggaggttatctgtctaaaaatctaaatgcacaaatatggtccgatatactctttgattggccagcaaccaaggatggacaaatgatgagtgtcatactggcacgcagctacaaggacctaccgaatcatcatttgagatcttgtttactttattttgctg

SEQ ID NO: 63644 - DNA, 302 bp, Triticum aestivum
  Clone ID: PAT_TA_63644
ttcgtttctaatttgacatacactatggatgatcgcactaagttatcagagcgcttccatactgtatcggatagcgttggaatgaagtcagaagttaaggtcgtgccggttcgcgagcaagctactttcttgagaaaacgattcgttccaggtgctttcggaactttacccgtacccagctttggccgtgtgttgtcaaaactgcctgtgagggcgaattttaacgcctctgtcactgacgatgattatatggcgggcaagctactgtctgccgcctatgagcatcggcacattgctagttt

SEQ ID NO: 63645 - DNA, 243 bp, Triticum aestivum
  Clone ID: PAT_TA_63645
ctcgcctacgcgtccggacggagtcacaaccattgatgttaagtcataggagtacaagaacaaacaagctgttggacatcctgtgaacagctggatgaatgcaaagattggcttggcagccgaggacattgctttgccaagtgctatttctgccaaagttgttcatccatgggatggcccgggaacataccatggaggacccaaactttcaatttatggcttgcctacggattttgctggccc

SEQ ID NO: 63646 - DNA, 310 bp, Triticum aestivum
  Clone ID: PAT_TA_63646
tcagtcgttgccgagccgaaggaggagctgatctggtgcgttccgctggtgggcggcgacgcgcgctcgcccacggtgctcctcaagttcctccgcgcgcgcgagttcaaggtcaaggaggccatggcgatgctcaaggcggccgtgctgtggcgcaagagcttcggcatcgacgcgctcctcggcgccgacctcggagtgccggagctggagaacgtggtgttctaccgcggcgccgaccgcgagggccaccccgtctgctacaacgtctacagcgagttccaggacaaggacctctatgagaaggcct

SEQ ID NO: 63647 - DNA, 252 bp, Triticum aestivum
  Clone ID: PAT_TA_63647
accacctaatttaggtgtactaggttttgcgccaatattgtttaacctcccgctaaaaggtcccaaattagcgtctttgttcccaccaaaaaattatggttccgctaaataccttgctaacaacccacgaatatataattctagaccaaacgacggcgtcttcacgagcgattggatctgagctctcgtctcggttcatctgtgctgccggcgtcatgacggcgtcaatagagcgaaccacgtcaggtgcac

SEQ ID NO: 63648 - DNA, 365 bp, Triticum aestivum
  Clone ID: PAT_TA_63648
tcgtttgacttgcgcatcccacctaacaccgcccgtggtctgggagctgccgccgccgccgcggagcaggggactcgatgggattcgacgggctggtcgttgtgtccgacccttacctgcagcgccgcttcacgcaggcggacctccgcgcgctccaggcacagtacgcggggctgcgggacacggcgcccaccggcaggctgcggctgcgggaccttcccgccgcgctgaccggcctggggagccccaccgctatggccgccgataaaggggaagcgctgcgcggggacgccgggaaagagatcagctcgccgcccgagcgggcgctcacggacgaggagtggtcctccgtgctcacggctgtc

SEQ ID NO: 63649 - DNA, 374 bp, Triticum aestivum
  Clone ID: PAT_TA_63649
tcgggtacctcgccgggaagatcaccgtcttcgaccgacgaggacacgttgcaaagctgtgcgccgtcatcctgcctctcctcgtggccgcgctcatcgccatctcgcgggtagatgactactggcaccattggcaggacgtcttcgcgggcggcatccttggtcagaagctcgcgcctattctttgttatctctgaactctttttttttttactattcctgtttttgcgggaaatctccaaactctctttgttgctgacgaggtttgtcatgtccgtgaaggaatggtggttgcgtctgtttgctacctgcagttctttccaccaccctctgatgacaaaggcttctggcctcatgcccacttcagggacatc

SEQ ID NO: 63650 - DNA, 243 bp, Triticum aestivum
  Clone ID: PAT_TA_63650
tcgcttcgcgtccgtccacgcgtccggacagaaatcgtcctttcgttaggctagggcgaggcgagagtagattggatctcgagctcagcacgcggcggccatggaggacgaggagcacgaggtgtactgccaggagatccccgtcgacggcgaggacgtcgacatgggcgccgggggcgacgacgccgccaagctgcacgagctcgactagatgaagcgccgtctcaaggagatggaggagga

SEQ ID NO: 63651 - DNA, 228 bp, Triticum aestivum
  Clone ID: PAT_TA_63651
tcgctacgcgtgcgcccacgcgtccgccggagtgggttcctgcctgccgctgcggggcaccatcaccgactccggcgaccttgtgccactgtgctacatcgccgggctcatcaccggacgccccaacgcgcaggccaccactgttgatggcaagaaggtggacgccgccgaggcattcaaggcgccctggcatcgagggcggcttcttcaagctcaaccccaaggagg

SEQ ID NO: 63652 - DNA, 265 bp, Triticum aestivum
  Clone ID: PAT_TA_63652
ttcgttcgccacgcgtccgctccgcggcatgtacggttacgcccccacgccggcgcccgaccggccggcgtcgccccccgtcccgccgctcccggcgccatcgcggcaacaggcgaccgcgcggcggacggcggacgaggtgtggagagagatcaccggcggtagcggcggggaggaggaggcggccccggcctccgctggcggggccggggagatgacgctggaggacttcctggcgagggaggacggcgccgtcgtcaggggg

SEQ ID NO: 63653 - DNA, 220 bp, Triticum aestivum
  Clone ID: PAT_TA_63653
tctcgctcgcccaatcccaccgtggtgctggacgcctgcctggtcgtgggccacctcatccccatggtggagctcgccaagctctccctcggccgcggcgtgcccgtcgtcatcgccgacccgaccccgccggcatccaccgccgacttgttctgctcctccgacttcgccgccgccgccatcgaagccgccaacccttgcatcgccttccaccacctcc

SEQ ID NO: 63654 - DNA, 357 bp, Triticum aestivum
  Clone ID: PAT_TA_63654
actttcaacaactgcaaactgttgagaccgttcatgccagcaaagacttgtcactacagctgaagaaaatgaataagctgcagaatgttaggattgatgacatcaatgcatctcattgtgacgacctttgccaagccctctcagatatgcccctgctttccagcttatttctctctgcatgtgatgacaaggagacactttgtttccaagcactcaagccagtttccaaaaggctccacacactaatcatcagaggcagctggggtgatgaggcactcaagtgcccaatatttcagggtcatgggaagaatctcaagtacctggctctagtttggtgcaatcttgggaatgaagacc

SEQ ID NO: 63655 - DNA, 165 bp, Triticum aestivum
  Clone ID: PAT_TA_63655
tctggactctgctgttctatccggtatgttgcttttatcggccatgaacaagctcaaaaagatggctctcagggtgattgcggagaacctgtccgaggacgagaccgccggcctcaaggagatgttcaagatgatcgactcggacaacagcgggcagatcacgta

SEQ ID NO: 63656 - DNA, 363 bp, Triticum aestivum
  Clone ID: PAT_TA_63656
tcctcatcttcttgtgcgagagatcacacgttcctttcattcttcaaccaattcgattccatcgatgtcgtctgccctctccttaccggcgacggtgcggccggcatcctccgggcttgggcgccagctctacgggtcgccgccgcgccacggtccagtgctgcgaccgaggaggccgcaggcggagccatgccacggtctgctggcgctgcgaccgaggacgaggcgctgcggcgctttcgggcaggaccactacggtggcgcgctggtggacgagggcatggcggtgctccggcggaggatccgagaggcgcggatggccgtgaccaactacgaggcgccggcgggatgggcggactggga

SEQ ID NO: 63657 - DNA, 292 bp, Triticum aestivum
  Clone ID: PAT_TA_63657
cttcgtcaaggagggtgacatgcaaacattgtcacctttgttggaatgtgctctgaagtttcggctcttgtgtacgagtggttacctaagggaaaccttgaagaccgcattctgtgtgccgatgacactccacctgtatcatggcacatccgtacacagatcatccgtgagggttgctgtgcactactcttccttcattcacacaagcctaatgcctcggtccacggcgatctccggccttgcaacattctcatcggtgctgactacagaagcaagctctacaactttggta

SEQ ID NO: 63658 - DNA, 387 bp, Triticum aestivum
  Clone ID: PAT_TA_63658
ttatacccaccgctagcttctctaaggagtgaggagcagagtaatggatcttgaactgttgtggagtggtccacctgcactctcggtactgccatggatctgcggcggcctcgtggcctcggtgctgctctggcaagccgcccggctgctcgaccagctgtggtggcggccgaggcggctggagcgggcgctccgctcccagggcctccgcggcacgcggtaccgcttcctcctcggcgacgtcaacgactacgcccggcagaccaaggaggcgtcgtcgggggccgccgatgccgctgcgctgccacgacgttggcccccgcgccatgccgttcctctacagcaccatcaaggagcacggcacgccgtgcatcttctggttcgggc

SEQ ID NO: 63659 - DNA, 339 bp, Triticum aestivum
  Clone ID: PAT_TA_63659
tttcttcaccatatgagtacattgtgtgtagacaggggattcctggtttggatggtggtgatgcaccaaagaggaagagtatgctagtcgtgtcagaattcataggttgctcgccatcattgagtggagcaatccgggtgaacccttggaacattgatacaacagcagaggcaatgaacgagtccattgctttgtcagagaatgaaaaccaattgcgccatgagaagcattatcgatatgtcagcacacatgatgttgcctattggtctaagagctatattcatgatctggagagaagctgcagggaccattttaggaggaggtgctggggtattggac

SEQ ID NO: 63660 - DNA, 382 bp, Triticum aestivum
  Clone ID: PAT_TA_63660
tcctattcctgctaccacctcggcaccaccagcccaagcagagccatggcgcccaacggagacaacaccgtggccaacgtccacagcggcatcgacagcaccaacaagacgctgctcaagagcgacgccctctacacctacatcctcgacaccaccgtcttcccccgtgagcacgagtgcatgcgcgacctgcgcctcatcaccgacaagcacccatggggctacatgcagtcgtcgtcggacgaggcacagctgctggggatgctgatcaagatggcgggcgccaagaagacgatcgaggtgggcgtgttcacgggctactcgctgctggccaccgcgctggcgctcccggaggacggcaaggtggtggccatcgacaccg

SEQ ID NO: 63661 - DNA, 339 bp, Triticum aestivum
  Clone ID: PAT_TA_63661
agccacagagtcacacaggcactagcttcagctagccagcctcagccactccgggcattttcttgcattcacgacggcaatggccaccggtgatgtccacaacccgacggccgcgctgacggaggaggcgcccgcggtggagacaccggtggccgccgaggaggccccgaagacggaggaggtccccgcgcccgcggaggccgaggtcgaggcgtctgcccccgtcgaggctgaggcgaccaaggaggaggcgccgggcgccgctgagacagaggaggccaaggagaccgagccagcagctgctgccgagccggaagccgaggcgcccaaagagccaga

SEQ ID NO: 63662 - DNA, 316 bp, Triticum aestivum
  Clone ID: PAT_TA_63662
tttctaggggagggagcccgaacgaaacgaccaaagcaaagcgaaagagaagagaaatcggccggtcttccctcgctggactaactagcgagtagagagagagagagagcatcagagcaggcgaatcacatcgcagagccaaggcagcagcctcatcgccgccggtggttcgcttcctgccgccccaccaagccccgaatcaaagccggggctgcgcctccctccctgctattggtgttggtttatcgcgcggctggccgggggcgctgtcgtgtgctgcggagaggaggaccggagggggcggagcatggacgga

SEQ ID NO: 63663 - DNA, 219 bp, Triticum aestivum
  Clone ID: PAT_TA_63663
tttttctattgatgatatatggtccatatcggaatggaacattatcaagtgtgctttgctagagaataactgttctagcagagttataactactacacgcattattgaagttgcacggtcatgttgtatgggtcaagatgaccgcatgtatgaaatgcaaccctagagtgattttaattgtaaaagattgttcttgagaacaatttttgggtccaagga

SEQ ID NO: 63664 - DNA, 239 bp, Triticum aestivum
  Clone ID: PAT_TA_63664
tactgcggacgcgtgggtccttcctccccgccgccgccgcctctcccaccagcgcacgatggaccagacgccgcagcgccgccgccggagacgcgccgaggtcgccccctccgacggcgctccgggcgcggcggagtacagcctcgacgagccgaccttggcggagaagctcgcggccctgagcccgcccgccgaggcggccggtggcgccgccgtggtgccctccagcgcggactccg

SEQ ID NO: 63665 - DNA, 300 bp, Triticum aestivum
  Clone ID: PAT_TA_63665
tcttttgtagcgggaggccctgacggggagaaggggctcctctccaacatcatgcatggtgttgccggtgctcatggtggtggccatggctacccatctggtggccacgggtaccccccgcagcagcatggataccctcagcaaggctaccctcctcagcatggctacccaccgcagcagcatggctaccctccacagcagcatggctacccccctgctggctaccctggctcatctggtcacagtggtagccatggaggaggaggcatgggcatgggtggcatgctggctggaggagca

SEQ ID NO: 63666 - DNA, 336 bp, Triticum aestivum
  Clone ID: PAT_TA_63666
acgagtgaagtgagagcttcgcacgaaatgttcatcagcgaccatgaagggcaccaagctcgcggcgatcctcatcctacaggccgctctggtcatgggagtcctctcacacgtgaacgccgactatttgcccaagtgctgaaacaactgcaggtccttctccggggtcgacgtgtgcgacgacgcccaccccaagtgccccacgggctgctcggcgtgccgagtggtgtcaacgagccctgaaatgtggcgctgcgcggatatgaaatccaccggcgacggcacctgcggtgggccctgcaagaagtactgatcggctcatgccagcatgatatg

SEQ ID NO: 63667 - DNA, 165 bp, Triticum aestivum
  unsure (1)..(165): unsure at all n locations
  Clone ID: PAT_TA_63667
gttctttcacgacgttngcgacgctggagtgggggatgacggagctggtgcgccacccgcgcatcctgcaaaaggcgcaggaggaggtacggtgggtggtgggcggcaagggccgggtggaggagtcggacctggcggagctccactacatgcgcgccatcatca

SEQ ID NO: 63668 - DNA, 261 bp, Triticum aestivum
  Clone ID: PAT_TA_63668
tttcttgatcgagccatccgcatagcccacaccctcgatcgtcttgcctttcgtgcctcggttccacacaactgccagggcctgctgctgaaacctgcttgttattcttcttcattcttcgccgtggcctagcatgctgtggatctatccaacggggggagatcgaccagatgactggctgcaacggcaacggcaacggcaacttgcgcgtattcaccatgggacagcagacggtcactgagaagaagctcggaggaattg

SEQ ID NO: 63669 - DNA, 423 bp, Triticum aestivum
  Clone ID: PAT_TA_63669
tttccggtcagcgctgtgatgcccctaccgcacctgcagacgtaggtgctgaagccggcgggggctggaaccgcagggttaggcgaggccgtatcccagatgaacgggaaccagatgcacagcgagtaagtgcactagagaaggcattgactggcttcgcggagaggcagactgatgttgttgttaatccaacagtggggacctgcttcgattcgattacagaggcatatgatttttataacctctattcctgggaaatggggttcggtataaggtacggcaagagcaggcggaatgcaaagggtggtaaatgcatgcacgaaattacttgtgttaattcgggtaaaccaaatatgggcgggaaatcgcgcatgtgcgagtgcacagcactaattaggctactcagaactgatgacaacggat

SEQ ID NO: 63670 - DNA, 407 bp, Triticum aestivum
  Clone ID: PAT_TA_63670
tttcttaaccatctatctggtctgatcattggtcaggacaacaatgatcctgagggctgtgacttgattcaccttagagccatgtctgaattgaggtaccttcagattgagagacttgatagggctacttccggagcttctgcactcgcaaacaagccattcctgaaggttctacacctgtctgagcaagcagcattaattgaagaagaagagaatgaggaagaacaggagaaccaagagggcgcagagaaagaagaaaaggacaaacatgaagtaaaaagtgctcagtggattagagatgattcagctaaagtgagtgaaaagatatggaatgagctcaccccacccaatagcgttgagaagctggtaatcaagaactaccaaggtcgaaagtttccaaactggat

SEQ ID NO: 63671 - DNA, 222 bp, Triticum aestivum
  Clone ID: PAT_TA_63671
agttttgtggcggcgccccctcccccggcaacccatcctccctctctttcccccctccccgccgccgccaatagcccccgccgggcgaagcccgcgcggatctggcggcggtgggctgccattttccgtgtggctcgttcacgggctggaggagccccgtgtggcggctaccggcgtggcgtgactccggcgcgcagcggttcatccagtggaggctgggga

SEQ ID NO: 63672 - DNA, 440 bp, Triticum aestivum
  Clone ID: PAT_TA_63672
tttcggcccctgctcccatcccttccacctcccctcccgctgcatcggctctccgctcagcatccctcccggtcacctccatccctcctgcatccgcctccgcttccttctccggttccctccaccgcgctattgcccctcagcccatccaccccagccactccctcccggccttctcggccgcttctctccccgcggcagccgacgtctgccctccgcccccgggcccccaccattccaactcgctctcggagttcgccgcttccgcatcccaatcccgcgtccaccgccctcccactcgcgccgcggtgcgcgcggaccgcccgcccccgctggagctgcgcccgaggccatcgagggagtcacagtctggcatcgccctctgtgctctcgcctgctgtgctgctcctggtgccgggacctccactcacctctgggcg

SEQ ID NO: 63673 - DNA, 127 bp, Triticum aestivum
  Clone ID: PAT_TA_63673
gggagatcacggagtgcgatcgacaccgtgcagtacgcagacgttgcctcgccgattgcccggaccggcgagcgccaaagcgccagccagcaacggaacgcaaggaattgcaatgggagatgggccc

SEQ ID NO: 63674 - DNA, 453 bp, Triticum aestivum
  Clone ID: PAT_TA_63674
tttaaggatgtattgccaagaattggccaatggaatatgaggcataagaaaatggtcaatggtggtagagttaaggagtggatatgtattaactttgctcggaatgtccaagatagtgctgccaggagtttctgtcgtcagctggctgacatgtgcgaaatatctggaatggacttctcaaaggatcctctgcttcctcctttatgtacgagagctgagcatgtagaaagagcactcagggcacactatcgagatgctatgaatattctgaaaccactgggcagggagcttgacctgctcattgcaattttgcctgacaataatggtcctctttatggtaatctcaaaagaatatgcgagacagatcttggattggtctctcaatgctgtctcacgaaacatgtttttaagacgacacagcagtatcttgcaaacgtcgcccttaaaatcaat

SEQ ID NO: 63675 - DNA, 390 bp, Triticum aestivum
  Clone ID: PAT_TA_63675
tttttacgcgtccgcacggaaccaacaaatccccacccaatctcgtctccgatcgactccacgctcgtcgaatactcctcccctaccgcctcaagatgcagatctctgcgaagaccctgactggcacgaccatcaccgtagaggttgagcgctcccacaccatagacaacgtgaaggccaagatccaggacaaggagggcattcccccggaccagcagcgtctcatgttcgctggcaagcagctggaggatggccgcacccttgctgactacaacatccagaaggagtccaccctccaccttgtcctgcgtctgcgtggtggcatgcagatcttcgtgaagaccctcaccggcaagaccatcactcttgaggtggagagctccgacacca

SEQ ID NO: 63676 - DNA, 120 bp, Triticum aestivum
  Clone ID: PAT_TA_63676
tctgtttaggccgactgaaggcggcataagtggaacagatgatgcggcggaggctttgatttcttctctgccgatgggacgagctggtggccgcatggattatgaagcgggcaaaagagc

SEQ ID NO: 63677 - DNA, 389 bp, Triticum aestivum
  Clone ID: PAT_TA_63677
tttcccacgcgtccgcccacgcgtccgcccacgcgtccgcaacaagtacattggagttatctcagtgcatcagaattgtttctttcatgcagagtttctgctgctatttgttaaatcttaaagaaacgtctgttcctgaggtttacaagtccccttgttcaaatatgaaaatgatttatttgcaaacttcaatgcaaaatggttagtcagtctcgaacaactgcatgtatatatactttctagctatgctattgatgccacatccagattacacttttcttctctttttcttttcttgggagtagaaaggtctcactcaaggatcgagcaaatgcagctctaatgcttgtgtcgtctaattcaaagcatgatgactctaaatgttcatg

SEQ ID NO: 63678 - DNA, 315 bp, Triticum aestivum
  Clone ID: PAT_TA_63678
ttccacgcgtccggctcaacctgagcttcaactggttccatggggagattccagcaagcctcggccgcctccgtcgcctacagaggctagacttgaacgacaactccttctccggcaagttccctgtaaacctgagctcctgcatcaggctgaacaaaatgggactacacaacaacaagattggcggccacatcccagctgagctcggcgaaaagttcatatccctggcagtgatctcgctgaggaacaatagtttcacaggtcccatcccggggtcaatggccaatctgtcctatctacgatatcttgatttct

SEQ ID NO: 63679 - DNA, 329 bp, Triticum aestivum
  Clone ID: PAT_TA_63679
tctggccgatctccgccagccatgtcgcccgacgacgtgtcccggaagtcgcccgtgccgccgccgtccccgccgccgatggactcgtgggctcggggagggcgtcgctccaggcgccgtggcagcagcggcagcgccagctctggcggcggcgtcgagtccgaggaggagtacctggcgctctccctcctcatgctgtcccgcggcgtccgcggcgaggtcgaggacggcggcatcggaggcgtcaagggcttgggagcggcgccgaccaaggcgcaggggtacgggtgctccgtgtgcggcaaggtctacgcgtcctaccaagcgct

SEQ ID NO: 63680 - DNA, 167 bp, Triticum aestivum
  Clone ID: PAT_TA_63680
cccacgcgtgcgagtcagggtaactggagacagggctcaatgactggaaaaacactttacgtctcgaagagtctggtgcgctctttacgatccttgaaaatcaaagggaaagaatgattttctcacctagtggtactgataaccgcagcaggtcttctaggtgaaca

SEQ ID NO: 63681 - DNA, 138 bp, Triticum aestivum
  unsure (1)..(138): unsure at all n locations
  Clone ID: PAT_TA_63681
ctttcctgttagcaaggngggactatcgccagggtgcttagtgacattcgacaggggtgggcggacnacaacagagagaacctcctccaggaagaggaggagcaagtggaagaggcttgagtgccaagcaacaaacta

SEQ ID NO: 63682 - DNA, 104 bp, Triticum aestivum
  Clone ID: PAT_TA_63682
ctttacgcgtgggtgatgtgtgggttcagggagggtgtaacattaactgggtgagagggtaagggacctatcctatatgtatgtctaaaatagtaacatgtaac

SEQ ID NO: 63683 - DNA, 354 bp, Triticum aestivum
  Clone ID: PAT_TA_63683
ttcagcacctgcctcaccctatacaatgagacggggctatttgacaagctgggcgggttcccggcgccgctgctgatgaacactgtgcacttcgcgctgcaggccgcgctctccaagatcatcctgctcttccaggccaaggggatcgacaccgccgtcgagatgagctggaaggattacttcatgagagtcgtcccaaccgctctgggaaccgcgctcgacataaacctgagcaacgcgtctctggtgttcatcacggtcacgttcgccactatgtgtaaatcggcgtcgccaatattccttttgctattcgcttttgcattccggttggagagccccagcatcaagcttcta

SEQ ID NO: 63684 - DNA, 241 bp, Triticum aestivum
  Clone ID: PAT_TA_63684
ctggtcgaaccagacctggcggaagaccttgacgatgcaatcgtagtgctcgtcggcgttgaaggcgaggtaacacgccagcagccgctccagctcctccggccgggcgtcggtccccccgctgctcgcgatcatctcggacatcgactccctgaacgcccgctgcgggtcccgcgtccgccgcaccactgagaggctctccagctccggcgccgaccgccgcggcgaccgcaccttcacc

SEQ ID NO: 63685 - DNA, 376 bp, Triticum aestivum
  Clone ID: PAT_TA_63685
cctatcccatcgccgatcgccttcgccccaccctgaaaccgttcaaactccaacgggggtccgatggccaaccagccccgcgaacgcgggtcccgcgccgcgcgcaagggccgccccgtccgcacgccagcgaccctgctcgcccttaaccccacccccgatcccgatctgtccgcgcaggcctctgacgacgtctctccgtggggccgctcgacggcggacgagctggaggaccgcctcctcaagaggctggaggaggcctacgcggcggcgctggccggcctcgctgagctcggctacgccgaggactccgcgctccgggccgtcctccgcgcgggccactgctacggcaagcttgacgaccctgtcgataaca

SEQ ID NO: 63686 - DNA, 302 bp, Triticum aestivum
  Clone ID: PAT_TA_63686
gccacccccgctcctctcctctcgcccatgcccgccaccgccgaagaagctgccatggcggccggcgacacgggcgcgcccgcggcgggcggagcggggaaggacggcgagcccgagtcgccgcgggagccggaccccgatcaccacgctccggtgtcgccgggcgcttccgaagaggaagagggcgccagcggcgcggtcgaggcggggcaggacgacgacgcgcctgacccggaggacgagccggaggagggcggtgacgccacggaggacgatatggacgaggaggaggaggaggagga

SEQ ID NO: 63687 - DNA, 443 bp, Triticum aestivum
  Clone ID: PAT_TA_63687
cgctatcacagcacaaacaacggcggggagggcgacacgatggcggcctgcctccgctgccgccgccgcctccccctctcccctccggcggcgccgctggaagacgacggcctgctctctgagaacctcctccgcctccccccgcagccctcctccctcccgcgcgcctccgccgtctgcagccgcctcctctccgaccccgccttccgccgccgcttccgcatccaccaccgcggcagcgctctcctcctcggctccttcatccattaccccggaatcaccttccagccagcgcccgacgcccccgaccgcctccccctcgagcaattccgcctgaagctcgacgaccactacatcgccctcggatgccgccatggcctcgcgctcttcttcctcccgatccggctccaggtgctcgtgtgggaccccctcgccggccacca

SEQ ID NO: 63688 - DNA, 343 bp, Triticum aestivum
  Clone ID: PAT_TA_63688
cttacgcgtccgctctccctcccgctcccttccggtctcactgacacccgggactgggcagccgacggtttccccgcctcgccggactccggtgccggcaacgacgacgacgcctgctccgtctgcctcgagagaccctgcaacgtcgccgccgaagtgtgcgggcacgagctgtgcctcaagtgcgcgatggacctgtgcacggtgatgaaggcgtacgaggtgccggggctggccggcaccgtgccgtgcccgctctgccggagcggcatcgcctccttcaggaaggccgtcgccgcggccaccgcgtcgcccgaggacgaccagcaaagcatgagcggca

SEQ ID NO: 63689 - DNA, 411 bp, Triticum aestivum
  Clone ID: PAT_TA_63689
gttagcctttgtcaaatcgagctccagctactgagtgagagtgaagtttctagccggaggagagagatagaagtatgggtatggggtggaaagttctgagcgatgtgaagccatacctggcgatggtgctgctgcaggtggggttcgccgggatgtacatcatcgccggggcgtccctcaaggcctggatgagccacttggtcctcgtcgtctaccgtaacctgatcgccaccgccgtcatggcgcccttcgccctctacttcgagaggggacggaggccaaagatgacaaccaccatcttcctcaagatcatggggctcgcaatcctggagcccatgatcgaccagaacctctacttattgggagcgaagctgacctcggcgggattcgcaacggcgctactcaacaccc

SEQ ID NO: 63690 - DNA, 318 bp, Triticum aestivum
  Clone ID: PAT_TA_63690
cttcagtcttttgcaggatatcatgggctgtgggggtatgggcataatctacggcggctacggggatcggtggcgccagatgcgcaagatctgtatcgtggagcttctcagttccaagcaggtgaggcgtatggagggcatcaaggccaacgaggtaggtaacctcctccattccatggccgccgccggtgctaccgtaaatgtgagcgcgaagatggcaacactcagcagcaatgtcgtgacgcgagcagttttcggcggcaagttcacacggcaggatgagtacctccatgagctaagcaaggtgaacgagcttat

SEQ ID NO: 63691 - DNA, 312 bp, Triticum aestivum
  Clone ID: PAT_TA_63691
cttaactgttccggcagaatagtactgcctttggggactggtcgaagttcaccgaggagtttgtgaccttctacttgcaccttaaacctgcaactatactacgctaatggagaagatgcgggcagcatgggaggcgccgcctacgcaacaactgcctccggggttccggttccaccccaccgacatggagctgctgctgcagtacctccgccgcatggccctggaccgcccgctgcccgccgccgtcatccccgtcgtccacgccgccgacatgcccgacccctgggacctccccggcgcgagcgaggggga

SEQ ID NO: 63692 - DNA, 178 bp, Triticum aestivum
  Clone ID: PAT_TA_63692
cactgtttttcggagaacaatctcgggagtcgcataatcactacaacatgaatcgaggctgttgcaaaagcaggtgcaggtgcccatgtttacaagacttgtcttcttgacgaagccgatgcttaaaccttgtttacccaaagaacttttgggagtgtgggtgcctgccctgcccatt

SEQ ID NO: 63693 - DNA, 272 bp, Triticum aestivum
  Clone ID: PAT_TA_63693
cccgaccatcacgttgttgcacgcagaaggtggagctggccaaagacgacgtctacggcatccagagcctctacggcggcaaccccaacttcaagggcgtcacgccgtcggccaccagcagcgaggagacccacagcgccgccccgcgcgcgctctccggcccgtggagcggcctggccggggcggctgcgctcgcactagccttgtcgtgctagttcttctttgcgtcgatcgattcacgaccattatttttaacgggcatctatttcact

SEQ ID NO: 63694 - DNA, 205 bp, Triticum aestivum
  Clone ID: PAT_TA_63694
gttttaatcgtatgctttttactcatgacactggagcccccactgcacacaagtcgtggtggaagtttgtccagttcggagaaaaaagaaacaaagttcaaaaagaaaaatcatgagttcaccttccataaagtttgaattacagagatatcaccttgatgagtatgtaatatgattgcaaatttgcaattaggaatgggtgtgt

SEQ ID NO: 63695 - DNA, 136 bp, Triticum aestivum
  Clone ID: PAT_TA_63695
tgagatggtccccgtcgttgagcgcctcaagaccggcttctagaagttcaagaccgaggtctacgaccagaagccggatctgttcgagcccctcaaggcccaccagtcacccaagtacatggtgttcgcgtgcgct

SEQ ID NO: 63696 - DNA, 283 bp, Triticum aestivum
  Clone ID: PAT_TA_63696
tttcacgcgtccgcggacgcgtggcggacgcgtgggcaagaatgtagccgtggaagttgccgacaagctctgtgaatcaggcgcagccagcctcctaggcaagaagcttggatcgttcacacggatatcctgttctgttcaggcagctatggaagaggctttggttcgcattttgaccccaaggcgagctattgacgtactgacagatgctcatgctgccaacgaccgtggtacgccgtatgtcataccctttgttggggttaatggggtaggcaaatccact

SEQ ID NO: 63697 - DNA, 413 bp, Triticum aestivum
  Clone ID: PAT_TA_63697
ctttttccttaagcgcatggttgaattccatgcggactcggagacaacagacatctatgtcattaagaaggttgacaacagggtaaagagctctgtagcagattccagcactcctgcagattctgctataatagggactactccagatggatctaagcggcaaaagatatgtgcaagttgggagaacacaatcactggagttggccaagtatttgagggtccaaaggaatttcgtgatgcattgcacaagtatgccattgcacataggtttcattacagatttgtcaagaatgactcttctcgtgtcactgtggaatgtactgatgaaggatgtccctggcgcatacatgcttccaaatcttctgcaaatcaggagttcatgatcaagaaagtggttgggagccatacatgtg

SEQ ID NO: 63698 - DNA, 152 bp, Triticum aestivum
  Clone ID: PAT_TA_63698
ttgtcgcctcctgtgcgccccaaaccctagcttgtccgcagcgccgtggactcggctctcccatcctgcaccgggaggcatggtgacggagctgggctacgcgccggccatgaagtccggcaagctcgggtgcgagggaacccaggaggggc

SEQ ID NO: 63699 - DNA, 367 bp, Triticum aestivum
  Clone ID: PAT_TA_63699
ttttgcaagggcgaccgtgtccgcttcaagtccgacgcgctcgagttcaacaagatgtcggagctgttcaaccagcggagctcggtggaggggaagatcccgtcggggcagttcaacgcgtgcttcgacctggacagcgggtcgtgggcgcaggacgcgtcctccaccaagtccctcgccatggacggctacttcatctccctcttggacctccgcctcgaccgccgcccgctcgccctcgccgcccacgtcctccgcgacgtccccgccgcctgggaccccgccgccatcgcaagcttcatcgagaagtacgggacccacgtggtggtggggctgagcatgggcgggcaggacgtggtgtgcgtgc

SEQ ID NO: 63700 - DNA, 429 bp, Triticum aestivum
  Clone ID: PAT_TA_63700
gggttcgtggcgttctcggcgccactggtgctcggcggcggggtggtggcgtcggagcccaggaaggaggtgaacctgtggcggcgccgccccatgtcccctcccactccgctggagctcccctgagagcggtcgccgcagcagctagcagcagctagcaggcctgcatgcgcgcatgcaggccatgccaaacgtgtcgatcgtctgttctttcatccctagagtttgtacagtagtggtatacttctacgtgatgctcatacaaagtaggtagtatcgatttgattttgtaaacgcgtgatgatccctattctggaaggaattgaagaagttttttttaaaaaaaatcagcaggagtgaaagcataattttgcaaagtcgacgaacgagcataatttcgcacacacgcatccttgcttgctttggttg

SEQ ID NO: 63701 - DNA, 250 bp, Triticum aestivum
  Clone ID: PAT_TA_63701
tttttgcgggggcaagaatgctgctgggtttccgcgacgcacacaaagctaggaccatggcgccagccggaggacgcactacccatctgctcctgctcgccctcctgctgtccttcgtcctcgcctactccgcggacgggagctacctggagcaccccagcccgggcgccgggggattcttcagtggcataccgtggttccgcggcggacagacgagtggagcccgaggtgccggaggcatgggcgccgg

SEQ ID NO: 63702 - DNA, 323 bp, Triticum aestivum
  Clone ID: PAT_TA_63702
gtttgctagctcaagaagaaagaaagaatctgatacattaagctaggcagcatgtacatgatctccagcatgctgggccggaggcagccgccggcgcatccgcagccgcagtagcacgcggagggtcacaaggacaacggccacggccacggcggacgccgggactaggatgtggagccagtgagcatagacatgctggagccggtcatggaggccatctcgctgactgctttcggacgtggcggttgccgcccagcgctgggcctgccggtctccacgacaagcatggactggaaggagacacctaccgcgcacgtgtttat

SEQ ID NO: 63703 - DNA, 412 bp, Triticum aestivum
  Clone ID: PAT_TA_63703
acagcataccttctgagactcgagtcatcatcaacgcatgggctattggcagagaccccgggtactgggacaagccggacgacttcgtgccggagaggttcctcgagggtggcgccgcggcagcggtggacttgacgggcaaggactttcagttcgtgccattcggggctggccggagaatatgccccggtctcaacttcgggctggctactgtcgagatcatgctggcgaacctcgcatactgcttcgactgggagctgccggtcggcatggagagggacgataaaatcgatatgacggaggtgtttggtctgactgtccgtaggaaggagaagctcatgcttgtccccaacacccacgtggttgcttgatcggtacatagtgcgtccatatttgtataccgctgcatgcg

SEQ ID NO: 63704 - DNA, 380 bp, Triticum aestivum
  Clone ID: PAT_TA_63704
tatctcacacgaagctcatagccattcaaagcctatccatctgcgaagctccaacccaacctcgaagatgtcgtgctgcggaggaaactgcggctgcggcaccgcctgcaagtgcggcaacggctgccgcggctgcaacatgtaccccgaggttgaggccgacggcgccaccctcctcgtctacgtcaccgacacccacaaggcgagctccggcgggatggagatggcggccgagaacggcggctgcggctgcacccagtgcaagtgcggcaccagctgcagctgctactgctgcagctgctagatccatcatcgatcatgcatgcaccgtgccgagcgtgcatcatcgatcgtatcgatctactactaccataccatgt

SEQ ID NO: 63705 - DNA, 298 bp, Triticum aestivum
  Clone ID: PAT_TA_63705
ctcttgcgtccgcccacgcgtccgcccacgcgtggggccactcttacgtggccgggcggtctcaccacccccacgcgcacccacatccgcacccacctccgcatcacccgcacccgcaccatcacatgccgccgccgccgcagttcgccaagcactacgcgccggggccgccgcctccccctgccgcggccgggcgacgcacgccgaccccacccgcggccggatccggcgggaacggctgcgaggagaataagacgatctgggtcggcgacctccagtactggatggacgagaacta

SEQ ID NO: 63706 - DNA, 377 bp, Triticum aestivum
  Clone ID: PAT_TA_63706
ttgaattcctcgcgattcctctcccctcgcctgcgcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagc

SEQ ID NO: 63707 - DNA, 185 bp, Triticum aestivum
  Clone ID: PAT_TA_63707
tgcttcctcctctcgaaacacccgaacggccgggtggattggattgggcagaggaggcgcccactggtggtgatggcctcctcgttgactacggcggcgcattcggtgtttcggggtggggccaaccctctggccgagctgaccgaccgtttcaggtcgctggaggtcggggtgcgctagtggat

SEQ ID NO: 63708 - DNA, 112 bp, Triticum aestivum
  Clone ID: PAT_TA_63708
ttctgctgacgcgtgggcggacacatgcgctaatgcagatgtacgttccatggaccccggcgacgcgccctcgcaagagttgttcaaccgcacggaccatccacgcgggcag

SEQ ID NO: 63709 - DNA, 148 bp, Triticum aestivum
  Clone ID: PAT_TA_63709
ttcttctttgctgttcgtctccacattattctctccggcggctgttactcgactctcggcgaggggcggagatgtcctacctactcccgcacctgcactctggctgggcggtggaccaggccatcctcgccgaggaggagcggctcgt

SEQ ID NO: 63710 - DNA, 210 bp, Triticum aestivum
  Clone ID: PAT_TA_63710
tgtttctgcaagcattgagggtgatgtaaaaaatctctgggagggtaagacttccacagcgctagaagagatgcaaaatcaaattgagtaccagatgcgctctggaactgcaaaagtagatgtatactggctggccatcttaaaacgccttcatatatacaaagcaaaggcttgcctgctggaaatccatgctcctctcttacgtaagca

SEQ ID NO: 63711 - DNA, 350 bp, Triticum aestivum
  Clone ID: PAT_TA_63711
tgattaaatcagccgccggcgccgcacattgtgggggcatagtaatatcatcatccaatcctcacaagaggacgaggagggggcacaagggtgttctgcagcttcaccatctgcctcttgatactttaagtgacattgtgtcattgttaagcttcaaagaggctgcgcgcatgagcgtactgtccagccagtggagacatctctggagatcatgtatcagagacctggtcttcactagggagacaatgtgctgccccatgcccatgagccgagtggaacatgatcgagaagctttcatcaggaatgttgagtgcgtattgtgccaacttgatcccaccattgctagggac

SEQ ID NO: 63712 - DNA, 285 bp, Triticum aestivum
  Clone ID: PAT_TA_63712
ttcttttggagacgaagaatgagaagccaccatcttctccatcagatatattgtctccagaacaaaggaagattccgatagctgatgctccatcttcccagtgtggtttgttatctagagaccaaaggaaagctccacccgtagattttattaagccatctgaaccacctgcgtgtcatatggaagctgatatggtgatcactgctgcaactccctcctcggaggctcaaggtactactggtaaaaaagggctacttgaaaggattcagatactatggactggtc

SEQ ID NO: 63713 - DNA, 99 bp, Triticum aestivum
  Clone ID: PAT_TA_63713
ttctttgtgacgaagaactaacacttcgctagctgtgatagaaaacaaacattgaaaacatagacgctcacaccatggcaaccaatgggtactccaatg

SEQ ID NO: 63714 - DNA, 291 bp, Triticum aestivum
  Clone ID: PAT_TA_63714
tgtttcttcctccgcatcggcagcctcacctggctctcattgctctacttcgagatagagggccactccatgatggtcgtggaggccgacgggcactacgtgcggtcgttcgcggtgaggggcctcttcatctactccggcgagacgtactccgtgctggtcaaggccgaccaggacccgcggagaaactactgggctgcgtcccacgtcgtcggccgcaaccccagccagacaccgaccggcaaggccgtcgtgagctacgccttcaacggcaacaacccgtggatgcct

SEQ ID NO: 63715 - DNA, 328 bp, Triticum aestivum
  Clone ID: PAT_TA_63715
tcttttgcccacgcgtccggaaaaacacaaagaaacaacagcgcgccgctccagctccagctcccgaggcagctcaccggcggccaccgttcgacccctcccccgcccattcccgcggcgctcccctccgcccgctcgccgccggctggtgatgctacgggcccccggccccgccgcggcgacaccggctcgcagctagatctggcccgcaggaggttcccgggcggcatggggcggttcgcagggctgcggtggctcctcctgctgtgggtggcagcaggggcgctggccgcggaggaggatagcaaggcggccgtcggggcgcccg

SEQ ID NO: 63716 - DNA, 251 bp, Triticum aestivum
  Clone ID: PAT_TA_63716
tggctccgtgctgcccatggacggggatgaggtcctcgtggcttccgctgacgacgaccacgacgacgatgcccggccgcgccccggggagaggctgggctcgtacgtccgcgacaaggtcggccgcgcgctgtcctgcctccgctgcggctgccgtgactcccggtcggcggtgggcttcgaggacatggacggcgtctacgaggttggggccaggaagatcagaggcgcggcggggcccagggtgttca

SEQ ID NO: 63717 - DNA, 344 bp, Triticum aestivum
  Clone ID: PAT_TA_63717
tttttgtggacgcgtgggcggacgcgtggcactccggtctttctgttcttctccctgcatccatcggctcaaccatccactgctccgaccgactctacaatctagtacatacgtgcatgatggcatcgcgcaccatgtgggtgaacggccccatcatcgtgggcgcggggccggcgggcatcgcggcggcggcctgcctgcacacgcgcggagtcccctccgtcgtcctcgaccgcgacgactgcctcgcctcgctctggcagcgccgcacctacgaccgcctgcgccttcaccttcccaagcacttttggcagctccccgggatgcccttccccgaccactac

SEQ ID NO: 63718 - DNA, 288 bp, Triticum aestivum
  Clone ID: PAT_TA_63718
catatcatatctggcatgatccatgacttattatcagaaaaaactaagctttcggcgactaaagaatattgccggccgaatgaccctgcagcaggaacagggacatggcatctacaacttaattgcccaaaaaagcatcgttctaactgaacaggaccataacaagatatcccccaaagaaaggtacatggtgcctcatccaacagtgcattcctcctgagctgaccgactgattattcagcatttcagcatgtatgttagtatgtgctcggtgacattgcggtattc

SEQ ID NO: 63719 - DNA, 211 bp, Triticum aestivum
  Clone ID: PAT_TA_63719
ggaccctatcttccactgcccataccacctttttgattgattcactcttttcgggagtcgatttctattccaccatcacctgggccaggtttgaggagctcaacatggacctcctcaggaagtgcatggagccagtggagaagtgcctgagggatgccaagatggtcaagatcaccatccatgatgtcttgcttgttggtggttccaccag

SEQ ID NO: 63720 - DNA, 318 bp, Triticum aestivum
  Clone ID: PAT_TA_63720
tcttctgaccggagatagcccgcgccgcatcgatctgcgtttacggcctgattcctcagatcttcgcgtacgccgtcaacttccccattcagaagttcctgcaggcccagagcatcgtcctgccgagtgcttacatctcaacggcaacactcgttctacatgtgatgctgagttgggtgctcatgtacaaggtcggccttgggctgctcggtgcctcactggtgctgagtgtgagctggtggattatcgtcggagcacaatttgtgtacattgtcgtgagcccgacgtgccggcacacgtggacgggattcagttggc

SEQ ID NO: 63721 - DNA, 201 bp, Triticum aestivum
  Clone ID: PAT_TA_63721
taccttttcgcctacctgggcgggaactcttccccaagtgccggtgacgtcaagaacatccttgactcagtcggtgctgaggctgatgaagaaaagcttgagttccttcttgctgaactcaaaggcaaggacatcacagaagtgattgcatctggaagggagaagtttgccgctgcgccttcaggtgggggtgccattgct

SEQ ID NO: 63722 - DNA, 173 bp, Triticum aestivum
  Clone ID: PAT_TA_63722
gtgcttcgcgtccggcagcagccgccgacggcagatgcttatagggtcgacaaaccctaaccctagtccatggatagcttagctgccttcctctggatctagctagagccatggcgcctaccaagggcgaggggccggacataggcatacacctcggcaccacctactcgtgc

SEQ ID NO: 63723 - DNA, 289 bp, Triticum aestivum
  Clone ID: PAT_TA_63723
tgggtacccgccgctcttcctgtacatcaccggggccactgtcatggggtgcaagcaccaggcataccccggcggtcccaacgccgccaacgctgcctgcagcgccgtgggaattctcggcatcatctgggcgttcggcggcatgatcttcatgctcgcctactgcaccgacggtgtgtgcgggggacacatcaacccggcggtgaccttcgggctgttcctggcgcgcaaggggtccctggtgcgcgcgcatgctctacatcatcgcgcagtgcctgggcgccatctg

SEQ ID NO: 63724 - DNA, 218 bp, Triticum aestivum
  Clone ID: PAT_TA_63724
gcgtccatcgcgttcgcccacgcgtccgaccggagccaactaattggacatcgagaggaggaggacgtctttagactcagcccaccggaccaagagaggagaacggtcatgcttgacgacgcctccgtccacggcaaggagtgcgacttgacgaggggagtttcggatgggggaccatgtggtggtgaatgtggacggttctgcgaacaccaaggatg

SEQ ID NO: 63725 - DNA, 458 bp, Triticum aestivum
  Clone ID: PAT_TA_63725
tctttcttccacgcgtccgcccacgcgtccgcccacgcgtccgcccacgcgtccgggatcttataaagtagaacaacaatatgcctaaatccatcgtcttggcaatctgccgctacttctatctataggatgaagggtgcaagctgggccacatacccggacctgtcacctaagcctaacatctaaagccgaaggcccgactgagccatctgtcaggtccagggcacaaaccggtccgacgcactcacatgtgttgtcgccgccatcttccactcgtccatctttagagcagattgacgtgtcaaccttggcaggtcctctgccatcgatgccaccacgacgccaaacgacgacctccacctacgcgagccttggcaggtcctccgccatcgacgccaccacgacgccaaacgtcgacctccacgaacgcgagtccatctgcaagcaacggacgtaga

SEQ ID NO: 63726 - DNA, 414 bp, Triticum aestivum
  Clone ID: PAT_TA_63726
tgttcgtgccgcctcgtcatctgccgtagctgccatgagctttagccccggatgttcgccctcctctccaatctcttacggaagcccgccgtcccctccgggattctgttaccggcggcacccgacgaccaccggaatagcagctcaggtggcgtcgaccctcaccacgtcctgcgatggctcgacgaccagcctcccaagtctgtcatctacgtcgcgctggggaccgaggcgccactgacgctagagaacatccatgaactcgcgctcgggctggagctcgccgaggtgcgattcctctggctgctaggcaagcctgccggaagcaacaaagtcgccgggccattgccggccgggttcgaggagcggacgcgggcgcgcggtgtcgtctgcacagggtgggtgccacagatg

SEQ ID NO: 63727 - DNA, 287 bp, Triticum aestivum
  Clone ID: PAT_TA_63727
gtggtattccccattccccatctccctccctgtcgatggccgtcgccgccgccgctgcttccatggcccgcaggctggtctcccccaccacctcctcgccgtgcaccgccatacgcctcctcatctcccgccgcatggcctccgtccggtccatcctgagcgccccggccgcggtggcgagggagatgctcagcccggcggccggggcctgctcgtccttcttccttctccgcggcgccgggggcgccaggggaatggcgcggcggccggggggcgacgggtactcc

SEQ ID NO: 63728 - DNA, 368 bp, Triticum aestivum
  Clone ID: PAT_TA_63728
ttctggtctcgtctgcgacgtccgcgccagagaactccgccgcggcactcgacgtcatctcctcgctccggctcccggagcggtgcctggcgcgcgccgtcgacagggatggcgcggcgctggtcggcgcgctcgtctccaccctgcagggacactccggccccgacgcggatgcggcgtcccgggcacgcgcagccgtgctcctggcggacgtgatggcgtgcatgtcgccgagcagggcggcgtcgctcccggagcaggcgttcgtcgaggctgtgcggctgctccgcggcgacgacggcatgggcgcctcgacctcgatggcgaccaaagcggcgctgcgggtgcttgcaggcgcgaccgcccac

SEQ ID NO: 63729 - DNA, 245 bp, Triticum aestivum
  Clone ID: PAT_TA_63729
ctataaaccttcatcaagggcgcgctttaactgcctgggcggaccagttatagccttctccatcatctgttgctacctgcatcaaaccatctgccacatgtcgcacctgagcatcctgaccttcaagttcaacctatcgaagctccggttcaagcccttccgtacggccggacggctgctgtccgctcagggaccggcagcagtccgacctgatgatgtacaagcctgacgaggaggagatggcc

SEQ ID NO: 63730 - DNA, 447 bp, Triticum aestivum
  Clone ID: PAT_TA_63730
tgttcgcgtggggcgcgcctggctcgtccgggaccgcctcgacggccgcttcctcctcgaccgcgccgcgcccgccggctccacggccttcaccgaggtcgccgtctgcgacccgcttttcccggcgctgcctcctgctcccgccaatccccgacgccctcgccgtctccgtcgacaacccctacctccagcgcggcggcgacgacggggggctccagtcgcgcagcaacgagatcttcctggcttctcgcggcaacgacgaccgcggcgaggagctgccgttcgccgtcatctggatggcgtgctgccgagggaagctggtcgcgttctccttctgctctggatctcgggaatggagcgcgctttcgccgccggtgcaccacgcgctcagcatgcggagggtcatgggtgtccgactggggcagcgcaaccatgcccacgggtgct

SEQ ID NO: 63731 - DNA, 443 bp, Triticum aestivum
  Clone ID: PAT_TA_63731
gtttttagtgctgtgacccaaagcattggaccttcaattcataagctgaaaagatttgataatttggatggtagttactttggctttccacctgatccattttccgcatcacgatccagacaacaggttgcaatttcgagcgagttggagcaaaggaactgcctgatgtttgaacattcagcagcacggcagtctcatgggtatcctcagtccacaaacggcaagggcacaaagaactttaatttgaatgaagcactgtcagatggtctggaagagcttgtagaacaggatgggagatctgttggtagtttgcagcatagtaaaggtgaaggatcagtatttgggatctcttggctaaaaaataaagctacttgtgctgacccaacaaggctggaaaagcaaagaaagatgcttggccattccaacgggactgcagcagacac

SEQ ID NO: 63732 - DNA, 287 bp, Triticum aestivum
  Clone ID: PAT_TA_63732
tgtattcatttctcaaggcggccaggcacctggagtgtgctatgcaacacgttctgtccagttccagattgtcgcctggatagagtaactgttgatgaccgcctgcattttcttgttggtaaggcctttccatgcaagctcttgcttaggcctcctgcaacgactcaatccagcacaacccttttgcagctagccaggcctaggcaggcagcattcatcatcgacagacaggtcaccttgtgcgcttgcatcaacgtgcagactcgcacgttgatcaaaggatggtt

SEQ ID NO: 63733 - DNA, 208 bp, Triticum aestivum
  Clone ID: PAT_TA_63733
taacatctagcttgcaaacaactgaagaaaaggccatcttgtgttgcatgtcgtacatagtgtagataagtgcaacaattaataaaagatcgtgctcgtctaatccttggattgatgcatcttgttaaggagtacaatcgcgttatgtgttccatatttgtccctcaaaggtcaaggggtgaatcaaattgtgttattagaaagctat

SEQ ID NO: 63734 - DNA, 417 bp, Triticum aestivum
  Clone ID: PAT_TA_63734
aatctgcgaggatcgatggggcagaggttcaggttcttctgctgcggctgcggggccaatgcggccgacggcgacatggaggtggacgacgagtcggagtgcggcgggggcaaaggggggcgaggaggccggggcgcggcagctgtcgtgggcgcaggtggagaggatgacgggcgggttcacctccgccgtggtcggcgagggcggcttcagcaccgtctacctcgcgcgcctctccggcgcgctcgccgccgtcaaggtccaccgcagcagcgagcgcatccaccgcgtgtttcgtcaggagctcgagacgctcctccgcattcgccacccgcacatcgtccgcctcctcggtttctgcgagcagcaagatgagggcgtgctggtgctggagttcgcggcgaacgggaacctgta

SEQ ID NO: 63735 - DNA, 196 bp, Triticum aestivum
  Clone ID: PAT_TA_63735
tttttgtcatggcaaatgtttgctagcagttacgtagattagtgtcagcgtgcgtttgtctcctctcaatcaacacacatgcacattaaggacagtagatcctgctcacttcgtgggtagcacgtgtcctaccttcggttgtaagtaattctgtatagataggcacccgatcaatggaaaagttgtgttgaatcat

SEQ ID NO: 63736 - DNA, 301 bp, Triticum aestivum
  Clone ID: PAT_TA_63736
tttctctagcggctttattacctaccgtgaagaagagagataaaaaggttcgagtgcgttctagagtgaggagtgtgaagagatggctccggtgaagctgttcggcgcgaccctgtcgtgtaacgtcaccaggtgcgtggcggcgctggaggaagccggcgtcgagtacgagctcgtccccatcaacttcggctccggcgagcacaagggccccgaccacctcgccaggaacccttttggccaggtgccagctttgcaggatggtgacttgtacgttttcgaatcacgtgctatttgcaag

SEQ ID NO: 63737 - DNA, 268 bp, Triticum aestivum
  Clone ID: PAT_TA_63737
ggctgatgacggccaccctgcacggcacgggtgcttttggcgtaataatgcccggcctcttccagtcaacgtgagttggtccgactgggcggaggagagcgactcttatgtggcctggcaacctgtgtcaatatgccttcgacgccaccaaaggctggtacaaattcagaaaaaaggacctagttggaaatttgacattcgccaagagacttggagagggcactgttgattcgcttgttcttgactggtcaattagcgatgggagatg

SEQ ID NO: 63738 - DNA, 287 bp, Triticum aestivum
  Clone ID: PAT_TA_63738
ggctgtctccccgtgggcgctcatcctcctcctggccgcggtcttcaccgcaggggccggcgcgacgaccttctccatcactaaccgctgctcctacccggtttggccggcggccattccgggtgggtggcggcagacggctcaacagtggcgacacctggaacctcgaggtccctggcggcaccagcgccgtcaggatctggggccgcacgggctgcaacttcaacggcgacagagggagctgcgccaccggcgactgcgctggcgctctatactgtggcttgtcc

SEQ ID NO: 63739 - DNA, 177 bp, Triticum aestivum
  Clone ID: PAT_TA_63739
gtagcgcaaccaccatgacgcctacccgctacctcgcggtgctggccgccgccgccgcgctactcttcatgctcggcggcctgcacggcgttaaagcggggccggcggacacctgactgcgccgttgcccagacggcgttcggcgactgcaccggatacgtcgccggcgtggaggac

SEQ ID NO: 63740 - DNA, 281 bp, Triticum aestivum
  Clone ID: PAT_TA_63740
tgttctcagacacttctcccgtcccgtccccaggcgaccttctatccccgtctcgcgtcgtatcggcagttccactccctcgccatgggcaagattaagatcggaatcaacggttttctgatgggatcgtgaggctctgtcgccagggtcgccctccagagcgacgatgtctagctcgtcgccgtcaacgacccctttatcaccaccgagtacatgacctacatgttcaagtacgacaccgttcacggccactggaagcacagtgacatcaagctcaagga

SEQ ID NO: 63741 - DNA, 192 bp, Triticum aestivum
  Clone ID: PAT_TA_63741
tggacgcgtgggtgcgagtgatggatgcctaggcgcacacgaccgatgaaggacggggactcccgccgaaacgggtaggcgagccggagtcaggctttgaccctaccatctccgaatggggcaaccccaccaccgtgatgggtggtgatcctgtggtgaatctatagtcacaggaagggcaccgggggaact

SEQ ID NO: 63742 - DNA, 183 bp, Triticum aestivum
  Clone ID: PAT_TA_63742
tggatggcgcaagggatgacaagtatggcggtagcatctgcagcagacgctatgggcctgaccgcggaggtgaacgctattctggaagtcgagatggaggaagccccggcagcggtggcggcgatcgatacagccgagacaggcctggaccgtatgatcgacgcagccgagatgaatactgat

SEQ ID NO: 63743 - DNA, 220 bp, Triticum aestivum
  Clone ID: PAT_TA_63743
gccggcgccgacccggtcctggccgcctcgtgcaccatcatcagcctgcagagcctggtgtcccgggaggccgacccgctggactcgcaggtggagccggtggccatggtcaactgtagcggcggcgacccggcggatccgttggtgctgggcggcacgttccgggccttctcgaacgcgagcttctacacgctgcggcggcggatcgaggaggtgatga

SEQ ID NO: 63744 - DNA, 192 bp, Triticum aestivum
  Clone ID: PAT_TA_63744
actagcgctcgtcaccccccaccactgcctccgagcattacatgcgtgcctcccccatcttctccctccccgcaactcgctgctgctaccacaaccgaagctcactcccgtggccacgcagaacaaaatgcagcgagcaattcaagctatcggatcacatggcagcgtgcagaaatctgctgtcctgcaaca

SEQ ID NO: 63745 - DNA, 300 bp, Triticum aestivum
  Clone ID: PAT_TA_63745
aactgctcgggcggcggcaacgagcttttcaagctcaaggtgatttccggcaggacgtacatgctgaggctcatcaacgcggcgctcaacgacgagctcttcttcgcggtggccaaccacacgctcaccgtcgtgcaggcggacgccagctacgtcaagccgttcgccgtcaccacgctcgtcatcttgccgggccagaccatggacgtgctcctcaccgaggccaccaaccccgtctccacggtcttcgccattgccgtcgcgccctacaccaacaccgtgggcaccttcgacaacacc

SEQ ID NO: 63746 - DNA, 277 bp, Triticum aestivum
  Clone ID: PAT_TA_63746
tgatcggtcagcgagagagcagacggcgcccatgggttcctttatctgccccggcagcagcttacccaggaaggcagccgcgccaagaaccagcaacaaaacccgagcgtaggagacgagaggagaagagagaacctattctccccccactcccactcctcgccacacttggagagtcgtcggacgatcggcgccagtgcacaatgtttcaagggtgcggcctgttcgcgtgcgtgagccggcgcggcgccgacgttaggaagcggggcgaggcggg

SEQ ID NO: 63747 - DNA, 191 bp, Triticum aestivum
  Clone ID: PAT_TA_63747
caaggcacttttctgtcgccaaaggataaaggtgctgctgaagaacctttgaaggctgtgggcacaaaacggctgcatactgatgctccttcaagccccgcttatcataatgtttatgtacggcgaaaggtggcaaccgaacataataaagtgaactcgcctccggagatgaaggttattggcaaggacaa

SEQ ID NO: 63748 - DNA, 343 bp, Triticum aestivum
  Clone ID: PAT_TA_63748
ttttccattcagctcgagcagggcgagtaaaggagcgtgcgcagagaaaggagtgaagagaggcaggccccaggccataattctcactctcagcagccaaatcaaggacaggcaggcgcagagcagaggaccaagctcgcaatgggcatgggcatggcttctcccttgctttcctgcgccatcatggcactcctagccgccgtgctttccccgccatccgtcgccggcgaccccgacttgctccaggacatctgcgtcgccgacctcacttccgccgtgaaggtgaatgggttcgcttgcaaggccactgtgaccgatgacgacttctacttcaaggggctgg

SEQ ID NO: 63749 - DNA, 405 bp, Triticum aestivum
  Clone ID: PAT_TA_63749
tcgtccacgcgtccgattagcagcagtcgctaactccctctgctcatctcgtttcaagcagcaagtgtcaactctcaacaccacctctacaaaagcaatcgtgcactctggtgatgctctctggtttgtgccgccatccctgtcgatgaagacctccgtggcctccttctagtgccccgtgccgatcgccgatgctttggccggaattcttgcaccatgccgccggttcctgacatgctcgtgcggctcctcgtcgcgtccgtgctgctcggcgcagccagtggcgcgtttacccccgcggacacctacctcgtcctctgcggcacgtcggcgagcgccaccgttgccgcgggacggacgttcgttggggacgcccgtctgcccgccaagtcgctggccgcgccg

SEQ ID NO: 63750 - DNA, 472 bp, Triticum aestivum
  Clone ID: PAT_TA_63750
ctctcttggggggcctggaggtggccgacatggtcgtcgacatcttcttcgccgtcgacatcgtcctcaccttcttcgtcgcctacatcgactccaggacgcagctcctcgtccgcgacaggaggaggataaccttcaggtatctgtcgacgttcttcatcatggacgtggcgtcgacgattccgtaccagggcatagcctacctcgtcaacggcgaggtcagggaaggcatggtgtacagcctgctcggcctgctccggctctggcgtctcaggaaggtcaagcagttcttcacaaggctggagaaggacatcaggttcagctacttctgggtacgctgcgcgcggctcatcgcggtgacgctgttcctggtgcactgcgccgggtgcctgtactacctgctggcggaccggtacccggaccgggacaagacctggatcggcgccgtgatccccaacttccggcaggagag

SEQ ID NO: 63751 - DNA, 265 bp, Triticum aestivum
  Clone ID: PAT_TA_63751
ttaggtatgtggctctgatgacatatggggatgacatcatcatgggtgtgagctgtgctgtgcgcggttttgaccacacagggatgcagatcgaattagccaagatcggcgtggtttacaccatggccgataaggaagcagaatccgttccatttatggatatctcggaggtttacttcttgaagcggacgtgggttatctcgcctgaggtgggatcccatattgcgatattggagcacgattcgatcgataaaggtctcctgta

SEQ ID NO: 63752 - DNA, 153 bp, Triticum aestivum
  Clone ID: PAT_TA_63752
ttttgtcatgtatgacattggagcggtctttggacattttgccatcgcacatgaggatgtgcccaagctgtctgagacacttaaatgatatgaccgttgtaagatcactcgcgatcctggtcctgtcaagggagggtccactgtgattgcctt

SEQ ID NO: 63753 - DNA, 388 bp, Triticum aestivum
  Clone ID: PAT_TA_63753
ttctcttcgtccgcccacgcgtccgcccacgcgtccgcccacgcgtccgcaggcgagcagcgaccaccttccggcgagggtagcagcgatggagggcaaggaggaggacgtgcggctcggagcgaacaagtactcggagcggcagcccatcggcacggcggcgcaggggtccgaggacaaggactacaaggagcccccgccggcgccgctgttcgagcccggcgagctcaagtcctggtccttctaccgcgccggcatcgccgagttcatggccaccttcctcttcctctacgtcaccatcctcaccgtgatgggctacagcggcgccacctccaagtgcgccaccgtcggcatccagggcatcgcctggtccttcggcggcatgatc

SEQ ID NO: 63754 - DNA, 317 bp, Triticum aestivum
  Clone ID: PAT_TA_63754
tctttctatgatccctctacacctggaaagggcgggtcctttagattccctggggtatacaccacataaaaatcattctcaggaggaccaaatcacccgacccaagccaaaaccaaaacaaataccatcacacagtcagccagccagacaagccagggagcaaaaaaatcccccccaccctccctgcaatagcaaacacgcggaaaaaaatggaggcatgaacacgccctcctactactcctccctctcctgcgtccccggctacccctatcccgtcgacagcccatgggccccgcccccctgctccctgcgggaac

SEQ ID NO: 63755 - DNA, 359 bp, Triticum aestivum
  Clone ID: PAT_TA_63755
ttttcgcgagtctctttctttcccctttctggggggcgttgctgtaacttggggggtgctaatgacgttaaattcggccctcctcttcctctctcctccgccggcgctgccggccggagtggggaaggaaggggagtgtgtccgcttgttgttgtgtttgttgtttcgtttcttcttttcccttttcgcagtggagatgggtgcttggagcttgcaagtggtggccagcgcctgatggcggtgctctcctcgtctgaggcgctccagaggacggagccaggggaggttgggctaatcgtcggctccaccatctgaataaacttgcccggttcccggatctgcaggaggaaccccggttt

SEQ ID NO: 63756 - DNA, 328 bp, Triticum aestivum
  Clone ID: PAT_TA_63756
cgttctcttgggcttacattcatcgatttctcatgagggtttattttagcattgagtcgggtgaatcctttcgatcttaaagagatttttatattccactgacatttttgtttgagattcgtgagtgaatcgagaatggttgatctagattctagaagctgatgaaaaagattagaacggtcaataactcctaccccaaattttggttgaagctagacttggttgatagagtaaagaaggtacgacttcaacatcaaggtgttcccgggcgaacaatatgctagtcactggtcagtgcaatttaattttagaatcatggtgagcttat

SEQ ID NO: 63757 - DNA, 434 bp, Triticum aestivum
  Clone ID: PAT_TA_63757
ttttcaagaccggaaggagcggagccgccgagccgggaagagccaccatcccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggca

SEQ ID NO: 63758 - DNA, 352 bp, Triticum aestivum
  Clone ID: PAT_TA_63758
tcgtcaccggggccaccgtggacgccgacatcacgcgcatgtctccggtggggccccaaggagtgggcccgccccatcgtccgcatcgcggtcgatggcgccgtcgacctggtggaccacgccgttgcacgcgccttcgggcaatgccactcgttcaattacctgcgcattcaggcgaagcgggagagcatgccgccgtgcgggccggacggggagtacgacccgacgcaggcgaacgtgcaggcgctgctcgcggcggcggacgaggcgatgaagcagcgcaacgtggagtcggtgctcttcgaggggaggcggatcggggagcagaccaacgcggagaagctggagtggt

SEQ ID NO: 63759 - DNA, 411 bp, Triticum aestivum
  Clone ID: PAT_TA_63759
tttcacgcgtccgcccacgcgtccgcccacgcgtgcgcccacgcgtgcgcccacgcgtccggtctttttcttccacgacacgttgaggccagggtccatgatcactccgaccatcccgccgaccacctacatgccggcgcttctctccggcaacgtcgccgactccatcccattcaccaccgagcacctctccgacatcatcacgatgttcgcgccggcgtcactcacgatgaccagagagatacggtggacgctggacacctgcgagcacccacggacgctccccggccagaaagcaggctgcgccaccttcctcgagtccctcgccgagctgccggtgtccctgcttgggaggcgaaacgtgcgcgcgttctccgccgtggatctgcccatggatgccgcggggacacc

SEQ ID NO: 63760 - DNA, 218 bp, Triticum aestivum
  Clone ID: PAT_TA_63760
ttctttaccattccagctccaccacgcggtcaggggggctttcacatcgggagagccttagatcccacagctccatccccacttgttccgatccattcatttcacctttggcgcgtgtgggtacagccatcaggcatcagccatggctgccggaggagtggtgctcaacctgcgcgtcccgtcggcgtcagtggcgccggcacggcggtgtgggacgg

SEQ ID NO: 63761 - DNA, 417 bp, Triticum aestivum
  Clone ID: PAT_TA_63761
ttcttcccaagatatggtttcttgcggtcatctactttattcttggttgcccaggtgcctactatctgtggtaccgaccactttaccgcgccatgagagggattttcccatcgatcagcttgataggaaagagcgtcgcagtaggggtgttctactttcttggctttgcaatgttttgcatcgagtcatcactaagcatgtgggtcattcagcgcgtgtatcactattttcgaggaagtgggaaagaagcacagatgaggcatcaggcagcacgtgccacaactagggcagcattttgatattgaaaagcaatgcatacattgatatggtttttactctcgcaacttttaaattgtagagacttgtaagttaactggcatgtaggactttgtttgtcctatgcaaaagtttatgccc

SEQ ID NO: 63762 - DNA, 415 bp, Triticum aestivum
  Clone ID: PAT_TA_63762
gttcttcagaactaccttcttctgggctacaggtggccttatttcaaggctgggggcactcaaggacgcatcatcttccacaagtggaaggagggcaagtgggccatcctcttctcgcaccctggcgattacacgcccgtgtgcaccacctagctgggcatgaccgccaagctgcagcccgagttctccaagaagaacacgctcgtcatcggcctcagcgtggacaacgtcgatgaccaccactggtgggtcaaggacatctagtcgacccagaactgcacggtgaactaccccatcgtggccgacccggacaggacggtggccgagacctactgcatgatccaccccaactcgcccctcaccatggccggcaagctcaccgtccgcaccgtctggatcatctaccccaacaaca

SEQ ID NO: 63763 - DNA, 290 bp, Triticum aestivum
  Clone ID: PAT_TA_63763
ttcattgcaaatcaatatgtcccctttatagttgctggtggcaaaaaatcgtacttcactacaggtgctgttgctcgaattgcactggccgatggggttcttgtgatcgccctcattttggtgggactattctctttgcgacagaagagaacgaacacggaactaaaataacgaatcaccaacccttttgcttcatggggcgcggcgcataaagacagcggaggagctccacagctgacaggagcgaggttcttctccttcgaggagctgaaaatctgcacggacaactt

SEQ ID NO: 63764 - DNA, 376 bp, Triticum aestivum
  Clone ID: PAT_TA_63764
tttctctgactccgggaggcactgaattctcggggggggttctctatactgccggggggtgatctgatcgggtctcccgcatactattcgggcctcttgcttccggacacagttcgggccgaacaacgttgactaaaaaaacagagagagagaagcagcgcagagtggctacctcatgtcctcttcaggctatgtcgctgttctcggtgctcggtgatcttcgatggcacaaactatgcagagtttacaggtttcatgcgtattcacatgcgcggtcttctgctgtggggcgttctctctggcgaggtaccctgtccgccctgccctgttgcttcggttgcttctgttcccccagtgcccccggtgcttgctgttg

SEQ ID NO: 63765 - DNA, 226 bp, Triticum aestivum
  Clone ID: PAT_TA_63765
ttgattcgtgggggtgttcaatcctgcccaccagtatattcttagttaaaaatggatcattcaaaagggaccaccctcgcctttttcttccttataaattgtataagttccaaatttttggttcctagcttgatcacatggcaattggcaacatatgtcataaaaaatgatagtctataaaacgatcatgcacgtctggacaagcatggatgaatgggaggggatt

SEQ ID NO: 63766 - DNA, 172 bp, Triticum aestivum
  Clone ID: PAT_TA_63766
cgcgtccgcttttgttccacacgagatttctgttctcgttgagctcatgtggatgccttgcaactgcggatcaggctgcagctgcggttcagactgtaagtgcgggaagatgtaccctgatctgacggagcagggcagcgccgtcgccgaggtcgacaccgtggtcgtcctc

SEQ ID NO: 63767 - DNA, 227 bp, Triticum aestivum
  Clone ID: PAT_TA_63767
tttactcgtgggcggacgcgtgggattgttttgtttttatatgtttacggttattcaatcacatgtgcaggtgtggtgacacttaaaaaaattaaatgtacaggtgttgtgtacgtccgtacgtgtgcatcgtatacatgttccatacgggctagacgacaaccacaggcccggtcatttgacttgattattcagtactcatacatgtccaggacatgtgtgtgtgc

SEQ ID NO: 63768 - DNA, 99 bp, Triticum aestivum
  Clone ID: PAT_TA_63768
tttattcacctgtaccgacccatgtccggtacaacaaccgcctcaaggacacaaccatgcacgggcgccgccatgtggacgactccctggccagagccc

SEQ ID NO: 63769 - DNA, 482 bp, Triticum aestivum
  Clone ID: PAT_TA_63769
tcgctatcgcgtccgaatcattagctacatacagataaatgtacgatgtattccatgttaggattttctgaagctcgattgccactacttctctagctcatatgtgataatgtgatcatgcaattgtcatgggtttaactgaatcttgttatcaattgtcatgtatgacagtacgacacatttgtcttgtacaggagtgcagttctgtatgtgatcagattttcttaggctgtattgttgacggtcatgtctgcttgttgttgtcatggcaagaaatatttttagaatattctgcattgatgatttttatcattaatcaaatgctacataaattgtttattgttctcagcaatactgccgctgatttcggcgatcatcactgttgagtctctgttcgtgacacagagtctatcaccaaagcccggcggctccaaagcagcaccggaagagaccttgcatagtcaaaaagacaagcagtgatc

SEQ ID NO: 63770 - DNA, 425 bp, Triticum aestivum
  Clone ID: PAT_TA_63770
atgcactatatatagaggtctgtactattaaatggttctgggtgaaactggcttacgagccggctcggtctgagccgagccatagccaaagcgagccgagccggttgaagtaggctcggctcgtgtccagccctactctgggggcgctgtgccgcggcggaggctggtcctacgcggacatctggcgctccgaccgtcgcgacccacggtgagtcatcacagagcaacacgcatcgcctcatgcgcctgcttcttctcctagatctgcatcgcctgggagggtctcttgctaggtgtctagctcctgccggtagctcaggaaaactctggctctgagtttcttcagaaattgtccgcgcaactttacaccgcggcgttcattttctcgggatttcccatggagtgccgagatcccagcatcaaac

SEQ ID NO: 63771 - DNA, 448 bp, Triticum aestivum
  Clone ID: PAT_TA_63771
tcttttaatgtgaggtccgtggaagaggcacgcagtataaggttgatggaaaaacagagaattaaagaattgtcattgcagtggagcggaggtgtgagttctgtggaacacatggagttgctaacagagctagtgccaccaagctctgtaaagaatttcaagataacacgttacaaggatgtcatgtttccgcactggtttatgcatataaacaaatatcttcctaatcttgtgagtttggagatgtggggtgtgctttgccacagcctaccaacaacactcgtcccactacccaacctacgaaagattgttctcagcaacatgcataacctggaagagttcaacacagcatgctctataggcgaggatggtgcaaatgagctcacgttggctaaacttgagtatctggcgtatatcacgtgctgacaatgtgctatcgtcatgggga

SEQ ID NO: 63772 - DNA, 156 bp, Triticum aestivum
  Clone ID: PAT_TA_63772
tcgttctcgcgtccgagcagctgcattggcctatggtcttgacaggaaggcttccagtgcaggtgagaagattgtgctaatatgtgaccttgggggtggcactcttgatgtctatctgcttaccatagaggtgggtctgttggaggtgaaggccac

SEQ ID NO: 63773 - DNA, 376 bp, Triticum aestivum
  Clone ID: PAT_TA_63773
gcggggatgatgatggacctgggcgccgcgcgcgcgacgccgccgtcggcgcatgaggcggccgaggccgccgtgcgcgcggtcggctgcggctacgacctcgccgacgacctccgcctcttccgcgccaaggaccgcctgctcgacctcggcggcggcggcgagcgggacctgtgcctgccgggcggggccgtggtgaccagcgtgcccgcgggggtcgtcgccgacaagggcgagcgcgcgcggttccgctccgacgtgctctccttcacgcagatggcggagcacgtgaaccagtcgctgtcgctgacgggcaagatcccctcggggcccttcaacgccatgttcgactaccgcggctgctggcaccgggacg

SEQ ID NO: 63774 - DNA, 466 bp, Triticum aestivum
  Clone ID: PAT_TA_63774
tcgttcagctcagcctaccttcagttctgacggcgtcgcccatggatcctcaggcacagctataattgagagtttatccagatcgatgaacctcgagcaagcggccgtgacccacatcacctgacctcgagcaagcgaccgtgacccacatcacctgaccttgacccacatcgaacaagagtgcaaatcgaccatgacgtccagcctcggccacaagtatttcttcacccaccgctgattgtgatgattgggttgccatcatgattcatagaggataagcaccagcaacgaggaactgggaaggagaggttgatacttgagataggttctacgatagcaatggtggtggcagcgtcttgcaattcacataaatggggtggagaatagcaaggattaatcttcaaatccaactagccaacacttcacaatgtatggctacgatggtggcagaatggaggagctcatt

SEQ ID NO: 63775 - DNA, 448 bp, Triticum aestivum
  Clone ID: PAT_TA_63775
tttttacacaacacaacacagagacacacaagagcagctagcagcaagagacgagcgcagcagataaggtagcgacctcccacctgtaaacaggttcgtgccttctgtaaagaaaatctttggttcaccagctctcctggctgcacgtacctagctcaagctcgagggcaccggccatgtcgcccgtgcacgtcccggagctcagcagcggcgggtcggggtcggggtcggggtcgctcaccctgaaccccgtgcagcgcgcgctcacccggctgtcgtcgtcgtcggccctcacgcccaggtcgcccccgccgtcctacgggagcatcgtcaccgtgctcagcatcgacggcggcggcgtccgcggcatcatccccggaaccatcctcgccttcctcgaagagaagctccaggagctcgatgggccggacgtgaggatcgcggatta

SEQ ID NO: 63776 - DNA, 418 bp, Triticum aestivum
  Clone ID: PAT_TA_63776
ttctgtctgccgctgttattactccgtccaatgcagcctcattcctgtcaagtttcactcagctgcgccgccgtcgtttaccttcagtgccgctacacccagctactcgtcctgcggctgttgtagctccatgtggaggcgtgccggaggagcggcccagctgctactacaggaggcgacacgctgagcttccacttgctgaggctacacccagatcgacaacacatcttctctgccattggtcacatccatctatctgagagaaaaattatctgacaacaatggcgatggtgctggatgcatttgtgtcctacctggtggacatgctcacgcaggcagcaagagatgaggtgaagactatgttgggcgtctccggcgagatcgacaagatgggagacaagcttcgagacctcaagaa

SEQ ID NO: 63777 - DNA, 384 bp, Triticum aestivum
  Clone ID: PAT_TA_63777
catcttattcgagagagagccgcagacatcaggaagatcatcaacctgagaaacgacgcgggcctcaccgccctgcacatggctgtggttggctgcgtgcacccggacctcgtcgagctcctgatgaccacgccgtccatcgaccttaacgtcgaagatgctgacggcatgaccccgctggcgctgctcaaggagcagctgcgatcaaccacgtcggagaggctcatcaagcagatagtctccgccggaggggtgctgagctcgagcgtgctgagaagccggtcggccgtcgtttcgcagataaagatgcggggagggattgcgatcagtccgggcaccatgttcaggatatcggatgcggagatattgttgcactcgggcatt

SEQ ID NO: 63778 - DNA, 210 bp, Triticum aestivum
  Clone ID: PAT_TA_63778
gtgatgttgatctgcactactcgatgcaagaaccaccaccacacgtgagtgaacgtgcgagcaaggaaaggcagggagagatggcaatgaggccgctcgtcgcgctgtctatacccgcggccctgaccggcgtggcgctgcgaggaggccgcacctgacggggccgttgagtgcgggaggtcctcctccgaccggatggccctgcgcatg

SEQ ID NO: 63779 - DNA, 227 bp, Triticum aestivum
  Clone ID: PAT_TA_63779
tcgctgacgcgtgggacctgctgcttcctacacacacattgcaaagcacaagtaagaagcctgcaaagagagggaatgggccaagaaggggcagctgcttcgttgctggatgggaagcttaaggcgaggagaaacgattatggccaccgaaaggccgcagcagcaacaaggaaaaagaagtggtggccgtgccttttggatgccgaggaagccgcggggcaagtggc

SEQ ID NO: 63780 - DNA, 298 bp, Triticum aestivum
  Clone ID: PAT_TA_63780
gtcacggcatcctgcagaagctgacgccatgggcggacgggccgagcatggtgacgcagtgcccgatccagcccaacggctgctacacgtaccggttcaacgtgacggtgcacgagggcacactgtggtggcacgcgcactcctccttcctgcgcgccaccgtgtacggggccctgatcatccgcccccgaaacggcaccgcctaccccttgccggcgccggaccaagaggtccccgtcgtacttggcgagtggtggagccagaatgtcgtcgacgtcgagaaggacgccgtcatggc

SEQ ID NO: 63781 - DNA, 259 bp, Triticum aestivum
  Clone ID: PAT_TA_63781
tccacgcgttcgattgtccccttgctccgaccgtccatccggccgtccaattcctgctgctgccttgcatcggctggactctgctgcctgctaaatctatctcatctgctgccaacggcctcctggccttatccccagcgcgcaccgaaccggacgcatctcccgcgcgccacacattcctagactgcgcctgctcccacaaccctgtcttctgccctgcccaccccgccccgatttggattcttacgccggccacctc

SEQ ID NO: 63782 - DNA, 259 bp, Triticum aestivum
  Clone ID: PAT_TA_63782
cttactcggttgtcctatgtccatctggaccagctagtcttgtgcccttatcttggcgtgctatctccggcgactccattcttcatcgcggctgaacaagaagtggttgtcgatttctgtcacgacttaagatcgagccagcttgcgttttgttgcggaaatcttgggtgcgatgttggccgggggatcacgatctttggtgcgccgctctcctgtcccgcagatcgaccgagccaactacagttcttatttatctcgc

SEQ ID NO: 63783 - DNA, 346 bp, Triticum aestivum
  Clone ID: PAT_TA_63783
gcgtcctctcgtcctgcaaatctacaatggcaatcggcaagaataagcgtttgacgaagggaaagaaaggtggaaagaagaaggcttctgacccatttttgagaaaggaaatgaccactattagatctccctctatgttttctgttagaaatgctggtaaaactattgtgaccaatactactggaacaaagattgcttctgagtctttgaagggtcgtgtcttcgagcactctttggctgatttgaacggcggagatgagtctcagggttatggcaagatccggttacttagtgaggatgtttagggaactaatttaattaccaacttccatggtatggacattac

SEQ ID NO: 63784 - DNA, 145 bp, Triticum aestivum
  Clone ID: PAT_TA_63784
gctcggtcacggcatcctgcagaagctgacgccatgggcggtcgggccgtgcatggtgactcagtgcccgatccagcccaacggctcctacacgtaccggttcaacgtgacggggcacgagggcacactgtggtggcacgcgcac

SEQ ID NO: 63785 - DNA, 155 bp, Triticum aestivum
  Clone ID: PAT_TA_63785
cctggtacttggggttgggcttgagtactggcgcgttttctacttcctctcccaccaccccgagagcctccacaccttcttcttcctcttcgacgacgtcggcatccccaccgactaccgacatatggacggcttcggcgtcaacacctacacct

SEQ ID NO: 63786 - DNA, 107 bp, Triticum aestivum
  Clone ID: PAT_TA_63786
ttcttacgcgtccgggcgcgtggtcctggtacagggtgttcaccgccctggaggccgtctgccaccgtgtaaccgcgccggacatggacgggtgcggcgaggaggtg

SEQ ID NO: 63787 - DNA, 223 bp, Triticum aestivum
  Clone ID: PAT_TA_63787
cctcgccacgcgtacgccgacgcgtccgcgcgggacctgttacggaagaccgggcgtgtcagccgggtccaggcgaggactaggaagccgcgctggcaggccagccgccaggaactgcagctgcgtctgcgatcacccaacaggagactccagcatgtccggatggggctccagaagatgatctgcctctgcccactccacctccactgacccagcatgagga

SEQ ID NO: 63788 - DNA, 224 bp, Triticum aestivum
  Clone ID: PAT_TA_63788
acgcccacgcgaccgaccacgcgagcgacacgcgacaacccacgcgaccgggacgccagcagagaggggcccagacggcaaaaccaacgaagccgaagcggcccagggcacagaaacccgccacgaccgggaacaccagaaaggaggcgaaaccagcacaaacagcaggagccacaagacggggagaggacaagaggacgcgcacacagggcaaagcgagacga

SEQ ID NO: 63789 - DNA, 397 bp, Triticum aestivum
  Clone ID: PAT_TA_63789
ccctcggcttccagatgcctagccacatgaccctgcgttcttgcaccgacgaaacaccagagacggagacatggggctgaaggggttcgtcgagggcggcgccgcctccgtcgtcgccggctgctcgacgcacccgctcgacctcatcaaggtccgcatgcagctacagggcgaggcggcccgggcccctgccccagccatgcgcttcgcgctcgtgttcccccccggcgtgcagcatcaccaccacaacgaccacctgctgcagccgccgcgcaggcccgggcccatcgccatcggcgcgcagatcttgcgggcggagggccccgcagggctgctctccggggtgtcggccaccgtgctgcggcaggcggtctactcctcgacgtccatggggctc

SEQ ID NO: 63790 - DNA, 396 bp, Triticum aestivum
  Clone ID: PAT_TA_63790
tgcagaaaccacacaaggggacgcaacggacttcaagcggggagaaggcggctactggccagactacaagggtaagcttgaggatggacaggaaatagccgttaagacactttcgcaggcatcgacacagggtcccgatgagttcaagaatgaggttatgctgatagcgaaactccagcatcggaatcttgttcgactgatcggctgctgcatctgtggacaagaaaaaatactcatatatgaatacatggcaaacaagagcctggacttcttcctgttcgacaaatccaagattatgcttctggactggcaaacccggtaccgcataatcgaggggatcgcccgaggattactgtatcttcaccaggactcgagatacagaatcgttcacagaga

SEQ ID NO: 63791 - DNA, 210 bp, Triticum aestivum
  Clone ID: PAT_TA_63791
tcttccacgcgagcgaaccaggcaaccaaggcgcacccggccaccacggcaacggccagggagccggacgagccgcacgccgcggagaagggcgaggaggcgccgcagcagcggcggcgcgccgacccgcgcgaggaccacagcccgaccgcggaccacgccgccgacgcccgggcggacccgaagcactaccacccggcgcacgccggg

SEQ ID NO: 63792 - DNA, 197 bp, Triticum aestivum
  Clone ID: PAT_TA_63792
ttgttcgcagacgcgcgcacacgcagacgagccagattcctacagcgcagcgcccctcctcccacgcgccgagcgcccgccgcccgccgaccgccggagaggacgccagggcgccggagccggaggacgacagcacggcggagaagaacccgcgcccacacgacgaagacgacagcggccaccagaagaccaacggg

SEQ ID NO: 63793 - DNA, 378 bp, Triticum aestivum
  Clone ID: PAT_TA_63793
acggcagcagccgccgccagcagctgcgcaaaggctctacaaaccctaaccctagtccatagctagcttagcttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaggtttgctgatgcccctgtccagagtgatattaagatg

SEQ ID NO: 63794 - DNA, 295 bp, Triticum aestivum
  Clone ID: PAT_TA_63794
tttgttcctcccaagctgatgttgccgttttggtcattgcctctggtactggtgagttcgaagctggtattgcaaagaacggtcagacccgtgagcacgcctttttggctttcactttgggtgtcaagcaaatgatcgttgccgtcaacaagatggacgacaagtctgtcaactggtccgaggatcgtttcaacgaaatcaagaatgaaacttctggcttcttgaagaagatcggttacaaccccgagaagatccccttcatccccatctctgggttcaacggagacaacatgtt

SEQ ID NO: 63795 - DNA, 174 bp, Triticum aestivum
  Clone ID: PAT_TA_63795
gtaaatacgtggttggtggagacaattcagagccctctgattgtgtatctgactttaagaatccagcgacgccagaaaagaagaagttaagaggtacaaaaggacatgtgtcttgcagtcctcctcagagtctgaattgcatgcctcagacaaggaattgggtgataacaggat

SEQ ID NO: 63796 - DNA, 290 bp, Triticum aestivum
  Clone ID: PAT_TA_63796
tttgttcagcaaccaacaagctagctagcgcgaccgagcaagctaaactgagatcaagatcgaattgattgatcttgttggttctacttctcggtagcaaatcaagatggcgtctgcttctcccgcgccagcgacgctgctggccgtgtgcgccttgctcgccgccatggcgctcttccagggcgcgcgggcgcagcagctgagcccggcctactacgacgagtcgtgcccgcacgtctacgacacggtgcggcgcgtcatccaggaggcccgcaccgccgacccgcgca

SEQ ID NO: 63797 - DNA, 193 bp, Triticum aestivum
  Clone ID: PAT_TA_63797
ttgcacactacgcgtaaaagactctgggtgcggcttgagttcacctttgctggattgcagctcatgtggagctacagtgagaatctgggactacaaatgcgttccactctcttctgatcttaatctcgggaacattgatgcacctgatgcagggacgaaacctatgttggcacgtctaattagcgctaccagt

SEQ ID NO: 63798 - DNA, 149 bp, Triticum aestivum
  Clone ID: PAT_TA_63798
tcgttccaccctcggcggcctccaccccaggatcgtctccaacaacgccgactgcaccatggacatccataagatcgttggctccatgaggagcccggatgggcatgtgtgttatcccaccacccggctcatatgcttggagaacacac

SEQ ID NO: 63799 - DNA, 418 bp, Triticum aestivum
  Clone ID: PAT_TA_63799
tcgttgcctccaccttcttcttccaccgaggcgccatggccaacctccccggcggcgctcccaacgccaagcaccacctcccaccgcgacgtcccctccgcgcaccacggcgtcccctcctgtggtgctccccccgtccatcctgcgcgccgacgaagccatccacggcctccccgcgatgagccaatgccaaatccggtcagccgcgggctcccacgacgggccgttgatggatccaaccatccacggccttcggcgatgcgctctctccggatctgccccgcgctcctcccccggtcccctcccacctcacgccccaacccctccaccttatacaccgattcgccgccggtggcccgagccgccgtagcctccacaccgcacttgtcttggagctcgcagtgactctccgcacgag

SEQ ID NO: 63800 - DNA, 303 bp, Triticum aestivum
  Clone ID: PAT_TA_63800
ccttctcctccgcctactcttttttcccccagctggaaccaaaatccgcgttaaattcgcagaattcattagcgggcgtcgcctctgagtgtggcctcaaagcttagctcaagatggtgcttgctccgatcattcatgaactcttcctgcgtgcgtgcgtgcgtggctgtgtggctcagagcttagctttgctgctttgaccatggcggtcgtggctgtggcgccgcggctggtgcttctgctgctgctgagccgcgccgggcttccggcggccgtggggctcggggtgaactggggcacgat

SEQ ID NO: 63801 - DNA, 272 bp, Triticum aestivum
  Clone ID: PAT_TA_63801
tcgttacgcgtccgcatcccggccccaccaccggcagtacctactctcttggtgtgaacaacgaagcggaagcagtctaactagctcttgggcttaactgattatctgaatcttcatttggtactcttgatcgatgataatagattatagctgattgcaccggtgattagcacagtatactcatgtttgtgtggaaatggaaccacgagtagtagcactagtatagatacgtacaataaaatgtggtagcggtggcttaagtttggtcaatg

SEQ ID NO: 63802 - DNA, 473 bp, Triticum aestivum
  Clone ID: PAT_TA_63802
tcgttgacgcgtggggataaactgatatggagatggattgcagaagattttattcatgataagcaaagggggaacttatataaacaaggagaaaactacttcaatgagttgattaatcggaatatgcttcagcctgttgatattgacactcatggtagtgcaaaaacatgtcgtgtacatgatatggtacttgatttcatcacctcgttatcagccgaggaaaattttgttactatactaggaggtcagcagccattgtctacagggaacaagatccgccgattatcagtccaaaagaacaatggagagcacaatatgcttgataaatccatggacttatcccatgtaaggctactttttgtcttgaggtctgctattgacatgattccatcacttttgagcttccaggttctacgtgtgctggatctcgaagaatgccaacatttggatagttgttatttgaaggacatcac

SEQ ID NO: 63803 - DNA, 365 bp, Triticum aestivum
  Clone ID: PAT_TA_63803
tcgtttcctcctgctgctgctacacccccgaagaacaaaattagcaggtacaacagcggctgctcctcctgctgcttgctccactcaacacgaggagatctagaggagtcgatgactggcagtgccgtctttaaccggaagcactgtgccacattggataaaaagaagacaccaacagcaggatatatcaaaagtgttttcgatgatccgtgttcttctattgcttctcttgccatatgtaccccaatgggcatcagtgagagcattcaacaataagactgatgtggattccttgctagtgttcaaggcaagcattgccaaccaccatggtgtcctagctgcatggaacacaagtactgacttct

SEQ ID NO: 63804 - DNA, 234 bp, Triticum aestivum
  Clone ID: PAT_TA_63804
tttgttgtcacaggtcacgtgcctgcgctgcgggggtgtcgtgctcgggctggcactgcaccactccgtcgtggacgcccgtggcgcggcgctcttggtggagacctgcgcgagcgtcgcccgcggctccactaaagaggacgtgcccctgccggctagcttggaccacaggctgctcgcggagcgccaagagcgctcggtgccgtacgaccacccggagtacaagccggagcc

SEQ ID NO: 63805 - DNA, 463 bp, Triticum aestivum
  Clone ID: PAT_TA_63805
tcgttgacgcgtgggttcgtcttcgaatgtgcaccgggtacgaatgccacttccattgaatgggatggtatttaccactacttggtacaacatggtcgtgatcgcatcattgcgggtgactattccaagttcgacaagcgcatgagtgccatattgattctggctgcgttcaaggtgatcgtcaatattttggcggctgcaggttggaacgatgaggatcttcacattgtgtggactatggcgtttgacatcgcattcccagttgctgatcacaatggtgatctcgtgcaatttctgggatcgaacccctcgggacatcctttgacggtgatcatcaacagcatagtgaacagcttgtatgtgcgctatgcttggtgtacgtcaaatcacaaccttgaggatttcgtgaagtatgtggctctgatgacatatggtgatgacaacatcatgggtgtgagtcgtg

SEQ ID NO: 63806 - DNA, 360 bp, Triticum aestivum
  Clone ID: PAT_TA_63806
tgacgcttcgcctccggcccttcccatcatagggcacctgcacctcgtcggcgatctccctcacgtctccctccgcagcctctccaggactcatgccgctgacggcctcatgctcctccacctcggctccgtccccaacctcgtcgtgtcgtccccacgagccgcccaggcggtcatgcggacgaacgaccacctgttcgcgtcccgcccgccgtccaggatcgccgacgccctcctgtacggctggtcgtccgacatcgccttctccccctacggcgagcactggcgacaggcgaggaggctcgtcaccacgcacctcttcacagtcaaaaaggtccaagtcgttccgcatcgcccgtc

SEQ ID NO: 63807 - DNA, 362 bp, Triticum aestivum
  Clone ID: PAT_TA_63807
ttccggcctccctcctcctcttgtcctccgcatgtaaccagctcggtcgatcgatcggctcggacgagaagcaacccgcttcaatccccgacccctgatcgtagtggagtgtggtatataggcggagctagcagaggacatggtgaagttctcgcgggagtacgaggccagcatcatccccgagtggaagggcgccttcgtcgactacaagtgcctcaagaagctcatcaagaagatcaaggtcgcacggcgcgacgccgagtccgaaggggactcctcgccggagagcgccgccctcgccgccggcgtcgagagcgcccgctatggcgccggcttctccgtgctcgaccccgtccgcgccc

SEQ ID NO: 63808 - DNA, 444 bp, Triticum aestivum
  Clone ID: PAT_TA_63808
tggctcttccccccagccagctctagtcccagacgccctctcctgctgcctgcctgctcctcctctgtcccggaatgcgcgatgccgggcactcgcggtaccgccggcgggccggcctgccgatgctctcccttctgctcgcgctcgcgctgttcgccgggggtgccagcgggcagccgccggtgccgccggagatgaggggcgtgcaggcgcagctcacggggctcaccaacgacgtcgcccacaccatctccgaccgcttcagcttctgcgtctccgacacgcaggaggactggaacggggccttcaactactcctccgacctcggcttcgtgcagcgctgcctcgccgacaccagaggtgacatgccgcagcgcttatgcacgccggcagaagcgaagttctacttcacaagcctgtacaacccgaaaggcgagaaaaacc

SEQ ID NO: 63809 - DNA, 433 bp, Triticum aestivum
  Clone ID: PAT_TA_63809
tttcgcttcgtgcctggtgccgtctcttctcccccctcgagccccttccagagccttcattcccggcctctctcccatcttcctccggcagctccggccgccggcagggagggggagaggggtggggccaaatactgtgtattttaggtcgcttgctttcttgtttattttgtaggttcctcgtatcgcaggagatggcaagctgcatccggtgcttgctggcagcaatagtccttgctacggtgctccaagggctggagctgaagttgagggctggatttgctgctgctgtttccaataagaagcttgccaagtccctgatctggagggcagccttctgttggctctctgctcgtcaaatcaccatggtggtggatggtgacagaggaggaagcagacgactgaagctatcagatcgggtccgagctcatag

SEQ ID NO: 63810 - DNA, 399 bp, Triticum aestivum
  Clone ID: PAT_TA_63810
cggacgcgtgggcggacgcgtgggcgtctacctccagatctccggagacccctccccactcccatccccgcgccgctgacccccgctcccattccccccacccggcggcgagtaagcagaggcggggctgctcgcagcgaaccctagccgccgcccgcccgcctccagccggcgccggcgcgacggtcggcgggagatctcgacgagggagatccagcagggccatggccagctccggcatcgcctaccccgaccgcttctacgccgccgcggcctacgccggcttcggcgccggcgccccttccaccgccgccatctcccgcttccagaaccgacgtcgccctcctcctctacggcctccaccagcaggcgacggtcgggccctgcaacgtgcccaag

SEQ ID NO: 63811 - DNA, 392 bp, Triticum aestivum
  Clone ID: PAT_TA_63811
cttgcttgcagagcccgaatggcgggacgggggcagggatggtgcggattctgccggtcttcccgcagtatcttagtgattcggtcgatgggttcgatggtgtccaggatggccttgaggatgatatgatcattccaatcgaggaggagtcgtcaacgatgaacagtcaccaagcatctcaattacctgcgttctcgggcgcgtattcctcggctcaggtgagggaggtgattgaggagagcgaattggaccaggacagctcagatagagatggtgccagcacgatttacgaggagaatgagagtgtgtccgttggggaggtgatgaagagcccagtattcagcgaggatgaaatgtcagaaggctctttctgggttgatctgggcaatagt

SEQ ID NO: 63812 - DNA, 455 bp, Triticum aestivum
  Clone ID: PAT_TA_63812
gctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaggccccgcttggatcgtcggtttgctcctaaatacacttgtaaccaaaacagacctcgagccgtcgttttcaatctaggcggaaataacactgcgaccggtaaaatacacttgtagattaaa

SEQ ID NO: 63813 - DNA, 272 bp, Triticum aestivum
  Clone ID: PAT_TA_63813
cccaggtcccaaccaccaccggaccgtcgctccgtcgtccagatctcgcccgcgcgcgcgatggccgtcggcgaccccatgccggtcgcggagcccgcggacggcgacgagatcgtctacgagtacatgccctgcatccgtatctacaaggaccgagtggagcgctacttcggctccgagttcgtatacgcctgcggcgacaccgactccggcaccggggttgcctaccgtgaccgagtgatctcccccgaggtctatgcgcgcctatacct

SEQ ID NO: 63814 - DNA, 471 bp, Triticum aestivum
  Clone ID: PAT_TA_63814
acggtcaataccttccgctcgttggagccgcgtgccatggacaccatcctggccggactctgtgcacgcatccggccttcggacgcccgcggtctactgtgtggggccactgatcaagtcggaggatgtgggcgtgaagcgcggtgacgagtgccttgcgtggttggacacgcagtctaagggcagcgtggacttcctctccttcggcagccttggccggttcagtgccaaacaaacaaggaaggtggccgccgggttggaagccagtggacagaggttcctgtgggtggtgcggagcccgccaagcgccgactcgtcgaagaactgcgagaagccgccagagccggacttggatgcccttctccacagggattccttgagcggacccagggcaggggcctcgtagtgatagtcatgggcgccacaacgcgacgtgttggcccatgatgcggtgggctgttttgtgacaca

SEQ ID NO: 63815 - DNA, 437 bp, Triticum aestivum
  Clone ID: PAT_TA_63815
gtgatgaagaagattccgatgatgaagaagaggaggaaattggtgagatgccttcacctgaaagacgcattcaaggggttgaaccaggggaagaggctgagctagcaagggtgaccgaagaagcgagggaggcttgcaagtcaaaacgatcagctggaccacttccagatgaggcagatcacccatctcagtttattcgtgacatagctcgcgatgtgcgctcaaagaggaagatggtcaaggtttcaagtcttgtgaggaggaatagggtgaagaaaggtaagttggttgttctggatgaagagggggaagcttcggaaagtgaagatgatcaggaagaagacaaagaaagtggtgatgaagaagattttgatgatgaagaggaggaggaaataggtggggtgccttcacatgaaagacgcactcaagcggttgaa

SEQ ID NO: 63816 - DNA, 255 bp, Triticum aestivum
  Clone ID: PAT_TA_63816
ttacgttttcggtttagtaatataatgcttattgcattacttgtggcccaatatgcattgctagggtcaggactactgcaaaaatatgtgttttcaattatgttgcaatgctcacttgttgtgtgtatggccgcattcataagaggcgtgatcaagcattataagctcacaacatatgtattcatatttcaccgcatgattggaaatatatggaataagcagtttttatccaactaaaaaaaaagtacaatagat

SEQ ID NO: 63817 - DNA, 410 bp, Triticum aestivum
  Clone ID: PAT_TA_63817
tcacgcgttcggccacgcgttcggcgaggtcttcttcctcccttcctccccctagcaaaaggctgggcctcaactcctcatagcccagccatggagtttcttccttgtgaagatggagtccatcttcatcatgccacaaggcaaacttggtccttgctccacatgagaacaagagcctttggtcggtcctccacctcagaacagaagaaaggtgctaattgtttcttccgcacaatatagaagccagtcgtgcgactggcttctatcttggtcgagagaagtaaaattaggttggtccaggccttcaatcaatcctcaagtatataatggtcagtatttgatgtcgatttggttttatattgcatcaaaaggtaaaggcttctcctggatttcggtctgggtggttttgg

SEQ ID NO: 63818 - DNA, 335 bp, Triticum aestivum
  Clone ID: PAT_TA_63818
actccgcactcgtggtggagtggagagcgtggctggcggcgggcctgcctcttcctcttcctcttcctagcggcactagtaggagtagccggtaaacccgcacctaaaccgcagtctcccatcgccacaccccgcggctcggcacgggcacggcacagatctccccactccaccccgccgggtagcgcgcggcggccgaagcacgcgagcgagcgagccctttccggccgcctacgcctcgggggcggacgcgcgcggatcgcgtcatggcggaggcgggcaagcgggtcgacctggccgcgccgctgcgctcggcgcgcctgccctaccacaag

SEQ ID NO: 63819 - DNA, 442 bp, Triticum aestivum
  Clone ID: PAT_TA_63819
ttcactcgtccgtgtggttcttggcattgctggcttgcatagcagtaacaacgctgatcaccattcatatggtgcacatcctgcacaaacacagccgaaagagagtttcttctgctcatccgcccggccctgccggccaccccatcctcggcaacttgctctatgtcatcggcccgctccgcaacaacccacacaccacactcgcctacctcgctcaaacctatggacccatcttgtccctccgccttggtctgacccgcaccatcgtcgtggtgtcatccgccgctgcggctcacgaggcccttgccaagaatgacacagcgctcgcgtcccggcttgtgccagacaccgtccgcgccatgtcgtatggcacgacgtccatggtcttgccttcaagctccaacccactgtggaagcaggaccgtgccatcatgggcgccca

SEQ ID NO: 63820 - DNA, 242 bp, Triticum aestivum
  Clone ID: PAT_TA_63820
ccggaatgtccgtatcactggacagcggacagcacaaaggaaatttcgatccaactttattgatgcgtcaaataacctacaagatcgcactatccctatatacatcatcgcactcgcgtacgtctctactcctctttgtccacagggacaatgtacaatcaactagcactgctactctttttccaccccctcccattctggttttgacctcttcaagcagcatgtgcaacccaggggagtcg

SEQ ID NO: 63821 - DNA, 353 bp, Triticum aestivum
  Clone ID: PAT_TA_63821
tgggtgaccgcgccacgcatgctcctcccccgcctgctccccgcgcaccgcctcctcgccggcggcccccgccccctactgctacttccaagccgtcgcctcgctccccggccgcacgccgacgaatccatgtcctccgactgctacgcgcccgcccggcgcaggggcccgctgcggggggtggtgttcgacatggacggaaccctgacggagcacgacatagactatcacgtcaaggaccaagaggtgcaccgtgcagaggcactggaagcacagtgacattaagctcaaggacgacaagacgctgctctatggcgagaagccagttaccgacttcggtgtcaggaaccctg

SEQ ID NO: 63822 - DNA, 359 bp, Triticum aestivum
  Clone ID: PAT_TA_63822
agctcatccgtctcatggatagctgccttggttacacttatgtcatgtcaaccccgaacacgtgcacgtctgatatgaaaatagttgattcgaccgatacagagttaaaaggctacagaaaaagcccgtcctggagacggtccgcctgcacgaagaacatggcgtctggcctctccgaggcccacaaactgatcagctaccgtggacactggaatagcatcatcttgctcttctccgatgggctcatcaacaagggggactactttgatggagccaaggacttcgtctcaaaagtacctgtccacacgtttactctcggcggagacgcgaacaaccacgttcttcatgccatggcaaag

SEQ ID NO: 63823 - DNA, 381 bp, Triticum aestivum
  Clone ID: PAT_TA_63823
cccacgcgtccgctccagttgaagatgaaggtgcagaaatggagggggaccaaggacaatcagctccgggcttgtctgaagcgaaagatggacctgaagaaatggaggagcaacaagaagagtcagctcaggacatgtctgaagctgaagaaatgaaggagcgccaggaacattcaggtcaggacatgtctgaagctgaagatgagcctgcagaagtggaggagcaccaggaacattcagctgtggagatgagtgaagctgaagacgaacctgcaggagtggaggagcagcaagaagagtcaggtctaggcatgtctgaagatgcaggcgatcctgcagaaatgaaggggcaccaaggacagtcagctgaggacatgcctg

SEQ ID NO: 63824 - DNA, 356 bp, Triticum aestivum
  Clone ID: PAT_TA_63824
tttctcgcgtccggtgctcttcgtcctcgccgccggctaccttcccttcaacgacgccagcctcatcaacatgtaccgcaagatctacgccggccggttccggtgcccgaactggttctcgccggcgctccgccacctgctacgccgcatcctcgaccccaacccgggcacgcgcatcgacacggacggcatcatggagcacccctggttccgccacggcgcgagcggcgacggcgagctggagaagctgatgcgcgggcacgaggaggaggcgtggttcgagacggagttcaaggaggacatggtgcgggacatgaccgcgttcgacatgctggccttctcgcccggctcggacc

SEQ ID NO: 63825 - DNA, 402 bp, Triticum aestivum
  unsure (1)..(402): unsure at all n locations
  Clone ID: PAT_TA_63825
tgccacgcgtccgcgacgagcggctgctggtgtacgagtacatgaagaacggcgcgctctacgaccacctccaccccaagggcggcggcgccgacgccgacgcggcgtcgccggtggtgtcgtcgtggaagctgcgcatcaagatcctgctggacgcgtcgcggggcatcgagtacctgcactcgtacgccgtgccgcccatcatccaccgcgacatcaagtcgtccaacatcctgctggacggcgggtgggtggcgcgcgtgtcggacttcgggctgtcgctgatgggcccgccggagacggagggggngggcggcgcgcangcgcccgagcagcacctgtccatgaaggccgtcggcacggtggggtacatggacccggagtactacggcctgcaccacc

SEQ ID NO: 63826 - DNA, 209 bp, Triticum aestivum
  Clone ID: PAT_TA_63826
tgcctacgcgtccgatccagtacagtggctgagcactcgagtgcagagccgattagccttccggttccggaacctgcaatggctgctgctccggcgacgacggcggaggtggtgccgcggatgaagctgggctcgcaggggctggaggtggcagcgctggggcttggctgcatgggcatgttcgcctactacgggccggccaagcccga

SEQ ID NO: 63827 - DNA, 283 bp, Triticum aestivum
  Clone ID: PAT_TA_63827
tttggtagtccagcagcactccttagctgcacttcggtcacttgcaacgatctccacaccacatagagacagagcgagagagagagggtgtgtgttgaagcaaagatgaagcttatggggagccggaggagcggaggaggcctgagcaggagcctcaaggagcacatggccaggctctacatcatccaacgctgcgttgtcatgctgctgtgctggcacgactgactccgatgcctcgctccatggatggatcttgttcttccattccatggatggtgtttga

SEQ ID NO: 63828 - DNA, 384 bp, Triticum aestivum
  Clone ID: PAT_TA_63828
tttctgcggacgcgtggcgagatggcccgcgacattgctcagaagcttggcttcagcgagcagtgcattgaggatgccaaggacaccatccagaagctctacaccatcttccgcgagaaggactctacccagatcgagatcaaccctctctccgagacctccgaccaccaggttctgtgcatggatgccaagttcggtttcgatgacaacgctgagttccgccagaaggagatcttcgagtggcgtgacaccacccaggaggaccctgatgaggtccgcgctgctcagtccaacctgaacttcatcaagctcggtggtgacatcggctgccttgtcaacggtgccggtctcgccatggccaccatggacatcatcaagatcaac

SEQ ID NO: 63829 - DNA, 499 bp, Triticum aestivum
  Clone ID: PAT_TA_63829
tggtttcatttagcatggcaatgcccaataccaatagcatgttgagcttttcctgtatagcttatgcagctattgtcgtcctagccctaggcagtagaacctgtagttgcttgcagtttacttatcccaacttcaacgcaatcaatatggatgatttcaccttcagcccaggctcaacaattgcagatggtgccttgcagatcaccccaagtaccggaaacatgcgccaccggtcggggagagtggtttatgcaagggaaaccctcaagctgtggaacaacaagcgcatggcgcccacctcgttcaggacagatttcctgctcaacatccaacccggtcagaatggggctggagaaggtatggcatttgtgctcacaaacaatccatcgttgcccagcaacagcaatggccagtggcttggcatatgcaatgacacgacagacggcacgaatactgacccagttgtagccgtcgagtttgacacgagaaagagctatga

SEQ ID NO: 63830 - DNA, 348 bp, Triticum aestivum
  unsure (1)..(348): unsure at all n locations
  Clone ID: PAT_TA_63830
tgnctgctaattcctgccaccacccacgatttcccagcaccccgatctggcgcgcctccacccacctccgtcggccaccggcgtgccgcccaccccaagccaccggcgccacgcctccacccaccgccgccggccgcagcgccccgcagcccccactgccgcctgccgtcggcggggcctcccccaatccccacgcggcgcgtcctcccgagctactcgatgcgccgtcgtggtccgcctcaacctcccaccggcctcctcccgcgacgctgccgccggcctctcaatcgcgcgtgcccgccgcatccaccgaatcgagcgccgtcgcccgccccgaccacgcatgcc

SEQ ID NO: 63831 - DNA, 123 bp, Triticum aestivum
  Clone ID: PAT_TA_63831
tctccgggccctgctcgtcaagaccatggaggcccacgccgacgtcgtgctcctagacccgaaggactactagctgatcacctgtgctgactagagatcaacggttgaaccatcttttgctga

SEQ ID NO: 63832 - DNA, 212 bp, Triticum aestivum
  Clone ID: PAT_TA_63832
ttgttcgcccacgcgtacgagaggcgaatcgcgtgcgctactttgcttcctcctgacgtgcctcggcctccccgattcccgttcccaccgacgacaggagcgagcagaggaccgcgatgcagcatccgcagctgcaggcgccgccctcgagggcgtccgggcccgacctcgaccggcctgctcccaccaccttccacaaggcattcatggag

SEQ ID NO: 63833 - DNA, 338 bp, Triticum aestivum
  Clone ID: PAT_TA_63833
ttctcacgcgtccgattccctttccccatctacagttaggagaggcgaccgagccggcgatttcgtttcctccggcgagccctgctctctttcctcctcccggtggcctttgtgctgctggaggtgggaggggggccggctcgccgggaggatccttgtacaggtaggctgcctaggtgtcggggtggcctacttggcgtcgtcctcggtcccggctgggtggcgatggtggcggggacacctgcgcctgggttctgcatctgctgctgcatcgcttcgtcggcttcgtcggtgtggacggttgcaggtcacgtgctttcgtgtgcgttggatcgagt

SEQ ID NO: 63834 - DNA, 202 bp, Triticum aestivum
  Clone ID: PAT_TA_63834
cctgatctcggctggcgataaccttcctccatgggtcgtaagcgccgccgcgcggaccatagcacgccggcgccacctacggccctccggactaaatcggctgagcggaaacccgtggtcggcttcggccacggcgccggcgccccctcctcctctgattggatgacctgctggaaggagatggcgaaagaagcacctggat

SEQ ID NO: 63835 - DNA, 154 bp, Triticum aestivum
  Clone ID: PAT_TA_63835
gcctcggacgcgtgggagcgactccgactccgagggggttgtggatctggcgccgtggccgccctcaaggaagcccgtccctttcgacctcgacctgaactgcccgccggcgggggagctctgatcgggcgccggagtctatgtagctgatatg

SEQ ID NO: 63836 - DNA, 280 bp, Triticum aestivum
  Clone ID: PAT_TA_63836
tctcctactctctctcgggggagctgcatctccgtcaatcggcgcgtgtggtcggcggctcgccgccgccacggcagaggacgccttattcccccgccaccgcccctaccatcgtcaatacccggcaccacctacctgtatctacaagtgtctgacccccaccaccacacatccggaccgatatccgaaggcaaggggagagaacaggagctagagaggcgggggggcgatggcggcggtcggcgttctcgccctgcagggatcctacaacgagcacatg

SEQ ID NO: 63837 - DNA, 176 bp, Triticum aestivum
  Clone ID: PAT_TA_63837
tttcgcacacatccatgatcatctgatctcctctgactaacacgctaagcagctgaactcaagcagaggcaatggagggcaaggaggaggacgcgcgtccgggcgccaaccggaactcggagcgggagcccatcggaacagaagcacaaggtgcagacgacaaggactacaaggag

SEQ ID NO: 63838 - DNA, 521 bp, Triticum aestivum
  Clone ID: PAT_TA_63838
ctattttttggtgatgacgaagatgagctagaggaagaaccttctccccccactacaccaatgactgggtcatggcaatctcagcccgagcagcaagtgtccccaatcctagaacaaaccaccgtagaggctgaaacggtggaatcgcctccttccctggaggatgtttttggcgggttgaccgccgatgaactggggaaagaatccctttctcccgtggctgaggtggattttgtcgatgcttccctagaaacgttatctctggtgcaggcggtagaggaagcctttgattccttgccccccttagcaacgaccccagcgaccattccccaggctgaagtagaggcagtggcagctccggctcctcccgtggaacgcacccatgaacggcgggccatgcccagggagcaaaatccagctaatctttccatccgggtggattttcaacggttggagcggatgaataattgggtgggggaattggccattaatcgcaatagcctgtctttacaaaatcagca

SEQ ID NO: 63839 - DNA, 449 bp, Triticum aestivum
  Clone ID: PAT_TA_63839
gtttggcctatcccaccaccatccccgcttcaattttgacgaggctgtgttgccagtgggggtagagctatttgtccgttgcgtggaaaggttctgcaatgcctagaagctgaaggtggtacgaattacccccattaccagggtgccattggcgttgttgtagtccgcattgggtaccaccacaataccgggggtaatggaaagattgtcactcactgcccactggaaaaagccttctaggtgcaaggaactgtcaatgtcagtggtggcaatgtcatcggggaagacaatggaactactgctcacccagggttgcatacccacaataatccccgccatattcccttccttgataatgtcggggaaagccagggtcacagcccaattccaaatatctaaacttcctctaccaatgctggcatccgccagatctatagatttgagggtgc

SEQ ID NO: 63840 - DNA, 450 bp, Triticum aestivum
  Clone ID: PAT_TA_63840
acaaaccctatatataggcaaatttgctggcattttaatagtaatttcagttccctttctccccaatggtttggagcttctagtcaagctaaaaaagtaaaaactctaactctccaaagtttaattgaccaagaaaaaattgacaaaatcacctgtctaaaactagatattgaaggttgggaatgggctgtaattaaacagctagaaaatatagaatcctatttactgcctgcggtagtgatgtttgaatatggcggcggcgtcaaccgaggtcaaaaccaaaagggttgggccccagaattctttgaaaatacattaaacattcttaaatcattaaaaactcttggctacggctccggaattttattggattttgctccagattgccaagaaataacctttgatttaagccaattgcaaacatctgagttggataaacttttcccccct

SEQ ID NO: 63841 - DNA, 477 bp, Triticum aestivum
  Clone ID: PAT_TA_63841
tacgaaaagtggattgttaccatcaagtttatcgtttggttggcaatgatggcggtattgagcaactattacgacgggcggaagaagatataactaaagccttggttaatgaagctcgaacggaatgtgatcgttatgtgcgggaaagtccccgattttatgatgaaggtactttttccatttatcaattccggcaaactctccagcaaacttcccagggttatgatgcccaggcgatcgtggaagcggaaccagctattaaggagttgctaaaactagattttgaacctaaagttttcaatactgtacggaaaaatttccgacaaaccgtcaataataccctaaaaacccatctgctaccaatggcagaagaacaagcccaaataattttagaacagtatgatgtggcaaggaaatatcgtgagcaaacgttggaacaggatgccgaagaaaaaattgctcgcaattcccgtttac

SEQ ID NO: 63842 - DNA, 434 bp, Triticum aestivum
  Clone ID: PAT_TA_63842
tttaaaaaatatcttcgatattggtcgtctggctttttgccacagccagcaatctttgtaaaaaatgaaatggcagaccaatgttttccactaagtgtagagctatactacgccatggattttcaattttttctaagagtcttaaatcaagaacctaagtcagtttggattcaagaaaaactaactcgactcagatggcatgaggacagtaaaaccatgggaacaatatcacgaatagactttcatgcaatagtgccagaaccggaggtgcataaagtagctctagcagaagctgaaaatttaccaacttggctggaaaaaatattttttcgaatccaagcatttgattatctctctctccaaccttatataaattccttggacaattttcattggttacaaattactaaaaccattgttaaaagacctaccct

SEQ ID NO: 63843 - DNA, 441 bp, Triticum aestivum
  Clone ID: PAT_TA_63843
gggacgtgcatctagaccaaacccgttctatttaccattggctccaccaacgcttacggaaattattacccccaccccaatgccaatttttaaccgatagtgaacccctcgggcgatcgctccaggattatttgggccaaccattcaccgtgatgcccattccccacacggattttgctgaagttgtacctttatttacagaagctgatcccattctttgctggtggcccggtgcccctcgggaagaaaaaggttggtcggtgatgcgtcatttggtttcattgccccggcctaattcacctaggctccaactaattgcggcggcggcttccggattaaaaagtgacagggaaggaattgaagttcatttaattggcgatcgcctgactagggaagaatacgccggttggttaaataaagcccaaattattctcttaccct

SEQ ID NO: 63844 - DNA, 408 bp, Triticum aestivum
  Clone ID: PAT_TA_63844
cgatcgccaagggttgctaactgcaatcccaaaccgggcaagatcgctccccccaccagttttttatcttggtcaaaccctgtaatggtcaaagcagtgcctccatcaaccactagacagggaaagccgtaggtcagccccgtccctaaaccagccagggcccggtcaatgccaaagctggggtaaagattgaccaggggaagattcttcagggtcaaaattttaggctgatatactcgccaaacttcggtttgttccggtaccaccgatgccaacatcagaggaactttccccaacaaaaccggcaactgagctgacttggggttgtaatctgtaacccaggtttgcaggggagcattgccgctacaatatgcccagtgcagacgggagttgcctatcattaggcct

SEQ ID NO: 63845 - DNA, 263 bp, Triticum aestivum
  Clone ID: PAT_TA_63845
tgccgattgtttgcaccatgcccaagcggcgatcgtcatggtcggtaccgacacagaacagtttgtcgggttggggaaaccagagcttagttttcccggacaaggcccccaatacaatccgtattttgtgcgccggcaaacctggcttttgggagaatccttaatgttgttgaatagtcctgaccaaactggggaggctctacaacaggtacttcatgatgttgagcgactagaggcgatcgtctgtaatggccgacaaaggc

SEQ ID NO: 63846 - DNA, 338 bp, Triticum aestivum
  Clone ID: PAT_TA_63846
aattgagatgacgaagatggaggtttgactttaaactgaggctaaccgctaatagcgtatcggaaaatcttcaagatcccaaggaaagatttttatgtcagtgaacagcatccatttggtgggaagggccggccgtgaccctgaagttaaatattttgagtccggtaatgtagtttgtaacttcaccctggcggtgaatcgacgcacaagcaaaaaggatgaaccccccgattggtttgacctggaaatttggggtaaaactgctgaaatagccggtaactacgtcaaaaaaggcagtttgattggtatccaaggatcgttaaagtttgaccattggg

SEQ ID NO: 63847 - DNA, 374 bp, Triticum aestivum
  Clone ID: PAT_TA_63847
tttggggggattgtttacctccaccgctttaactctactggtattaccagctttatatgctcaatttggacggtttttacgtccatcggctagcgttactactccagcatcaacccccattaatgttctgacaaaagtttaaattttaatttatttatgaagttctcaatccccaccaatcctgttatccttctactcatagtttttctgctcaatgcctgtggtaatcaaacttcgccaacagatatttccgttagtccgaccccgactcctaccgtttctcctacagaaaatgttgaggagaataaaactgaatcccatggaggccagggaggacaggtaattgaaatgggggattaccatttagaattact

SEQ ID NO: 63848 - DNA, 162 bp, Triticum aestivum
  Clone ID: PAT_TA_63848
ggtccagagggaaaagccccagtcccttggccgatggcagttcgtagtccggactggcattctagttgctacttttatcctcgctttggggagcctcgcaagccctagcctagccctagactataaccggggtaacttagtgggggcagatttttcccatca

SEQ ID NO: 63849 - DNA, 123 bp, Triticum aestivum
  Clone ID: PAT_TA_63849
aattaccgcattcatggtgcagttaaatgcccgcatcaaagctgctataccgaacattctagtatccgtctgccctgccacctacaatctcgcttacaacacttttttgcaggattggttgga

SEQ ID NO: 63850 - DNA, 231 bp, Triticum aestivum
  Clone ID: PAT_TA_63850
aatttttggccccgacttagaacaactccgcaccctcgggaaatcggtggaaacagccatggcggatattcctgggctggtggatttacaactagaaccccaagtcccggtgcgtcaggtacaaattcagtttgatcgcctagcggccgggcgttatgggttaaccgttggtcaactttctgagctggtagaaacagcattgaatggtagagtcgcctcccaaattttgca

SEQ ID NO: 63851 - DNA, 540 bp, Triticum aestivum
  unsure (1)..(540): unsure at all n locations
  Clone ID: PAT_TA_63851
ttaagatttttaaacatattttttatcagggatataaagaactcataaatattgatgtaaaagttgatttacaactgcaatagtgaatcctatcaaagctcccaatgggccaaagaaaaatattgaggtcattgctaattccaagggcttgtcctgaacattagtggagaaattattgacaataaagattccagccataacaccaaaagcataacctaccaatgcagcaagtaatgcaatacctataaatttgagcatatttctagtttcatttaacccaaagaaaaaagaataaactttaatatcaagaaggcaagaataaagatgtggttcccggcactttatggtcgtcgtccctccctttttttactgcctccccatccccccgccggacaaaagctaactatcaaggcctagagccactgaccggcggccccccgagtgggggcgagaaagcaagaaggcangaggcgtttctaatattcgacgataaaacccgttggtatggtcggttagagcaataaatatttcactggacta

SEQ ID NO: 63852 - DNA, 369 bp, Triticum aestivum
  Clone ID: PAT_TA_63852
aggggagtgcccagaaaagcggagattaaaagaaaaacagtgaccccaaaacaaactcccaaagaccactgtttcccactggggttgcccaggagcagtagtagtaagacaatgggaatgagggcgctggcaaaaaaaggatttaacaaacctgtgccagggagactgttacccaactccggtaaagaactacccatggcgcggaagggccattggggcaagtcaaaaatgtatagaccctgtagaaagaataagcccgagctaccgaaaattaatccccagttgaacggccaggtaaattgcaacggtagatagatccgcaacagtaacaccaacaggtatgaccccaacaccatggctaatttgggt

SEQ ID NO: 63853 - DNA, 356 bp, Triticum aestivum
  Clone ID: PAT_TA_63853
atgcatattccagcctatggccccatgccggtgctcacctacaaggctcaactggaaaccctattggcggcagggcaatggtatcgggatagtcggggcagtaatcaatttgagggccagccccagatgctctcctgtggtttacccctgcccaatctgggggccatcaaggcacaattcctggccactggcggacaacccgcagattttgaggagcattaccaccgccgctcccaaagggaagtgttgcaaaactttggccgtcagcgggctaaccgctacccccgccagcagtttacccatttcattatcaccggcgacccccagcacaataccatccacgacctaggctgggt

SEQ ID NO: 63854 - DNA, 319 bp, Triticum aestivum
  Clone ID: PAT_TA_63854
ccggacattgtactggtgggagaattgcgggatttggaaaccattgcccttgccatcactgcggcagaaaccggacacttggtttttggcactctccacaccaactcagcagcgggcaccattgaccggatgttggatgtgtttccggctaaccaacaggcccaaattagagccatgttatccaactctttactagcggtatttgcccaaaacttagtcaagaaaaagtcccccaaacccggggagtttggccgggccctagtgcaggaaattatggtcattaccccggcgatcgccaacctaattcgggaaggcaaag

SEQ ID NO: 63855 - DNA, 380 bp, Triticum aestivum
  Clone ID: PAT_TA_63855
tgagtgcggccgtttatctcggtttcaaacccaaacccagggtatatccctagaagcccaagcccagcgggccattcccctggccactgccttggacaatggtcgtcccaccttggtggaattctatgctgactggtgtactagctgccaagccatggctccggacttagcagagttgaagaaaaactatggcggttcggtgaactttgccatgctcaatgtggacaacaataaatggttgccggaagtgttgcgctatcgggtggatggcattccccattttgtttacctagatgacaccggcacggcgatcgccgtgacgtaaacgctcttccacatagggcaacatacgttcaataatttccgctcggctggggact

SEQ ID NO: 63856 - DNA, 399 bp, Triticum aestivum
  Clone ID: PAT_TA_63856
cctgccgacggcgatcgcgccattccagggtggtgaggtagagaatgccaccactaacaagcactagcattaccagggccgctaaaaaaagggtgttgaggacaggagtaggagttgcttccacggtatcaaagactcttaaacaacgggaaatccaggtttaatcctagaagccgttccgaccccataccaccatgctgatggaccaggtgaacagaactaacacgcttacccaacctaatgtcaaaatgtccatagtcttttgttaaatacgccaataaaaacaagctttgccagcctttatcttacggcgatcgggcaaaattttaaagcttgcctcagggacaaaacgcccgagctaatctcccctggaaccatcattgtctctatccccttttt

SEQ ID NO: 63857 - DNA, 336 bp, Triticum aestivum
  Clone ID: PAT_TA_63857
tgggggactgttggcctgtgaccggtggggagtggggcgtttggcgtaactcggcgcaaattatgcatcgactgcaagcactgctgttcaccggaggtcaggaagatttacggggtaaaaggattcttatcaccgctgggggcacccaggaatatctcgatgcagtgcggtttattggtaatccgtccaccggaaaaatgggtttagctctggcccagtcggccggcgatcggggggcaagggtgactctcatccatggccccataggggatttgcccatacccatgggagtaatcagtatggcggtggtcaacgccgagcaaatggagcaagcct

SEQ ID NO: 63858 - DNA, 547 bp, Triticum aestivum
  Clone ID: PAT_TA_63858
aaagttaggcttgaaacctgttgtggccagtcttaaattgagtacaattttagggttttcatccatgttttctagaataatttactgggaaatttagttagaagttttagtaaatttttcgtattattagtgagcaaagtacggcggtaagtatcggcggcttttttaatcgcttcggcctgggtgggatagggatggatcaccccggctaatttgcttaagccaattttattaacaatagccgtggtaatttcagaaatcatttccccggcatgggaggcaacaatggtagcacctaaaatttcatcactgttggctacgtggataattttcaaaaatccctctgtctcgtcagcggcgatcgcccggtcaacctgggaaaagggaattttaataattttatagcctatgtctaaggcctcagccatagtttcatttaatcctacatgggcaatttctgggtcggtgtaggttacccaaggcatggttaaactgcttagtttactgcgtcctaaaccgaagggagaaaagagagtatttttaatca

SEQ ID NO: 63859 - DNA, 441 bp, Triticum aestivum
  Clone ID: PAT_TA_63859
gcaacaggccttagccggtttggaagaacgtacccgccgcattgtggaatttgtttttctccacgactttacccacaaggaagccgccgaaatgatgggggttagtgtgattaccgtttcccgtcgcattaaacagggcattggggctctgaaaaaagccttaaatacggaaattttttaactgtttagagtctatctccagtagtaagtagcaaaaattcagccaaggtcggcgatcgccctggtagtatggcaaatggagctttatgtctaacttttccattttgttttgagccattgtgttaacctatgctgcaattgacccccagtgccgcccaggaaattaaacgattgcaacacagtcgccaactaacccgccaccattttcgtttggcggtcaggcccggagggtgcgccggttggttataccatttggatttt

SEQ ID NO: 63860 - DNA, 372 bp, Triticum aestivum
  Clone ID: PAT_TA_63860
ccctggactaggttaggatttattaatgtaaaaaaaatataagcacagtcaaattgtctccaaacttggcatctaagcttagcgtttgcttagaataacttaattgcgtttatttaaaaatcaataatttctcttttttggaacgaacaaatgtcatgaattcctcgctttaccatggtgaaaaaatccgccattggtttcctaactcctccctagattttgtttcctcactacatgcaatgttggacaatttgtcaaaatggtttcgtaatttacctatcccaaattttagtaacaattccttgtttctccgtggagttagtaaagttcccaactctccccaatttaatgacccaattcaaaacctggcct

SEQ ID NO: 63861 - DNA, 396 bp, Triticum aestivum
  Clone ID: PAT_TA_63861
tcttgccttggaggggattgccctggatgcccaccacagtgaacgtttccgtcacggcttgatcggccaagattggcggattcaactgttccgccacccgtcgtaccccgtcgtaatagcactgcttccggattagtggccagttgatcaatccagccaaaggctccaccagcgcttgtgtcgttgttattacccctggggggagtagacaatgccccagcaattttggggggagcggattgaaaaataacgttaaattccccccggtccagggtgggaacaaatccctggggaatgaggggaataatggctaagcctgccattaaactgactagggccagggccacaatccaccaacggtgtgccaaagaccaagctagaacccgttgataacca

SEQ ID NO: 63862 - DNA, 450 bp, Triticum aestivum
  Clone ID: PAT_TA_63862
atctgcaccggcttattaaactgactagccataggcctgtgcagccggggaaaacgttgcaaaatttcccccaggggcaacatgcgggcccacatgagctcatcccgcagggaaaataccatctgcttttgcacatgcactgtttgatgggccggcctggaaagtagcaccacatcatccacggactactccaactgcatgatttcttccaaaatttcctgcaactgggccgatagggtgccataggaatccatttccagggcatcgaagttatgctctagccatccctgggaccttggctgggcccgcaacatggcttccccctgcggccggattgccaactggtccgccaactgtctcagtttcagcgccatggtctggaaggtgccaaaacgttgccccagggctcccacagccgtttgcaattgctgattttgtaaagacaggcta

SEQ ID NO: 63863 - DNA, 474 bp, Triticum aestivum
  Clone ID: PAT_TA_63863
ctatccagtggcaatttagaagactatggccccattgccggttctttccagccagtgttaggggcaacggaaccggaagatggcaacctcagcaatagtgttttgtactatacttttcctgccacggaaaatattcgtctgtgggccatgggggccgggggcgctttcgacgatttcaccaatacagtcaatgttttagacggggatggagcctttggagcattgactacctttggcacccgtagcccgatctatttcttgggggaaggtaccggggcggccctccagggcacctgggataaattacaacttagccttggttacctggcccccgctggcaatgatccttcccagggagaaggattatttaacggcagttttggcacgatcgcccaggtaaactatgatttcagcgataatctgaccgtagctgtaacctatagctatggctataacaccttggacactagcacc

SEQ ID NO: 63864 - DNA, 420 bp, Triticum aestivum
  Clone ID: PAT_TA_63864
attctatctggcattatttcggaacttcaacgttctaccacaagtaaagttccaattctaggggatttaccggtgattggagcattgtttaggcagtccacagacacaacagaccgttcggaagttattattctcatgacccccaagatcattcatgatagtacagaggcgcagtttggcttccgttacaatcctgacgcggctacggcggaattcctgcggcagaaaggatttcccgttcaggctcagccatagttaaattcctagcgggagactaaagtgttgaccagccgttccagaatgttaactcgataatagggttcacaaatctgggatagctggtttgcttttggttgataatttctaaacaagataatgttgccgtaaacgctttgaggggggaaaagtttatccaactca

SEQ ID NO: 63865 - DNA, 370 bp, Triticum aestivum
  Clone ID: PAT_TA_63865
agaggatcttcctgcaccattttgctcagagccatacccaatttttcgtccatgccttttttcttgggcttaatggcaatggagatcaccgggtcggggaagaccatgggttccaaagtggccggatttttggggtcacagagagtgtggcccgtttgcacatttttcatgcccacgatcgccacaatgtccccggcttgagcggactcaatttcttcccgggaatcggcgtgcatttccaccaaacgaccaatgcgttctgttttaccggtggcagtattgagaatggtgtcccctttactgagggtaccggagtaaatccgggtgaaggtcaaagcaccaaagcggtcgtccataattttgaacgcca

SEQ ID NO: 63866 - DNA, 452 bp, Triticum aestivum
  Clone ID: PAT_TA_63866
cagaataattggcgatggaggtaatcaccgcagcgtgatttgccatggctgccagcattaagggggtttttccttcccatagggtttggtccaggtcaacccctgcccggcccaaggcgttaaccatgaccgcttgggtctgggcattcccatgggtggcagtgagggctgttaggaggggcggatccccattgctggaaaaattaccgtcggcgccggcattgagtagttgggtcacaatctccacatgtccctgggcgatcgccaaatgtaaggccgtgtcccccgcttgattgacggcattgaccatatctttggggcccttttctaacagaatggtcaccatggattggtaaccttctaaacaagcaatgtgtaaggctgtatcgccgccatccccagcctgggtaaggggataaccgccctggatgaaagctttcacctgatcaacg

SEQ ID NO: 63867 - DNA, 338 bp, Triticum aestivum
  Clone ID: PAT_TA_63867
aggatcgggatggcaagtgattctcatcgagcaaatggaggctttgatggatcgcttcacaatctttatgaagcgctttgagctttccgatgacttcatggccaagatgactgttgagcaaatgaaaacccaactgggccagtttggcatctcccctcagcaaatgttcgaccaaatgaatttgacactggaaagaatgaaagccgaaatcaagtagacttcacggtgtcgaaattgtctagccagacgttcctcaccaatgtcagaatgatgggagtaggttccccgtagcaattgcgagaactatgcccaccctggatccccgggtaccgagctcg

SEQ ID NO: 63868 - DNA, 276 bp, Triticum aestivum
  Clone ID: PAT_TA_63868
tgctcccaacaaatatcaaccattggcaaaaccccgaattatcctttggtgactttactgtactttctagctatccaacagtctcaaaaaaattaccaggggtttcgagaataaaacggattcttccaatgtagtcaaaaagcatttatggcaactgactaaacatccaaaagtccaagtacgcaaatatttggtaattcgcatacgcatcaggctacaaactcaactaggtgaaagttcagttcatccaacaaagatccccgggtaccgagctcg

SEQ ID NO: 63869 - DNA, 382 bp, Triticum aestivum
  Clone ID: PAT_TA_63869
aactgtctgcgagggaatgggctgggtcggtactcagaactagggtcttatggcctaattccgcacaacggagaccggaggccgccgcaacggaggttttaccaaccccccctttacctgtcatcagaattacgcgcatggatggatctgcctagaaagatgaaaaattggagacggaatgttacatattgttaacttccatgtctgcattatgccgggaaagccagatttcttgcagggttgtggcataactctctaggctgtggtgccgacggtaagcttgggccatggctgctaattgctgatggatgcttgaatcggccaacttttggtcaatttctgcccatactagggattgggcttgccaatccactactaaact

SEQ ID NO: 63870 - DNA, 400 bp, Triticum aestivum
  Clone ID: PAT_TA_63870
tcgccctgttgactctttcccattatttttggcaatttgccctgcgattttacactagtgcttctagttgagtagaacaaaaaataggtttggacagagcaaagttcacgtctacgaaaaagtagaaatgaaaaccattgccccgccccttaacaactaacttttactccgtaaattttatagctatttgaaataaaattaagacagtaagaatttctgcaaggtttagattaaaattaccttggttatttatattgccctatgcttagttgaattagctataaactaaatcagtcaattagtcagctaatttaattagggttgtaacttatttgtttgctgatcggtgccccctggggattctgcaggctgaatcgatggaaaataaccgagtatgcca

SEQ ID NO: 63871 - DNA, 355 bp, Triticum aestivum
  Clone ID: PAT_TA_63871
aggatcgccgacaggtcacaggcccgccgcaacaaggctaattcagtttcacttttaacttgccggaggggatgcaccaagggatgggaattcactaaagcttggggaccatagccttggcggggataggcggccaattgtttttgccagtgcttgaggatggtttgatttaacgcttcatctcgaccgaggtggtaatggattttatctgccttttccagatatttcggtaaatgctcatccaattccccaatgggataggcaatgtccgacccaaagctggattgaaccccctccacaccgtagcgaatgcccgtccaggtttccttggctggatccccgggtaccgagctcg

SEQ ID NO: 63872 - DNA, 309 bp, Triticum aestivum
  Clone ID: PAT_TA_63872
aggatcgccctgagccaaagcaagtggccgaatacggcaaacactggcagccctatcgtagcctggctagatggtatttgtggcggaggttgtccgcaacagctagccagattcactcgaaggcgttagctctgaaatttttctagtcaaaacctaacaccattgatccctgagaatctctgcaatgcggcgggccgatccagcttgtcccagcctttcccggccattacaggcgatcgcctctagtccctcaacatcatgaagtacttgttgtaaagcttccccagattggtcaggactatgcaacaa

SEQ ID NO: 63873 - DNA, 508 bp, Triticum aestivum
  Clone ID: PAT_TA_63873
tcccggtcccatgggtcattgaccacacagcctaaaccactggtggccaaagttcccaaagcaatggtgcctagtaggggtaggggtggtagaccttgggccgctaaacacactgcccacagcgccggaatcattaaaatcagtcggccggcgggtttatgccagcgcaacaggtaaatgattgttaaccagaggggcggggaagatggggtttgggcaaccatagaaaaattaaaggactactagggggaaggggggcggtcactgctccaggcccaccaaccctgaccacattcacactggtaaaattcctgccatttgcgccgtcgatcatcccccaacactggcgatcgccgattgatccaagcccggagggcctgacgggggccagcttggcattggggacaacaaaaacccctggcatgaacagtatcctcaacccaagggggaggagtggggtcaaagactttcatggggttctggcatgggtaagggatggaaaaattcg

SEQ ID NO: 63874 - DNA, 411 bp, Triticum aestivum
  Clone ID: PAT_TA_63874
tattgctgagaatggttgcttctagccccacatttttaactgctcgactgagggacaaagcctgttcgtagtaatttaatgcctggtcataatcctcacgggcatagtaaattgtcccaatattatttaaggttaaagcttccccatcccggtctttaatttcccgacgtaggactaacgcttgttgataatagtccatggcttgattaagttcacccaagccgtcatacacgtaaccaatattgctcaaaattgctccttccaccaggcgatcgccagtttcttgggatatttttagggcttctttgtagtaggttaaagcttcatctttttcaccaacactatcatagagcaatgcaatattatttagtcgtatcccttccccagagcgatccccgggtaccgagctcg

SEQ ID NO: 63875 - DNA, 297 bp, Triticum aestivum
  Clone ID: PAT_TA_63875
ctgtttctttaatcagaccaaagttttccggtctaaagccagcttcaaactgggtttgttgattgtattttgccttgcttaactttgctccggttaagtctgcccccgtcagcaaggctccatgcaaacaggcatcttcaagattagccctggttaacaaagctccggcacaaagggcattgtttaaatgagctccctggaggttgactttaagcaaaaaagtttttattagagatgcttgccttaggtccgccttagctaaattcgcccccgacagatccccgggtaccgagctcg

SEQ ID NO: 63876 - DNA, 498 bp, Triticum aestivum
  Clone ID: PAT_TA_63876
ctgcaggtcactctagaggatcgccgtgaccgtggtagtaatttgggcggcaaagggatgggacgcatcgacattgactgcaatgctatggcgttttagaaatttcggtatttcctgtggggttaaagctccaacgtgaaccgtcaaacattgatgaatcggatataaatgcttggcctccgatgtggtgactgtcaccagacaatttattccctgggcaattaacccttcggctacggcacgactatccaccgttccaccaattaaccaaacggttgccaggctatccaccatgatttaagtgcttacaactggaatttttcacccaagtaatattgccgcaccaaaggattttccgataactccccggcactaccggaagccaaaatttgcccgtcccgcataatgtaaccccggttggtaatggctagggtttcccgcacattatggtcggtgattaaaatgcccatatttcgttcccgcaactgggcaatgata

SEQ ID NO: 63877 - DNA, 489 bp, Triticum aestivum
  Clone ID: PAT_TA_63877
ggtcgactctagaggatcattaccgacgccctagtaggggaaggctcatccccccgccacaaggaatcccccgtttccactaaactcagacaacgagaagttgttacccccaaacgatgcaacgcctcagcggccaacacttcccttaccccacctttgagggttaggcggccatcaccgccccgggaatagggagtctggccagagcctttggtgccaaaatcgaataattccccgtttactccccgcacttggccgtagagaaaaccccgaccgtcacccaaattaggattatattcaccgaattggtaaccgtggtaacgcagagctaaaaatggccttaccccatggaataaaccgaaagcttcaacgaaattatcatccttaacctgacttggctccagacccaacatgggcaacaggcgatcgttacggaatctcagtttatgctcaggaaaagtcgctgctgacactgggtcaaaaaattca

SEQ ID NO: 63878 - DNA, 364 bp, Triticum aestivum
  Clone ID: PAT_TA_63878
caggtcgactctagaggatcgccatcgttttggttcttctaattgcggtggtgctattacggggcaatcaatttcccctgatggtaacgcaatacagttggcgcaacaccaacatcggggcccaaacccaggccctgaccatgacttttaaccatcccgttgacccggacgtaatggagtcaggcttggtaattgacccacccctggcgggcaaaaccatttggcaggggcggcgttggttctacaccctaacggacatcccccgttatggcactaactatcaattgaccttacctttacctgccatggtgcggggtccaaggggacaggatttcaccagtctgatccccgggtaccgagctcg

SEQ ID NO: 63879 - DNA, 263 bp, Triticum aestivum
  Clone ID: PAT_TA_63879
tcggtgcaactgcaacaggcaaaagttggtttatcgacaagggcggcagaaaatttaaccatagccgaagtgtcggaaccagaaatggtattaaaaattctcaaagcctctgcccgctctgtgcccaacgatagtctgaattactacggtgctggccatgtcaacgccggggaagccgtcaaacaggcccaacaaggagagatttccttccgggatttcatgcgttggttgcgggataacggttatctcaatcccatcttttg

SEQ ID NO: 63880 - DNA, 360 bp, Triticum aestivum
  Clone ID: PAT_TA_63880
gatcgccacccacggcttggataatttccaccacttcggcgatcgcctctgggagattaatgcccagcaaagccaaaatttccgacggcagatcctccaggtgggaaccgagccttataggggacttataagaggaacttcccagttcagttgtatccagtaatgccttggtaaccttggtgagggtagctcccccattggtcaacacatcggtcacattgcgacgactgcaacctaacttctcggcaatggcactgccggtggtgaagccagaacggatcgcctcgacaatatgccagcgggcaatctgggaacgatcgccagcgtggggagtaatttcaaaaccatggaggcaaacat

SEQ ID NO: 63881 - DNA, 309 bp, Triticum aestivum
  Clone ID: PAT_TA_63881
caggtcgactctagaggatctttaactggagcgacaaacgtagccatggttaattgtctccgtcacaatttttcgagcttaatagtttggggtcagatgattagggggattgcaccgaaaaacttatgttaatcggtatatttccgtatgctaacgacgtttagcggcaacctggggggtcatgccaccgattaagcgctgtagctcgtccggcttaccactcttagctaaaccttcttccagggaaattacccccgacaccaccaacgtggccaggccctgttccatggtctgcatacctagttttgc

SEQ ID NO: 63882 - DNA, 208 bp, Triticum aestivum
  Clone ID: PAT_TA_63882
ggatcgccgtctgacgattaacttacctcccaggagttggaagagatttttgtgtcatttcccaatttaaactcaggcaaccggtttggggctggaacatcaacaattcccccagagccctgacgggattggcttggtgtactgactgggtatggaactgcacttttaactggtcaccggcagtggtgatccccgggtaccgagctcg

SEQ ID NO: 63883 - DNA, 404 bp, Triticum aestivum
  Clone ID: PAT_TA_63883
tgcaggtcgactctagaggatcatcgggacagttatgaagatttagtgcattttgtcgaaatcgtggcaaacgctggctgtcaaagattcactgtccatgcccgtaaagcctggctccaggggcttagtcccaaggaaaaccgaaccattcctcccctacgttacgaagatgtttatcaattaaaaaaggattttccccagttattgatcgaaattaatggcggtatcacccaaactgagcaaattcaacagcatcttagccatgtggatgcagtgatggtgggccgagccgcctacgaaaatccctaccttttcgccaccgtagaccgggacatttaccacaaaaccaatttagtccccagccgagcggaaattattgaacgtatgttgccctatgtggaaga

SEQ ID NO: 63884 - DNA, 468 bp, Triticum aestivum
  Clone ID: PAT_TA_63884
gatcccgactttgccgaatgactaaagtccccgccagtaaatctccaatgcgtttttcccgccggccaaaaatgattaataaagcgccgatgtaaagaaaatcatcaatggggcggaacagagctcttaaactagcttcctgtaagccaacggggcggccatctccccgaattacccgaattttagccctgcgtttaccgggggtttgaccctgccagagggtttcaaaaaagacaaaataacccacataaaccgcaaaaatgaggaaaatttggatagcggtgagccagagttgccattccccggaggcgtagagggaaaggttataggccaacaccgcccaaataattagcaaaattaaaacaacgcttcccagacagacatagtcgatcagcaccgcatagagacgattgccgatgcccgccaaagtaaattccaattctacgctttcgggggtttccacctgat

SEQ ID NO: 63885 - DNA, 237 bp, Triticum aestivum
  Clone ID: PAT_TA_63885
agtgctgaatttgccccggaagcggaagggctgaatgtctggttattgacgggggttaatggagccggcataaccaccaccatcggtaagttggcctttatggccaaacaatccggttatgactgtgtgattgcggcggcggatacttttcgggcggcggcggtggaacaggtgaaagtttggggggaaaggagtggcgttcccgtcattgctaaccctgggcaaaatactgacccg

SEQ ID NO: 63886 - DNA, 108 bp, Triticum aestivum
  Clone ID: PAT_TA_63886
aattgatggggccgtttttgtttgctcacctgggcaattaaatccggtaccggagccaacggcaaactgtcgggtaaatcctgtttagctattttggctgtccatgtt

SEQ ID NO: 63887 - DNA, 414 bp, Triticum aestivum
  Clone ID: PAT_TA_63887
gggagccgtcaagcacacttaaaagaagttccgggttgtaattaatacggcctatggcctggccagagcccacgccgtgaatagaaaaaaacaactcatcaacaatcttgtaaggcactgcttcatatggccattggtgatggagtaaaacctggtgaccgggtttaagcctcatgcgaacctgggagtgaatgcctaaacgacctaatactggtacatccgcctcaacaacttgaaaaatcatgtctgcaattgaatcgcgagaaaagaccgcaatggcaaaaccatctaagtcccgcacattggcaataacaacctgattttcagttggttttaatcccaaaaaattcagctcccctggcgttattcctataacgggcctgaagtgctcaacattcacacactgtccagcgt

SEQ ID NO: 63888 - DNA, 385 bp, Triticum aestivum
  Clone ID: PAT_TA_63888
attcattgccgatagtgataacctccctttggaatttattctttgtcagagtgctcccaacaaatagggaaaattatatttttcgccatcaaagattaaatttaagtcaattaatcgcccttactctgctcaccttactgctaagcctaggttttgcccaagcccagtcggcacaaactctccttagtcaactaccgccccaaattgacctagtggatcccgtcaagtctgatttccccctgcaaaataaagcttttaatctaggctttgaatcagatttatccggtagaattggtaacttggattacaccaccgttagggtagatggagagccaatttttttgattgctgtgcccacaggaaatgctagtaaagaaggagattc

SEQ ID NO: 63889 - DNA, 220 bp, Triticum aestivum
  Clone ID: PAT_TA_63889
ccaaccaaccaatagaaagcaccaaatcagtgcgttagattgcggtaattgccaagacaaaggtgagcatttgtccgcctacaaattcttttctaaattaggagcaaaggacaagctgcaactacacacctgggcagcattgggattggtgaaacgaaatcctccccccattaaatcctcggcatagtctaatttgagattgtggaggtaacctgcactc

SEQ ID NO: 63890 - DNA, 273 bp, Triticum aestivum
  Clone ID: PAT_TA_63890
ttgggagaaagattattgttgccggaacgtttaatggttctttcgcagggaaaaggaaaggctcagcgggaggggtttctagtcagtatccgcccatcctacattggcgatcgccgccgggttgttcggaacatcccagcaaaaaagcctccagccctcgataatccgctaacctgaaattaggtacttctcccccatttacccaaggcgttaaagcattcaggggttgattttttaaggttatgcaaacaaccagtgacgttctcattattg

SEQ ID NO: 63891 - DNA, 294 bp, Triticum aestivum
  Clone ID: PAT_TA_63891
acctagttcgataatgctttggagaattacctgatttttttccctagtcaaaaggtcatctaagaacgacttatgaatttttaaagtctggagaggtaaatccttgagataggagagggaagaatagccgacaccaaaatcatcaatggcgatttgtatgcccatttcatttagttgattgaggcgattaatggtttcccctggttcatagagcataagactttctgtcacttccagggtaatttgctggtaacttatttgagtctgagcaacaatactttctatctcgcttac

SEQ ID NO: 63892 - DNA, 302 bp, Triticum aestivum
  Clone ID: PAT_TA_63892
aggatcatggtctaagcactccgcatggtttgccagagttgcttatattggttgtacggtggcaatgtccaggggcgcgagaaatggacaacgctccagtaactccggtgaaaaagccaataaagggttagtgctcagggcggaaacctccaggttttgatagggcaccgccagggcattactgaaagttgccatctgctctagactggaaggctgggcggaaaaatttaaccattcataggtaatttcagccgcctccatctcagcgggcatagtccagagatccccgggtaccgagctcg

SEQ ID NO: 63893 - DNA, 229 bp, Triticum aestivum
  Clone ID: PAT_TA_63893
tcgatcaacatcggcaatgcgcgctcggttcacctgcaggaggacctggggctgacgggcgtgcaatacaacacggcgtctaccgtcttcttcgtcccgtactgcatattcgagatcccatccaacatcttcctcaagaggttctcgccgaggatatggctgagcatgtgcggcttgagattcggtgccgtcaccgtgttcatgggactgtgccagaacttttcgggat

SEQ ID NO: 63894 - DNA, 192 bp, Triticum aestivum
  Clone ID: PAT_TA_63894
tcgcttactgttgattcatctcttttgtgctgcttggcaatcccatttgtttggtcattgctgtttgattttcggcctgatgacaattccatcaaatcggctctggcttgtattgatgcccccttgattctttctgatggaaatcaacttttactcatttcgactgacctgaatttcctttctttgacttct

SEQ ID NO: 63895 - DNA, 385 bp, Triticum aestivum
  Clone ID: PAT_TA_63895
tgtcgttgcccacgcgtccgcaatctctagcgtgttgcaaatttggagagctagagcaacctgcagtccacgaaacagatcagaataagcttccagccatgaggttccccattttagtgtttgtgtgggctgcggcggtgctgctcgccgtggccgccttctcggcggtggcggacgcgtcgcctcggccgtcaaagtctttgaaggtcgggttctacaagcacacatgcccacaggccgagtacatcgtgcgtgacgccgtccgccgcgccgtctcccgcaacccatgcctcgccggtggcatcatccgcatgcatttccatgattgcttcgtcaggggttgcgatggctcgctgctgatcaactcgacacctgggaactcggc

SEQ ID NO: 63896 - DNA, 303 bp, Triticum aestivum
  Clone ID: PAT_TA_63896
tcgcggacgcgtgggtgaaccctgttctcttgcggcccagcatccgcggctgttgcgagctcctaaagccgcgacccccgacgccataatccctcaacgatccccagagcagagccatcctctctctctccccgcgagccctcacaagcgagaggaaagagaccagagatgggcggcggcaactgcaaccccaaggacttcggcgccgccgcctactgggacgcccgctactcctctccctccactggcggcaagggcggccgctgctgcgggttcttcgactggtaccagtcgtactcggcg

SEQ ID NO: 63897 - DNA, 263 bp, Triticum aestivum
  Clone ID: PAT_TA_63897
tcgcggacgcgtgggcgcgtgccgacctcagcaacgatgggcacgggcacgggcacggcactagggccggccatggccgccgccgcctccagcacggcccaccggcctgggccgctgcctgccgcggcgaccgcgaatcgcagcgccagtcgccccaccgcctgcgcgccgcccgggagaacgctggtctgctccgctccccggcagtctgaggcctgcgcggcgcgccgtcgcgaccacggtccgggcggcggaggccgggg

SEQ ID NO: 63898 - DNA, 244 bp, Triticum aestivum
  Clone ID: PAT_TA_63898
tgtcgttcgcaacaaccggccctccacagggggacctgctgctcctgctcccaacactcctccttccccccgccggcggtcacaggcaccctacggcactctgccggtgctcttatcttgtcctacgcgtcgccagatcggaagccgagggccaggcataaccgccggccaagggagaggacaggacagaatagcttcccccgtgccgagatctgccggccagatctgacctcggagggaggac

SEQ ID NO: 63899 - DNA, 372 bp, Triticum aestivum
  Clone ID: PAT_TA_63899
ttcgttcggcagggtaaatacaatggaaggaaaggactctagagaaaggatatcaaaggcagaaccaaagcatcaacattctcatttagagaagagtgacagtgtaccaaaacctgcagaaaagccatccccagtttctgccgaggtgtcaggaaaagagacacctagggttcagagaaccaaagagaagggaggtatagcagaaaaggaaagagagaagaaggacaaagaggcttctcgaagactggaagaggcaaaagaaaggcaaaagatattggagaaagaaagagaaaatgccgaagtcagtgaaaggaaaaaattggaagaggaggaaagggagagggaaaaggaaagggtaaaggataagcttgc

SEQ ID NO: 63900 - DNA, 386 bp, Triticum aestivum
  Clone ID: PAT_TA_63900
gttccccgaccagcgccgccaccatcctccggccgcgcgcgcagcgcgaggccgccacccgccacggcgcgccgcgcccgtcctaccatgcggtgacgcccgaagccgccacaccgagcccttctgaccgcctcgccgccgcacgcacatgcagttccccccgtcgcccgcgcgctccatggccgcgcccgcggccgtgcccgccgtgtcctgcctgcgcctcctcctcctccccgggttcagcgcctccctcctcgcggccccgcccgacccggcggccatgctgcgccggccggccgccgccacgacggccgcggaggagcgggaggccgacgcggacgcctcgctgggctctccggtggacgacgagccgcccgaggagggga

SEQ ID NO: 63901 - DNA, 294 bp, Triticum aestivum
  Clone ID: PAT_TA_63901
tcgagttcaccaaggtttagcaaatcgtgtgccgggccatgtcactacgccggagctcagcggctgcgctcgcggcgctgctggcgctggcggtgctgctgggcacgtcggcggacgatggcggccagggccaaccaatcgtggcgcgcgtgagcaaggacgcctccacctccctctacaccatcgccatcaaggtcggcggcgtgccgctcctcgtcgacctcgccggcccgatgctctggctcgccaactgccccaccccgcaccgcatcatcccctgcgtctcccacgact

SEQ ID NO: 63902 - DNA, 365 bp, Triticum aestivum
  Clone ID: PAT_TA_63902
catccgccgcccttttccaccccacgactgtggttcttccccttctttactcaccccgccgtcgactattcgccgccgtgggctcatatattagccgctgcgtgccgtctgccttcacattcacacacactcgcccggggacaagccaactcttgcgctcccacctccacagcagctcattagcagccgcgcacagagccagcgtgcatccatggcgcccctgctcctgctcttcctcctcggtggcctatgcgccctattctccctgggctactgctgctcgcgcggcgccaagaagtgctgcgacgtcgacggcgagaaggccaagagtcaccacggggagcaagaagccaaggccagcaagg

SEQ ID NO: 63903 - DNA, 339 bp, Triticum aestivum
  Clone ID: PAT_TA_63903
tcgcggacgcgtgggcgcggtggcgcgggagctgcgagaccaatgccaccgacttcccctcctcgatgtgcaaccggaagctcatcggcgcgcgcggcttcttccggggcttcggggcgggcggcaggaacggctcctcccatgggaccaccgagctctcgtcgccgagggaccacgacgggcacggcacccacacggcgtccacggcggcgggggccgtggcggccgacgcgagcctcctcggttacgcccacggcacggctcggggcatggcgcccggggcgcgcgtcgcggagtacaaggtgtgctggaagcagggatgcttcaggtcggacatac

SEQ ID NO: 63904 - DNA, 245 bp, Triticum aestivum
  Clone ID: PAT_TA_63904
tcgagttcgccgcgttctgcagagtcttcaaggatgggcatggtaagcctttcgtccccatgtgcagtgaccgcaccaagtgatctctcaccccgggtctatacacgccgtcttttgccgggtttgtcgacacctacatttcgtccgggacgatctctctgagaagcttgatcgaccgaccggcggctgcgagctcaggcgccggggggaagacctgcatcctatcgagagtgtacccatccatg

SEQ ID NO: 63905 - DNA, 138 bp, Triticum aestivum
  Clone ID: PAT_TA_63905
tcgctcggctcctgcctagccttgtacgccgtctctcccaagccctcctatcccatgcaccgtgccggctcctcccggatctccggtggaacaccatcatgcggaggactcctcctcacgcggcggcatcctccgcca

SEQ ID NO: 63906 - DNA, 391 bp, Triticum aestivum
  Clone ID: PAT_TA_63906
tcgcggacgcgtgggtccgccgcgatctcgtctcgctacgcactctctatctgagatttggaatcgggcgaggcctgcagctcctgccgacatggcgctcgttttgcattcgggcagtggcaacaagaatgccttcaaggcacttattgctgcagagtactgtggggtcaaggttgagctgaccaagaattttgagatgggtgtctcaaacaaaacccctgaattcatcaagatgaacccccttggcaaggttcctgttcttgagactcctgatggtgctgcttttgagagcaatgctattgcacgctatgttgcccgctcaaagggtgacagcctgctttggggtggttctcttattgaatatgcgcgtgttgagcaatggatggacttt

SEQ ID NO: 63907 - DNA, 360 bp, Triticum aestivum
  Clone ID: PAT_TA_63907
gagccctatcctgcccaaaccctcccctcccctgccctagcggatccacacctctccctagcggcggcggctgcggccacagcgggaagcgacaactcgaagcatccccccagcggcgagcatggccagcgtaggcacgcacgcggcgggagcgggcgagcagacaccgctcaagaaggcgggcgaggcggagcaagacgaggagctccaggccccctccggctggaccaagaagcttaattccactcggggtgggaagcctgaggacgcctcctgcgcaccaactggcgaggaggtcaagaccaagagagctttaaccacatacctaaaagcacaccctggaggccctgctctttcaga

SEQ ID NO: 63908 - DNA, 324 bp, Triticum aestivum
  Clone ID: PAT_TA_63908
agacaagagtagacgatccccatccatcgccacctgaccaaccgaatcactcaccattcaccaagtgaaagcaaccatggcaccgccgcgttgcggttacatacgtggccccgcggccagccgacaccaacaacatccgtcgccgatcgatcgataggccccgcccaaccgatcctcacttcttcttactcttcttcttccgcgggcttctccctctccctcctaactctctcctcacacggatgcacctctacaggctacggcaacgaagctagcttgctacttgttggccttgcccagcagcttctcatcttctccccggct

SEQ ID NO: 63909 - DNA, 309 bp, Triticum aestivum
  Clone ID: PAT_TA_63909
cgggagaccgacttcgcgcgcttcccggactccgcccccatcgtcatcgacaacggcgcctccaccttccgcatcgggtgggctggcgaggcggagccgcgcgtctccttccgcaacatcgtgcagaggccgcgccaccgtagctcaggtgaaactgtgacagttgtaggagacactgatccagctctaatgaagtactttgactgcacacggacatcaattcgcttagccttcgatgatgatgtcgtctatcagttcgagtacatggaatatattcttgattatgcttttgaccgatttggtgccaca

SEQ ID NO: 63910 - DNA, 305 bp, Triticum aestivum
  Clone ID: PAT_TA_63910
accatctccattaccgtcagggtctttattgtatccgtcgctacacgacgttctgccgtcaagcagctaccctccgccgggaacgacgggctcactgtttccgtcgtcaaatttcggaccaaacagtagctacccgccgccgtcggcaccggccactgcatatccgccaccgccgccgtcgtgcacagcctgcccggctcctccggcacaatacatcagcagctatccaccttcactgccgagctattatcctcctccaccaccgagcggctacccaccttcagcacggatgaacccggagttcc

SEQ ID NO: 63911 - DNA, 313 bp, Triticum aestivum
  Clone ID: PAT_TA_63911
tacgggcgtggaatcaccgtggtcgagagagctatggcaaagaggaacggttcccccgtgatttctgattttgagattggcgtcgaagaattccactctgagggcaggtctgcgatcaaaggattcaatttcagagacgagcgtgttatggatggtaactgggttcaccaagcccactccggtgtcatcgagatgttcttccggttgctggccatatgccacacatgcataccggaggtcgacgaagttacagggaagatttcatacgaagcagagtctccagatgaggctgcctttgttgtcgcggcacatg

SEQ ID NO: 63912 - DNA, 320 bp, Triticum aestivum
  Clone ID: PAT_TA_63912
ccaagtgccaggccaacaatgccaatgctggcttcaacgcaggctatctctccggcttccccgagtcggagatcactgcggtcgaggaccgcacactgactagtggtaatgtcccgtggtactcgctgcacaagacaatggcaggtctgctggacgtctggcgccacatcggctctgaacaggccaagacggtgctcctcaacatggccaactgggcagacactcggacggccaagttgtcgtacgccaagatgcagaccatgatggacaccgagttcggcggaatgaacgatgtcctcaccgagatctactattacact

SEQ ID NO: 63913 - DNA, 291 bp, Triticum aestivum
  Clone ID: PAT_TA_63913
tcaaccccccgtcgatcccggggatctttcgccccgagaaaaggtggcaacccaaggaaaggagaaggcgacgacgcgacgacgacgtcggcatcgagtagaaagcagagcagagattttccttggggtgccacgggaggagccgatgccgatgccggcgccggcgcaagaagcggacgacgacttcaccttccccacgccgccgccgcttctcgccgcagccgcgtgcagctacggccaccaccgccacagcaacagggtgtcgccgtcgccgtcgccctcctcctcccc

SEQ ID NO: 63914 - DNA, 319 bp, Triticum aestivum
  Clone ID: PAT_TA_63914
ctgttttggaagaagctgcgcaggatactgaattggatacctgagcctttggattatatccatcatgcctctcttcgtcttggccgagacgcctgcgggctacggtctcttcaaggccaaggacaagaagcttctgtctcgcgatgatattacgaagtcgctcgatggcgccgatgccatcaattccgctctttcattgaagaagatgatcaagttcgaggactccgcccaggctctcggtgaatacagctctctgtgcgagggcaaggttaccccgatgctgcagcaattgctcgacgacatcaaggaggagcgcaag

SEQ ID NO: 63915 - DNA, 221 bp, Triticum aestivum
  Clone ID: PAT_TA_63915
accaaggcgcccaaggtgagcattcggttcgtcggcacggagctcggcgtcaagccggcgccggccgtggcgtacttctccgcccgcgggccgacccagatgagcccggcgatcctgaagccggacatcgtcgcgccaggggtggacatcctcgcggcatgggtgcccaacaaggaaatcatggagatcggcaagcagaagctctacgccaagtacatgct

SEQ ID NO: 63916 - DNA, 187 bp, Triticum aestivum
  Clone ID: PAT_TA_63916
aacagatacgtaaaagtgtagcagaagcagatgatctactagtgttagctgtgccgccggtaattatgctatgatccgcttaatcgtactcattctttgcgagtgattactactacatatataagtataaaggaggaagtactagtatatgaagtgaactgttgataggaactgtagtttctagaag

SEQ ID NO: 63917 - DNA, 384 bp, Triticum aestivum
  Clone ID: PAT_TA_63917
gataagtttgcgaagatatgggacatgcagacaaaaacatgtgtccaaacatttggagaattcaagtcttcggttatttctgttgtttcccatcccagtcttccagttttaattataggcacaagagatggtgctattcatttgtggggcacaaatttcaggtacaagcgacaacttagcattggcggtcctggaggtgctaatggtctcacatgtctgacggcgttaggaagggttgtgatgggaaatgagtcggcgctattcatgatggagatccttgatgaagaaccagatgctcctgtcggaagtgaagaagcagttggtagctcgggcagcaattgaaattcccagtgtgggagacggtcgattatgaaatctgaattg

SEQ ID NO: 63918 - DNA, 195 bp, Triticum aestivum
  Clone ID: PAT_TA_63918
ccatggcggaggaggagggcacgcagcaactgccgttcgtgcgggagacggtcctcaagaagaggaaggacaacgaggagtgggccaccaagaaccgggagcgcaaggcggccaagaggaagcgccgacggcacgacgccgagggcgccatcaagcgtgccgaggacttcgagagggagttccgcaacaaggagc

SEQ ID NO: 63919 - DNA, 272 bp, Triticum aestivum
  unsure (1)..(272): unsure at all n locations
  Clone ID: PAT_TA_63919
ctcgcgcccaagccgncggcggaggacactacggcagaggcacaagaccatgacgagaactacgacatcgaggaacagccgacggacggcgacggcgaagagaagccctctggcggcgggtccgagtacgtgtcgcagctgttcgccgcgctgtggggcttggcgtcgaagctcgggaaaggcccgctgcactacgtgatgaggccgatcgctttcgctgtcaaggcgccgaggaagatgctcaccgtcgtgccgggcatgtctggcatgaa

SEQ ID NO: 63920 - DNA, 251 bp, Triticum aestivum
  Clone ID: PAT_TA_63920
gctgtcgctatcagcgcaccgcagccgccgccgtcgccgtcaacgccaccaccgccatcgccatcggcttcctcttcttctccggcaagctgctctcaccggagattcatcgatggacggtgatttggtggaggctgctacttgttagattggtgcagacaaagagcttttgcttcaaatttatgtagtttgtctgaacatatgatgccatccctatgaagaacttatgtatagttagttatgatgctagc

SEQ ID NO: 63921 - DNA, 268 bp, Triticum aestivum
  Clone ID: PAT_TA_63921
ggtcatcatcggcatgaccggttctttccggcggccaggaacctgcaaggatggcggacgtggttggcatccccacggagatcctccgcctcgcgctggcgatcaggcaggcggctgacacggtgaggcagaacagggaggactgcctcgagatccagcggtgcgtgaacaggctccacggcatcatgtcctcggctattcgcggcacaggcacggacatgatagcgaacttggcagtgagcgccgcgctgggggacctggaacggat

SEQ ID NO: 63922 - DNA, 259 bp, Triticum aestivum
  Clone ID: PAT_TA_63922
acatcctccatgggaagtttctttccaggtcgacgggttatcattgtatcagataccataccaactcctactggcacttgttgattttgaagagaaatttgaacagatacttttgatgaactcccaagtgttataatatcaccatcagcaagttcgggaggcgcactccaacgactagaaccaacatcacgatgggtaactgcctgggaattcaagaaggttccattcaaactgcccatatacacaagttcccatctga

SEQ ID NO: 63923 - DNA, 294 bp, Triticum aestivum
  Clone ID: PAT_TA_63923
ccgtaccacgcccccgcccccagcacccccgcctatcacgcccctcgtgcccatcgcctatcccgtttcctctcaccgcagcatcgcgtttccgcggtctccgccccttccgcaaccttcggtcattggtttgtgagagccttcaagatttgagcaccacaggcaacagtcttctacatcctagtgtcggtacttggtagggtaatcttccctggtccccagaagctgacctgtatatgagaagattgaacagagcatgtgaaccatcctgaaatctgatgcacatgtgaacca

SEQ ID NO: 63924 - DNA, 273 bp, Triticum aestivum
  Clone ID: PAT_TA_63924
gacaagggaggagggtgatgcagaatgggtaattagccgggtcatcgacctgcaaaatttgctcccacctgctgctctcgtggatgcagaggctgaagtgatggtattgggatttgccgagggagtgaatgtcattttcgttaacacggtggctggcctcttcacaatcgagctacagtcggagcgggtgaagaaggtgtgtgataatcatggctttctgtaatttgattccagttgtcagcttctgcactcctgtggaccgtctcaaatacc

SEQ ID NO: 63925 - DNA, 285 bp, Triticum aestivum
  Clone ID: PAT_TA_63925
acgcacagagctcaagctgttggcacggtggcggcaccggcgcttgcgtcggagcagcttcggcttcggcggctgccacagctgctgcgccctcggctagcccctgaagagcgagagcccgccgctgcactggttgcactccctctgcatggtccacgcgccgagttttcgacctcgaccacgcccaaccgtccggtggcagccatggaccgcgacctccccgatcatgccccaccatctcacattccctcctcgcctctagagctccgccgatgcttccgtctc

SEQ ID NO: 63926 - DNA, 300 bp, Triticum aestivum
  Clone ID: PAT_TA_63926
cgcacacacactctctgcatgttccatgtgttttgtcacgacagctgggcatgatcatcaacgagacgctccggctgtacccgccggcggtggcgacgatccggcgcgccaaggcggacgtgcggctgtcggacgggtgcatgatcccgcgcgacatggagctgctcatcccgatcatggccatccaccacgacgcgcggcactggggccaggacgcggcgcagttcaacccggcgcggttcgccggcggggcggcgagggcggcgaagcacccgctggccttcatacccttcgggctcg

SEQ ID NO: 63927 - DNA, 174 bp, Triticum aestivum
  Clone ID: PAT_TA_63927
tcaactacacctccggcaccacgtcggcgcccaagggcgtcgtgcactgccaccgcggcatcttcgtggtcaccatggactcgctcgtctcctggtccgtgccggagcagtcgacgtacctgtggacgctacccatgttccacgccaacgggtggagctttccgtgggggatgg

SEQ ID NO: 63928 - DNA, 282 bp, Triticum aestivum
  Clone ID: PAT_TA_63928
aagccatagttcattttccttctttccatgtgatgtcagcagtggtgccatttcgaaaatttatatgcgatggttcactaatgactggttgaactgagaccatttttgaacacccctattagcactacttgtttcgtccagactcataaactatacacatattataggcatgcaacacttgattacttgaacgcctaaaatgaagtggaaatatttagcgataagtgcaaaccatggaaaaccacaccaattgttttgtgttcctcactaaacattgtaaaa

SEQ ID NO: 63929 - DNA, 263 bp, Triticum aestivum
  Clone ID: PAT_TA_63929
aagctctacgcctggaaagttcgtgaggtgcaaagaacggtttgtgatcagcgatgactggacaatcacgccggcatccacttcgctgattcacaggttcagctctgaatctgaggccgccttccccgggtttgaggaggtggaagtgcgtgtcagctggcccaaggttatatccatgctgaaggcttctctgtcgtcggataccatattcactgatattttcttacccatgggaaccggtggtcaggatgctcgtgccactg

SEQ ID NO: 63930 - DNA, 215 bp, Triticum aestivum
  Clone ID: PAT_TA_63930
ctgcggctgcaagttcgccgaccccgacacggtcgttccctccgcggcggcggcgtcgcatcgcgtgcggccggacaccatgagctgcggcagcgacgggtgcagggacggcggcagcggcggcggcagcgaggggttcgggcggtcgcggccgagcaaggtcgcggccgacgactcggtggagcccgcgcggtgctcggacgccacctcgccgt

SEQ ID NO: 63931 - DNA, 356 bp, Triticum aestivum
  Clone ID: PAT_TA_63931
ttccaagctccatctcgctgtgtgcccgtcattgccaacacgccgccgttttcctttcccaacacgcccagcggccccctcttgcatctcccctgagccgccttcccccgacgacgacaccattggcggcacggccgcgagacgatgattcagcgcgggcgacggcggtgacatggtcgagtagcggcgccgaggaccatgccagcggccgtatccgcgtagagggagatcgaagatgaggaatacgcagcggaaaccatctattctcaacttcgatgctggatgcggatcttccttgtcttttattgtaataggcttggtgggatgcaccctcattgtctgcctatttttcatca

SEQ ID NO: 63932 - DNA, 327 bp, Triticum aestivum
  Clone ID: PAT_TA_63932
gcaagccggagtacaccgacctcttgttttacaaactgaagcaccaccctgcgcagatcgaggccgccgccatcatggagcacatccttgaaggaagctcctacatggcactcgcaaagaagctcggcgagcttgacccgttgatgaagccaaagcaagataggtatgcgctccgcacatcaccgcaatggcttggcccccagattgaggtcatccgtgctgcaaccaagtcgatcgagcgggagatcaactccgtcaacgacaacccactcatcgacgtctcccgcggtaaggccatccacggtgggaacttccagggcacaccta

SEQ ID NO: 63933 - DNA, 198 bp, Triticum aestivum
  Clone ID: PAT_TA_63933
gagacgccgacgacgcgggcgcgcgcgcccgggccaccgaggccgtgcgcgaggcgtgccaggccaccgggttcttccgcgcggtgaaccacggcgtgccgcacgagctcatggcgcgcgcgctcgatctgtcggcggcgttctttcgcgctgccggacgaggagaaggccaaggtgcggcccgccgagggcgccttc

SEQ ID NO: 63934 - DNA, 243 bp, Triticum aestivum
  Clone ID: PAT_TA_63934
gactttcagataatacatgtgtcaatttcgcagaatcatatcgagcatatgggcatcgttgacacgtagtgcatgacacattgcgcgattaagatgttcttaggccagctaagtaacataagacaacttttgtatgaagatcggttgttcggtttcactctgacagtttagaagcttttgtttggcgtttctctcggccggataatagagaaaaagagacttacgcaggcgacgaagatttca

SEQ ID NO: 63935 - DNA, 300 bp, Triticum aestivum
  Clone ID: PAT_TA_63935
cctgctgctatttccagccttttttcactaagcgcccaacggtcgcccgcccggccggcctcatctcgaagcgacattagcttgcatattgtgttgcagcactcaagcagcaacccgctttccagccgctgcctgacttataatagtctgccgtcttcccgcttctcatcagcaaagcatctgcatcgactattccgccttttgtcctttccgctctcggcttcatctctggttcaactgtcatcggcatctggtttccatctcctcttccgacttatacaccaaccaagaatcatattc

SEQ ID NO: 63936 - DNA, 312 bp, Triticum aestivum
  Clone ID: PAT_TA_63936
cctccccctcggcgaaaccctagaattcatccggcgcggcatggcggacggcgagggcggcgcggacggcctggcggagaggctcgcgggggcggagatcgccgcgcacggcggcggcggtggcgaggaggagccgaagctctcgaagaacgcccagaagaaagaggagaagaggaggaagcaggaggagcagcgccggctcaaggaggaggagaagaagagcaaggcggcggtggctgcggtggcggccggtggagcgccccagcaggcggcggccgacgatgaggacatggatcctactcaatattatga

SEQ ID NO: 63937 - DNA, 320 bp, Triticum aestivum
  Clone ID: PAT_TA_63937
acgtcggcgtcgcggaagcgtgcttttggcagtggcctgcgtggcgccacgtcttccgcggtcgctacggccgccgcaaccgcatctcgtcgatcgtgtcggaggagatgttctcgagcctgttcctgcacaaggacgacacggcctgcccagccagtggattctacaactactcttccttcgtcagcgcggcggagtggttcccggagttcggcagcggagcccaccacgtcgactgggacacgcgcaagcgcgaggtcgcggccttcctggcgcagatctcccatgagaccaccggcgggtgggcgacagcgcccgac

SEQ ID NO: 63938 - DNA, 312 bp, Triticum aestivum
  Clone ID: PAT_TA_63938
gaagatagggggagagatagatcgatgtttgacgaccatggcgccaagctggtgaagagcctgcggggcgcggcgcagaagtacgtcggcgtcggcttcttcctcggcttcttcctcgtcctcctcacctacttcaccctctccgagcagttcgccatcgccgcgcccaacgctatccgaaggacctcagcggcgcacccgacgccgaccgccccggccgtggcagagaagacggtgcagcagcagcagcagctccccgtcaaaaaggaggaagcacctctgccggagcatgaacaagtacaagagaagcca

SEQ ID NO: 63939 - DNA, 164 bp, Triticum aestivum
  Clone ID: PAT_TA_63939
caaacacggttcctgcttcctcggctcccaccttgagagggtggtcaagcccaatgtgaagctcctggcagagtgcgggctaggtgcttgtgatattgccaagctgttcattcaaataccgatgatcttcaccgccagcccagagcgtgccctggagatggtcg

SEQ ID NO: 63940 - DNA, 305 bp, Triticum aestivum
  unsure (1)..(305): unsure at all n locations
  Clone ID: PAT_TA_63940
ttcccctcctcaggcagctcctgctattgttcgggnccatctccgaggatgtcctctctggggtgctgtctggctgccatgtcttggcgaacttatatctgtcggagattcgtgaggtaggtagcctccgcatttgctcgccaactctcaggatcatcgtcataacttgtttgtttgaaggcaaaggagaattggtcattatggaggcccctcgccttgaaaggttgctgttacgtccgccagtcttaggtagtgagattatccgggttgttaaggcacctaaactggagatgttgggccttttg

SEQ ID NO: 63941 - DNA, 267 bp, Triticum aestivum
  Clone ID: PAT_TA_63941
gtccgacccgcgcagctggggcgtcctcgtcaacagcttcgccatgttggacgaggactacgtatcagccttcatctcgttctaccagccggacgcgcgagcctggctggtgggccctctgtttctcgccgccggcgacgtgccggaccgcgtgggggagcaggaccccgaggggtgcctcgcgtggctcgaccagatggcggagcggtcggagtcggtgatctacgtgtcgttcggcacgcaggcccatatctccgacgagcagct

SEQ ID NO: 63942 - DNA, 289 bp, Triticum aestivum
  Clone ID: PAT_TA_63942
tgggctacgtctccaactacgccttggcgcgcctcccgatccacctcagctggcgcgtcatgctcggcatcggcgccgtcccgtccgccctgctcgcgctcatggtgttcggcatgccggagtcgccccgctggctcgtcatgaaaggacgcctctcggatgccagggccgtgctggccaagacctccgacacgccagaggaggccgtggagcgccttgaccagatcaaggctgccgctggcatcccgagggaccttgacggcgacgtggtcgtcatgcctaagacaaa

SEQ ID NO: 63943 - DNA, 227 bp, Triticum aestivum
  Clone ID: PAT_TA_63943
cgatagcttgggccggcgacagccaacggctcgggcgcgtttttgaccgaggtgggcattaatgacaccatcctccttggctacgactccaaccacgccttcgcgcgcctcaccatgcacctcatctggcgcgtcatgctcggcatcggcgccagcccggacgacctgctcgcgctcatgcagctgggcatgccgaaatggccccgctggctcggcatcaaaggaca

SEQ ID NO: 63944 - DNA, 285 bp, Triticum aestivum
  Clone ID: PAT_TA_63944
tcggtcaccggtcgccgccgggagcccagccgcccaggaggctccccgctcccgcctgtccttcccgcccgcctggacatctgcgccccctgcgagctgcggcgaccctgccctgaacggctgcgcccgtacccctggccgcctggcgcccctacaaagccggtggcagctgcccagtcaccagtccggtggcagcaaatcagtaacctgagaaaataaaaacttagtcatggtaccgtgagctcaccagatctgggccgagcctagaccaggcaccggggtgag

SEQ ID NO: 63945 - DNA, 319 bp, Triticum aestivum
  unsure (1)..(319): unsure at all n locations
  Clone ID: PAT_TA_63945
aaattcttctggggccttggcttcggcgtgccgggcgngattatgctgctcgcgctcctcgttttcctgctcggcaccaggacgtaccggttctacgactccggtggcggcgagggcgacagcgcgttctcgcgcgtcggcaaggccatgaaggcatggcgcaagaggtcgccagagggtgactgcgcagaggacgccgtgctcatggaggaggtgcggggcctggcgaggctgttcccgatatgggcgacgtgtctgctctacggcgtggtgttcgcgcagccgccgacgctgntcacgaagcaggcggcgacgctcg

SEQ ID NO: 63946 - DNA, 358 bp, Triticum aestivum
  Clone ID: PAT_TA_63946
ccaacaaccccgtcgttgccggggacgccggcacctactactccggcacctcatcgtccccgattcgtcccgtggccggggaccagtcgtcggcgcaggaggacggatgggtcatctgcagggtgttcaagaagaagaacatcctcgtgaaccaaggccagaacggcggcggcggagcggcgtccagcaagctggccggcgccgcccccatggagcgcagccagagcaactgctcgtccacggtgaccaccatcagcaaccacatcaaggcggcgcagcagcaggaccagcagcaccagctgctgcactactccgccagcgacgacgcgctcgaccacatcctcaaccactacatgca

SEQ ID NO: 63947 - DNA, 269 bp, Triticum aestivum
  unsure (1)..(269): unsure at all n locations
  Clone ID: PAT_TA_63947
atcaaccaatttttttcccttnccttatattatatattatgaacatgacaagaattgccaaaaactcaacaatgcctgataggccaataaaaaaaggttaatggcctcacacaccagctgctgagatcacaactcgccacactgacacaatcaattggacttattgtcactcactcctgtacttgagaaaactctcgcaacccctcatgacaaacactgaaagaaagccaagaaaaaaaatacacaatcattttaggaatctctacttc

SEQ ID NO: 63948 - DNA, 118 bp, Triticum aestivum
  Clone ID: PAT_TA_63948
gcgctgaccaggcgccaatccgcctcgggccaggacttcccggggtcggggcaccggccggacgaccgcaagacgtggatggcggagctggggccggagcgggtgcgcgtgcaccagg

SEQ ID NO: 63949 - DNA, 280 bp, Triticum aestivum
  Clone ID: PAT_TA_63949
agattctattccaaatctcttcttcccctccttggaggcctttttgagttcacatgtttggatgatgtcttgcagctgtggatcaggttgcagctgtggctcagactgcaagtgcgggatgatgtaccctgatctggaagagcagggcagtaccaccgcccaggtcgccgccgtggtcgtcctcggtgtggcgcctgagaacaaggccgggctgttcgagatgaccgccggcgagtccggtgagggctgcagctgtggcgccaactgcaactgcaacccc

SEQ ID NO: 63950 - DNA, 176 bp, Triticum aestivum
  unsure (1)..(176): unsure at all n locations
  Clone ID: PAT_TA_63950
cggattcgtgggtggacgcgtgggcggacgcgtgggcggacgcgtgggcggacgcgtgggcggacgcgtgggcggacgcgtggccgaagctctaaaccctgaactgttttgcatttgcaatccaagttgttcatttgctaattctgaattcaatattgtgaactggtcatatnctg

SEQ ID NO: 63951 - DNA, 401 bp, Triticum aestivum
  Clone ID: PAT_TA_63951
cggtctcgtggttttaaaaaaaaaaaaaaaaaaaaaaaaaataataaaaaaaaaaaaaaaaaaaaaaaataaataaaagtgagaagatattataagttacatgattcgttatgcatgatttctagggcttttttttttttttgttggttttaattttttttgattggccgatattttataacattttaattgggtggctcctgttttttttaaatttatttttttttgaccactttctcactttgtcattttgtttatattggacaaggttcctattttatcgccttttcttttataatggtactctgatttggatactgggccgtctcccttttttactctttttttcctcattttttttgtttaggttatatataccgttaacttgcctgcgcccgacc

SEQ ID NO: 63952 - DNA, 351 bp, Triticum aestivum
  Clone ID: PAT_TA_63952
gcggttgtcagtttcggcggcgactccaccaccagcaccagctccagcaccaggcgggcgaaccaacccagaccatggcgcccccgacccgcgcgtgcgcatagcagacgtatgcggtgaggacacaggggcgtatgggcatgtcgcgcgcggaggcagtggaatgtttcaagctcggggaaaggcccctagggggagatcgtcagtgccgcccgtggtccgagcgcgcgaagcccgctttcaaggtggtggcgcactagcgattcatccacatcgcgattgttgtgggcctgataaagtccgacccaaagcccatactgtttcagtttctcgaaccgatcggatcgattt

SEQ ID NO: 63953 - DNA, 304 bp, Triticum aestivum
  Clone ID: PAT_TA_63953
cccactcgtccgtccacgcgtccgagcctactactagcaagatatatacctacatagtacaggcatggcccccaccgtgatgggctcgaaggacacctacgacgctcctttccaggggctcaagagcaccgacggtctccccgtcaggcgtcggtccaacggcgctagccttggcagcgtcagcaacggaggaaggatcaggtgcatgcaagtgtggcccatggagggcatcaagaagttcgagaccttgtcttacctgacaccgctcagcacggaggcccttctcaagcaggtagaatacctg

SEQ ID NO: 63954 - DNA, 315 bp, Triticum aestivum
  Clone ID: PAT_TA_63954
gcatgtttggaatgaaggttctcttgcggtggtgaacctgatgtttgctgttcctgtagacaggatccttgggttccttttgctgctcttgcttttgatgtaatggttatcagtgtaatggtaatcaaggcagattgtactttgtggtagctggtgaatttagggctacgttgggtggccggcctgtgttgaccgtttgggatgctttatggtcgtgttggcttcgttttgatcttttcttttctgtttgaactcgtttgtagaactcggtggttttcagtaatgaaaattggaaggggcaagcccttttttgat

SEQ ID NO: 63955 - DNA, 297 bp, Triticum aestivum
  Clone ID: PAT_TA_63955
tcgccctttcgtgcgggcttatcctccccttccggttcgggttctggttcggctctggtccgagagtagctagcctagtctagggtttccgtagagaggaagggagagggagatccattcatggcggagacggagtaccgctgctttatgggcggcctcgcctgggccaccgaccacaacaacctacagtaggccttcagccagtacggcgagatccttgacgccaagatcatcaaccaccgctagacggcgaggtcccgcggcttcgggttcttcacgttgggcatagaggagaca

SEQ ID NO: 63956 - DNA, 220 bp, Triticum aestivum
  Clone ID: PAT_TA_63956
agcttttcgacttttgtatgcatagcgagctcaagcggaacatcgtcgtagtccaaggagctacacgcgaacttgccacaaacgtaaataatattggacggcaatttcgacaattggtggtcccggaccatcaggggcgaagactgggtgactcctatcgaaacgcaaaagaatagcgccaccgggatcgaggatttaagcttctgggccgatgactgcg

SEQ ID NO: 63957 - DNA, 433 bp, Triticum aestivum
  Clone ID: PAT_TA_63957
ggaagaagggcgctccccgtcgattgccaataggattctgtgggtttgctgtcaacagcacaatgctccgggatcctcaaaggtaggaaccgcccaactatggattctgctatagtgcaatctggtggcagaggtggtctgtagcgagtcacgatttgacctgatgtttggtaaaaacgagcgtaaaataaaaagccttacagacaactgatgacggatcatggtctggaacttccccctggaacctccccagctgaaatacccctgtccgatggccactgaggcaccaccttgtacatgaaaagacctgcgacatagagatcctgccaccggaagtcctgtgttccatgcaagacgtttctcttggcgagccatacggaaagatgattaaccttgcggtgacacagaagttactgatataaacttggcgatg

SEQ ID NO: 63958 - DNA, 137 bp, Triticum aestivum
  Clone ID: PAT_TA_63958
aaatttttatgtttttcaaatgaggagtgctaccggggaataaatccaggaagaggtggcggcttgacagggagtttaggacctttttgcttgcattctcgtgtcttttggcaaggagaaaattatcatttggaggg

SEQ ID NO: 63959 - DNA, 361 bp, Triticum aestivum
  Clone ID: PAT_TA_63959
aaaaatttaaaaaattttaaaaacaaaaaataaaaataaaaaaaataaaaaaaaaaaaatgcggggggtttattgaattcagccaccgtcctgcgaggagaacggaaagggctaaactgttctgtcaccacggtccatttatatagtgccattgcggttttgtcaactctgacattgctttgggttttccttcttcatttatctgtgttgcatgctcctatttttatgcgtatgtccatgttgatgtaacgacatgtatcgagaaagcctgctcgaatgctaatgcaatgggtgggtatgtctatgcgcatgcgcatcatatatttatacaatgtgtggggtatgtattcgggtaactaat

SEQ ID NO: 63960 - DNA, 329 bp, Triticum aestivum
  Clone ID: PAT_TA_63960
cggggctgtgcaccgtgcaggtgaaccacggcgtcaccgtggtgggctacggcgagaccagcgccgccggcgacgaggggtccgggaagtactggatcatcaagaactcgtggggggcggggtggggcgaggccggctacatgcgtctgcagcgcgacgccggcatgcccaccgggctgtgcggagtctctctgctcgcgagctacccggtcatgtgattcattctgccaggtcatgtacgtagtaataagtagactcatgcatggagcatttgtgaagtgtaagaagatagcgagtataaaaatacgaatatctatacatcagtgtgt

SEQ ID NO: 63961 - DNA, 159 bp, Triticum aestivum
  Clone ID: PAT_TA_63961
cccattcgtccgggggctgcaagctgcagttgacaggagttgttgtatgcgtcgattaattgtcacttagtcaatcttttcaattatctgtgttttgagattgtactgagtcgaggaggataaggagtaactcttgacattagtgtgaagtattttggc

SEQ ID NO: 63962 - DNA, 384 bp, Triticum aestivum
  Clone ID: PAT_TA_63962
acggagctgtacccgcggttttcggggccgacaccttggcgtgcgacgaggggatgcgccaggcgatcgaggtcatgaacggccaggacctggacgggcgcaacatcaccaggaacgaggcccacacccaccgctcccgaggtagcggtggccgtttcagcggtggaagcggtggcagttacagcggtcatcgctctgagggcagcggcgggggctactgtggcagtagttgtagctacaggggtggccgcctacgtggctgaggagggtacggcagccatgaaggccgctgcggctacggcggatacgcacgccgctacagtggaagacgcgaggcgccggcggtggaaactggagggagagaatggtgggccccctcgctgg

SEQ ID NO: 63963 - DNA, 389 bp, Triticum aestivum
  Clone ID: PAT_TA_63963
gcgccttctacgcggtctcctacaagcctttcttcgacggcgccgtccaggccaaggggcccaacgacgacaccaccaccgaagccacctggtgctgcaccggccgccgctctctcaacctgaggagctacaccccctgcttctaggcattggaggacaacgagggcccggccccggccccgggcaagaccgacgaggcggacgtggagctgcacaggaagaaacggctgctggactacaaggtgtacgacgtggagggcaaggtgaaggggtcggtgcggcgcagagtcaagcggatcaacggaaagtgctcccgacgcacgtctacgggtggtgacgagccggcgatccgtccatgcaggatggtctgcctacgtgtgctgccggta

SEQ ID NO: 63964 - DNA, 224 bp, Triticum aestivum
  Clone ID: PAT_TA_63964
ggcggttacggacgtcctaggggcggagcctggcggagggaggagtcgcgcggaggaagaccacactgacgctgaatcggtattttcaaatttggggtagtttggtcatttcatcaagtttcacctggtcggaaataataccccaacgacaaataaataggaacggagggagtacatccgtatgtttttcgtattaaacaaaaataaacattgctgaaaataca

SEQ ID NO: 63965 - DNA, 413 bp, Triticum aestivum
  Clone ID: PAT_TA_63965
tcgcaaaaccccgattcctgttcgtgtctcctgtcctccccggccgaccccagtagctagcttcgacaatgaacatcttgaaccagcccatcagccccggcggcgcccacgcggccttcccggccgccgccgccgccaaggacggcggcatgccggcgtcgctccgcttcgacgtcggccccagcaccgcccaccgcgccccgaggcggcagacgcagacgctgcttcgggccagcagcagtagctacgtcggcgccgggcacgccgacgaggccgccgtcatcaagagcgcggagcagcagaagggggccgtggtgccgccgttccagccggtgacgctcaacttcctgcgctcgctgctggacagggacagcatgacgtccatcgccgaggagggcggcgagggcgcgggc

SEQ ID NO: 63966 - DNA, 192 bp, Triticum aestivum
  Clone ID: PAT_TA_63966
tcggccatgtttaaacggctggggaaacggctgtggtagactgttttgatgactgatatgaggcgtgatacttgtcttgaaactactgtttgagttactatctgagtcataacctcatggatgatgtaatggatagatgcatcgggcggtggaatagactgtttaatgaattgtgtcgtgaatcatggaatc

SEQ ID NO: 63967 - DNA, 260 bp, Triticum aestivum
  Clone ID: PAT_TA_63967
tcggcgtgtctacccgctgagtttaagcataaaatatcagtgggtgtataatataaatataataaaaaaataacaagttaagctaaaaagattaaaaaatgaaccaacaacatatgcgactgaatggagaccttctttgcccatgaaaatgaaaatttttgcttgctgtaccaaggtgatcggggggtgtggtttataatagtaccatataaactcattgtgctacaacaagaatattgtgtagtgatggtgtaatacac

SEQ ID NO: 63968 - DNA, 296 bp, Triticum aestivum
  Clone ID: PAT_TA_63968
tcgctgctactgaaagtctcacacatcatcacccgcaggccgcaccgccctttagccatgaccgctctcgacttcatgcccgccgagaaggccccccaagccggcaccgtcgccatcgataacaatgccgccggtgccgccgtgccggtgcagcagcagcacaggagactggaggggaaggtggccatcgtcacgggcggggcgcgcgggatcggggaggcgatcgtgcgcgcgttcgtccggcacggcgcgcgcgtggtgatcgccgacatcgacgacgcggccggggaggcgct

SEQ ID NO: 63969 - DNA, 272 bp, Triticum aestivum
  Clone ID: PAT_TA_63969
tcgccgctgtcgacctctgaaactgaaagcgccgtcgagaagatctgcgaggtgtgggtgctggtgagcggcgcccgggatgagctccagaggcaggaggagactgtcctgtacaagcgtccactttttttttttttgagataagtacaaacgtccacgtgagcatatgtgactgtctaaggctggtttaagaagtcttgtacatttgttgtatgttttttttaggatcaaacactccattttattcaaacaccacaagtcgttcaatacat

SEQ ID NO: 63970 - DNA, 263 bp, Triticum aestivum
  Clone ID: PAT_TA_63970
tcgggctattgtgcggagatcgtggggcggctgggctagatcgctgcgcggtacgaggcgatggaccggcgggcgccgtgggaggcactaatgagaaagccgcacgcgggtagctgagaccacgcagcgtacgcggcggcaagggaagcaagactaacgggcgcagggctcgcggagagcgaagtgcgccaatggaggcggtcgttaccgacgcacttaacggactgtcatcactgcagtggccaacggcaccgagactactc

SEQ ID NO: 63971 - DNA, 460 bp, Triticum aestivum
  unsure (1)..(460): unsure at all n locations
  Clone ID: PAT_TA_63971
tcgcacacattcgcggccgagggagcgagcagcgccggccgccccgcggcaccgccggttgctctcgcctcccgctccgcagcaccgccggtagctctcgcctcccgctccgaggcaccgccggtagctctcgcctcacgtcccgcggaaccgccggtagctctcgcctcccgctgatacaatggccaacgccgcggtcgaccccgagcgcaaaaggtcgcggttgacgtcgtccatgtcgtccatgtcgtccgtggacaccattctccgtctcccgccctcgccgctgttgacgtccccgacgcgcgccccggcgggacacgcgctggaggagcctcccgcgcggcacaggccggcgcggagatccaagcccgtgaggattttccagagcatgttccggtctctgccggtcgtgacggtgccgcgctgcggngggattctgacgccagccccgaccggc

SEQ ID NO: 63972 - DNA, 500 bp, Triticum aestivum
  Clone ID: PAT_TA_63972
agaagatgcagcatgtcgatccatcaatagcagctagctattactaactagcaaaacaaatttacaaaggtcgatcaatgaccaagatgcacggccattacgtcgccgtcgccgccaccacctgttccaccacaaggagggcgaggacttccagcccgccgctgacggcggcgtcgacacgtacgggtactcgaccgagacggtggtgaccgccaccggcaacgacggcgagtacgagcggatcaccaaggaggagaagcaccacaagcacaaggagcacctcggcgagatgggcgcagccgcggccggagccttcgccctctacgagaagcacgaggcgaagaaggacccggagcacgcgcacaagcacaagatcgaggaggagggggctgccgccgcagccgtcggcgccggcggcttcgtcttccacgagcaccacgagaagaagcaggaccactaggaggccaaggaggccagcggcgagaagaagcaccaccact

SEQ ID NO: 63973 - DNA, 524 bp, Triticum aestivum
  unsure (1)..(524): unsure at all n locations
  Clone ID: PAT_TA_63973
cccacgcgtccgcccacgcgtccgcccacgcgtccggctgggcgccgcggacgcgcactacgcgagcagcttcagggggagctgcgacgaaaaggtggcggctgtgcggccggtgccgttctccgaggacgcggtggtcttcgaactgcgcgacggccggttggcggagctgcggcgtgcggcggagggtcgcggcgggtgggagtgggcgcggatcatcggcacgcccgccagcgcctgcatgacaagctactggacggccgtcgccacgtagccggcggcgccggtgggaaggaagcgggcggaagcgcggagctggaactctatttcaacggcatacgcgcaagatacgagttgaatgctcaactactttacctacctgattagtcgtggctaacgtacaccttgttataaaaaaaacagaggctacctatgtagtacaaagcacaatagtacgtgatcaagttttcttgtacatctctagcggatcccgtanaccgggccatccgacaaaataactagga

SEQ ID NO: 63974 - DNA, 384 bp, Triticum aestivum
  unsure (1)..(384): unsure at all n locations
  Clone ID: PAT_TA_63974
cccacttgtcncgttttaaaaaaagaaaaaaaataactagagaaaaattagaggagataaaatctaaaatacctgaaaaaagggcaggggttggtttccgagctgaccgtctgaattgttcgtctaggcatgatccgtgtcgtatgtttgggtgattgagaatgcaggctcatatgcttcgcttcggggggtgtgtgtgccacattttaatctgtcatttgcgctcctgggacacgatgtgtgttttggggacttccccaatatgagacatgtggcaggtgcaatcgcctgacttgctaggcaaactctgctcttgccgggagcgcttccctgggcgggcttttctctttttttttaagtgtcgaagttcaaaagggccccccc

SEQ ID NO: 63975 - DNA, 417 bp, Triticum aestivum
  Clone ID: PAT_TA_63975
tcgcagagttatagcacatctcctcgtgaggaattaggagggaagatggcgtcgccaatccaagctcgtctgcgcctgggcagcatctccacgccatgggacggatgatggccgtcgccaacgccggccgccgtgccgtcgagctgcatcaggagaagcgacgtctgagccgccgtcgtgccaatggtgtggcggagagaactgcgctccgcatgcgcgttggccgaatatgatgccggcctgcgtggcggaccgtggtgctcctacggagggaggagcgatgctgacgctatgtggtcgtcgtcgttgtacacagccgtgcctgcggaagccgtgggtgccgcctcaacacatccgcatgcagggagaaaaggtatgaggagatgggacaaacggacgatgtacaggatccaagct

SEQ ID NO: 63976 - DNA, 100 bp, Triticum aestivum
  Clone ID: PAT_TA_63976
tcggcagaattcaaaatgtgtactcccactattgccaaatgcagtacatgtaagaacattacgatgtattttcagacgaacacggttttgttccactctc

SEQ ID NO: 63977 - DNA, 504 bp, Triticum aestivum
  unsure (1)..(504): unsure at all n locations
  Clone ID: PAT_TA_63977
tcgcccactcgtccgactagccactagaagcactaaagaagcagagggtgtcaagcatggcgtccaagggtcttcttgtgtttgctctcctgcttgctgcatctatcctcgtcgcctcaactgaacaaactcaggccaagaaggaggagaagaaagccggcgtagagggctaccctggaggcggcgggggaggctacccagaccacgctggaggaggaggaggcggcggctaccctggacacggtggaggaggaggaggcggcggctaccctggacacggtggaggaggtggcggcggctaccctggacacggtggaggaggaggcggtgggtacccgggtcacggtggaggaggcggcggcggctacccgggccacggtggtggcggcggtggcggctacccaggcggtggcggcggcggctaccccggacatggcggtggcggcggcggtggctaccccggacaccgctgangcggaggccgcagtggatgtcactggggct

SEQ ID NO: 63978 - DNA, 298 bp, Triticum aestivum
  Clone ID: PAT_TA_63978
tttttataaacaaaaaaaaaaaaaaaaaaaaaaaggaaaatattataaagaaaaaataaaaaggaacgacccgaaaaaagggggccgggtttcttgcggggtcaccgaaccttagcgcgctggcgcttgggttaccaaccttttgtcggggggccccctgacttacaccgcggtcactgggaacaccctgattcccctaatttcggggtttccacacttatctggttgggacccatggcccttttcccaggggcgcgttctgaccgccgttccgtacgccccccttttctgaacgtta

SEQ ID NO: 63979 - DNA, 400 bp, Triticum aestivum
  Clone ID: PAT_TA_63979
cttacgcgtgggcggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggcggcggctacagcggccagcgcgtcggtggcggaggctacggcggaggaggacgctacggtggccgcggcagctaccgatgcgagcggaggctactgatgtagtggcggctacggcggccagcccggcggcggccagcggccactccggcggtcagtggaggaactgagactagaatttcccagttatcgactatttacccgtgcgtcgctatcgacgcatggttcttcagcaa

SEQ ID NO: 63980 - DNA, 373 bp, Triticum aestivum
  Clone ID: PAT_TA_63980
cccacgcgtccgcccacgcgtccgcccacgcgtccgcccacgcgtccggggaaggggccgttcgagaacctgcagcagcacctggccgacccatggcacaacaccatcatccagaccatctccggccaataaatccgtcgatttcaccgaccggggaggtttcaggcggtctgaattgttattttggggtgctgaggatgtacaaagtgtggaggagtaggtggacagtgcaaaaatgtgttgtaatcttaaagctccggtggtgaaactttgttcttgtggattcgcccatggcttctaatggaggctgtacttgtaatatcacccatgcgtgttattttaaacatggcaaaacatactactagtttgaagc

SEQ ID NO: 63981 - DNA, 490 bp, Triticum aestivum
  unsure (1)..(490): unsure at all n locations
  Clone ID: PAT_TA_63981
cccacgcgttttgttttttgctggaaccgggacacggatagctgctaccagcgatttttttgcttcaacggagatgagacccagagagtttttttgctggaatgaaatttcttcatgaggtgcggtggcgaggcatttttttttgtgctgtaatttgtgctttttgctggaaccatgttttgattttgctacaacgagcatttgattttgctggaaccgcctgaagcagatttgggaccagtttttttagtaactgatttttgctgcaaccatccaaccggcgagcgggcccggccggtgagctgctccggcgagcggcgacggcgagccggtgagcgggtccggcgagccggcgagcagcggccaccgagctgcaatcgtcgctacatggagctagaaccgcagggtcacgttgctggcgcgaaacgcaggaggcgacgtcggcgaccggtgacgacgacngcgacgggcggcgagggcagcgacaggg

SEQ ID NO: 63982 - DNA, 230 bp, Triticum aestivum
  Clone ID: PAT_TA_63982
cccacgcgtcctcccacgcgtccggagaggctgacgcctcgttggtcgtgttgttccactctgtggttgtatttgcttgtctgtaacatgatggatgaactgggctctgcataagagaggagggtgcttgctgttgctgcctctgccctcccttattgaatcatgttgtatctgaacttcagattcagaagcctgtaataattgtcatgttgtaatgctgttgctgcctc

SEQ ID NO: 63983 - DNA, 326 bp, Triticum aestivum
  Clone ID: PAT_TA_63983
ccttcgcgtctttaaaaaaaaaaaaaaaaaaaaaaaaaaaagaaaaaaataaaaaaaaaaataatgctaataaaataatcataaaaaaaataaagaacgaacaaatgaaaaaaaaatggtcctttctagccattgtattatattaaaaaaaggggggggcgctttttaaaggaccaaggtttccttccctgggttggcgaactattgtttttttattggggcccctaaatttaattacctggggctggttttacaaacggctgaactggaaaaaccttgggattacccaaataaataggttgggaaagaatccccttttcacaacg

SEQ ID NO: 63984 - DNA, 462 bp, Triticum aestivum
  Clone ID: PAT_TA_63984
gttctacagagaaaatgagaaaatgagctgtgtgcgtcctgattacatgtccagtcaagaagacataaatgaaaaaatgagaagcagtgggtcgactccggtaacactgatgaagaactgataaaaagagaggagaaaaggataagagaattctttgagttccttgatgatgctgaatttttggagaatatgcgctgcaaacgtcttaattatccacggaaacatgaaatacatctccagtcggatgaagaaattgcccctgattcagatgaagagtgaagatgtccctgcctattatcacctgttttcatttatcagtagattgaactcagtggagctttcgagtatttgaacttgttaccaagttaaacactcgacttaatcttagctattatgacgtttgtgtgtaatgtcatatgtgaacaaggctggaaggcttctccaatttcttttgtgttgctt

SEQ ID NO: 63985 - DNA, 399 bp, Triticum aestivum
  unsure (1)..(399): unsure at all n locations
  Clone ID: PAT_TA_63985
tttttatgaaaccgcacntttgntcctcattncngaggcncctccatcngcatctccatttccatctccatgggtgggttcacccaacaatccgactaacgacaacatcggcagcgacggcagggtcatgtcgcggtatgagcgccatgttcaggccaacaacgctcgctgtcctttcttggtgggggcctaatcccatccacgacggtgctcttgctcttgtggtctgagaagctgacgaggagcttcgccattgctatcccatctagtaccaaccatgtatctatcttatctatctatatttctaggtgatcctgtggacatatatatgtgggattgatccgcctaccctgatgctattgttgcgcaccgatgaagcaatgtcattgtgagactgat

SEQ ID NO: 63986 - DNA, 237 bp, Triticum aestivum
  Clone ID: PAT_TA_63986
tggggttctctttagggatgcttcttttatatcaataaaaccgcgggtgctagtgcccatggagtttcatttttgaggacgtgggcatagcccagtagttgggggcgcatgattgtaaacctaacgaccagagttcgatccacgtcggggacgaatttctggaattctcatgagggatgcttcttctatatcaataaaaccgtgggtgctagtgcccatggagtttcattttttttt

SEQ ID NO: 63987 - DNA, 453 bp, Triticum aestivum
  unsure (1)..(453): unsure at all n locations
  Clone ID: PAT_TA_63987
gccgctggaccgacccgaatgcccgggcgacccacgcgccgggtgcgagggcnacggagtggcgcagccgggggaggcggcggggnacgggggcacgacaggggcgggcccggaccagagcggcgggaagacgaagaagaaggggatggggatggcgggcgggctggcggtgggcgcggcggcgggcgtgctgggcgggctggcgctggcgggcggggcgagctacgtggagcacaagatcgaggaccacgtgacggagcgcgtggaggaggacatgtaccgcggcggcggcggtgggtacgacgactacggcggcgacgacgactactagaccaaccatgggtccgtcgttccggtggccatgcacgaaagaatctttctttatgttttctgcgcgcggaagatgccgagggtgagggtgaaccaccggaccggagaggtgagaagaagaga

SEQ ID NO: 63988 - DNA, 263 bp, Triticum aestivum
  Clone ID: PAT_TA_63988
ccccccagccaggctgacccggcacagcttaacacctagcagagctgcgtagctgttcctcgggaggtgcacttgcttcgacgccggcgagctccgcatgccgcaggtgatgtctctcaagagcataagatggcagagcggggcgtcctcctgttcctcctcgaacacgctcagcatccgctgcagcagcacgggggccggcgccgtcacgcgcatcggaagacggctagctccgcctgggcggcgcggtcatcacagccacc

SEQ ID NO: 63989 - DNA, 486 bp, Triticum aestivum
  Clone ID: PAT_TA_63989
ggttttcacggtggagcagttctgcgacgactccggcgaagacccggcatgcagcaggtccctccctctctctccccgcaccaccatcccccctgaattgtaccactacgtgcctcatggtacccgctcttggttaacattgttcgccgccttctcaggtctgtgagcggcaacagcattcaagaccacataacctacctgggcgtgagcatgcacgctgaggcctggagcagctgcaggatcgtcatggactacgccgagctgcggtacaagatggacctccatggaaacgtcgtcttgtcgaagcagcaccagcagcccggtctgtcggacgagcgaagaagacacagcgcccagtgaaaccaatgtaaacaagttctgtatcatcatagtagcaccacgcacgcaacttgtcattcccctctctgcttcattggttctgcatccagagaggggataacacaaccacgctcgacaggaaaatgc

SEQ ID NO: 63990 - DNA, 417 bp, Triticum aestivum
  Clone ID: PAT_TA_63990
aggggggccctatttcccccgcccggccagaccggagcacgcgcagagcattctagtcattctgggcctgccaggtggtgctcatgggcgccgtggagggctaccgcgtcgccggcggtccgctcggcgagatcgtggacccgctctaccccggcggcagcttcgaccccctgggccttgccgtggaccccgaggcgttcgcggagctcaaggtgaaggagatcaagaacggtcgcctcgccacgttctccatgttcggctttttcgtgcaggccattttcaccggtaaggggcccctggagaaccttttcgttcacctcgtcgaccccagtaacaacaacgactgggcctttttcaccaactttttttcctggcaagtgagctgcggtcagttaaacctctaggccgacaacttca

SEQ ID NO: 63991 - DNA, 471 bp, Triticum aestivum
  unsure (1)..(471): unsure at all n locations
  Clone ID: PAT_TA_63991
gagatgcatgttcaagtgcgcttcctgctgctacatatatgactgctagtacatgtatatttacaagggcatatctgattatttgctggttgaggaacttcaaatggaagtatgtaaaactacaattatgttcttattcctaatgcattagaacagatctgattgctttatcaatgagtgcataaattgtcatttcctaagattgctcaaacatacgagttcttttgcagggacaaaaggaggaaagtagcaagttcacaagttgatctaagatgttccggtgactgcttttggtcataacatggttgtcacattttgttcatatggaagttgatctcagcttgnggatagaagacttggtctcttccataatttcttctggtggtgatcgaacatttagtctcttaggacttggccatcatattttattagaggacatgactcgaatgtgacttatgtatttcctaatgc

SEQ ID NO: 63992 - DNA, 569 bp, Triticum aestivum
  Clone ID: PAT_TA_63992
ccggcgctgtttatggcggcgaagcagccgttggcggacgtggaggacgggctcctcgcccacctcaacgcgaacgccgagatccccgactcccgctacttcgcctcctccctcggcgtcccgcacaaggacgtggaggatgtcatcaagaggctctccgccttccgcatcgttgagagtgcggacatcaccaaggagacgtggatgctcaccgatgaggccaaggggtatgccgcgaggggctcccccgaggtgcagctcgtcgcggccatcccgcccgagggtgcctccaagggcgcgctcaaggagagattgggggacgcgttcgatattggaatgaaggcagcagccaagaacaagtggattggattcgagaagggaaacaaagacctcgtactgagaaaggttgaggataccaaggatgaattgcaagagcagcttaaaagactggagaactgggaggttttcgctgacaaagtatagatgatttgaagagaagaaagcttgtacaaaagagaatctatttgtttcactgagaaggggctgatttgtgcaagagaaaacattgc

SEQ ID NO: 63993 - DNA, 130 bp, Triticum aestivum
  unsure (1)..(130): unsure at all n locations
  Clone ID: PAT_TA_63993
cagggactggaccggaatgcccgggttttccacgcgcccgcctttgcttccgcccacgcgaccggtccgggggagagcactttcacccccangcaccggaaggacagccagaaggggaacgcgaaaagac

SEQ ID NO: 63994 - DNA, 188 bp, Triticum aestivum
  Clone ID: PAT_TA_63994
gggggccaggtccaccagcggagccggctgccaaagcagtaacagctgcggcgaacgacagatggttcccaacggggctgccgccgccggcacgatcgccaagaggatgctcaccgactgccacatcgagagcgtgcgcagggttactgaccgcccggggagaccggcggatcagactgtacatcctg

SEQ ID NO: 63995 - DNA, 286 bp, Triticum aestivum
  Clone ID: PAT_TA_63995
agaaagtttcgcaagagagagcaatgaaaaccaagggactcttctgttatataccccttgttgcaggatggcaagttgtaggatgtacgtgtaaacctgattgtactctcctgtctaaactacatccataatggtcttattgcatattccctctgctccttctatattcctgtgtaaggaaatgtattcctgagatgatttgttatgtaaacctgatgtgatgcgatggatgatttgaatttcatatgtagttttcttgattttaatatgaaataatgttggatgt

SEQ ID NO: 63996 - DNA, 221 bp, Triticum aestivum
  unsure (1)..(221): unsure at all n locations
  Clone ID: PAT_TA_63996
ccctttttagctgggaagcctcttgttataataacctaactaacaagnnntatgatctcgcattgcatattgcttgatcaacacatgccatgacctggctattgtatttgttatattacaatggatagtcttggcttgcttttggactaaagcctttcggactatgtatagcttgattttggactgaaaaaaaaaaaaaaaaaagatgaagagaccataat

SEQ ID NO: 63997 - DNA, 365 bp, Triticum aestivum
  Clone ID: PAT_TA_63997
ccttactctgccgcgaggggctcgttagagagtaagaaagaagctcgccggagtccgagaaggggagggagagggaggatgctaaactgggggccggtggcgatcacggtgccactggccgagctgctcgcgcccgggcctccggtgagactccccggttagcacgagtggggacaggtcgtcaaccagaacaccatggccacgcccttcctgagtcaacaccatccactacttggatgacacagggctctgcgatatcgtcatcgtggtgcacatcaccaccgactataaaccggttgagctccatcaacttcgtccgccagcttcaatcaaagtgctgtagcacttatacctttttctttttt

SEQ ID NO: 63998 - DNA, 308 bp, Triticum aestivum
  Clone ID: PAT_TA_63998
agtatcgactcaaatggaaatattgtgttggtcttacagttcattggttccatgcgacacaaagataccccctgcaggctggagcatctatgaactttctgtgaactgatgagaggaaggacatttttgtgttacttcggcccaaatagaaattgctccattattgagacaggcgctacaatgtaacagcagggttttcataacactatagcgaacatgtttacatactacatatgtttaaagatgcttgtagtttgtgattttttgaaacatctctgaaatctgtatacatttcagtttaatgctcc

SEQ ID NO: 63999 - DNA, 424 bp, Triticum aestivum
  Clone ID: PAT_TA_63999
tctccacgctacgctatccggaaccttccggaaggttgctttgccaccctcccttccgttccgtccaacggtgtcgtcgggacagatctgcgctgtcggcggcggcgacggcgccatgggcgagcaggccgcggccgtttcctcctgcgagacgcctgctccggcggaggtggggacaggggtcgggcagaggtcgctgcccacgccgttcttgaacaagacgtaccagctggtggatgacccggcggtcgacgatgtcatctcgtggagcgaggacgggtcggcgttcatcgtgtggcgccccgccgagttcgcgcgcgaccttctccccaagtacttcaagcacaataacttcttcagcttcgtgcgccagctcaacacctacggatttaggaagatggtgccggacaggtgggagttcgcc

SEQ ID NO: 64000 - DNA, 299 bp, Triticum aestivum
  Clone ID: PAT_TA_64000
gggcgagcgagcccgcctccgtgcgtggagggcaaaatgggcaatgcctgtgttacgattctttcatttatttttcattttttatactagcttcttggtggggtgtgtaccaggttcgttgtcaattgaatgtgtacatttctatctttttgagctatcgatgaataacttgttttcggatggcatatttcctttttcttttttggccaaggtcaaaaaaaaaaaatataaataaaaaaaaataaaataaataaaaaaaaatactataataataacctacaaatttattataatataac

SEQ ID NO: 64001 - DNA, 339 bp, Triticum aestivum
  Clone ID: PAT_TA_64001
tcatgggagaaggtggtgtataggggaatccttgcgggagagctctggctagcctagccttttacaggcccatgagaagccaacaacacattctttcagtgacatactactccctcctaagcgtgctgctctttcgtgacgtgtacctacgaacaagcttcttcatctgcagaacattccgtgtgcctgttaaaacaggaataaaaatgaataacctggttgtggagcgaataaaatgatttccgagaaaaaaaaaaaatcacaagacctacctacacttataaaaaaaagcgaatgcgactagagagttatcaccaagagaagtgtttcacaattttt

SEQ ID NO: 64002 - DNA, 376 bp, Triticum aestivum
  Clone ID: PAT_TA_64002
ccaccacaccggagaggggggaattttagcgtttatgtcggggcgcggcaagggaggcaagggtctgggcaagggcggcgccaagcgccaccggaaggtcctccgggacaacatccagggtatcaccaagccggcgatccgtcgtttggcgcgtcgtggcggcgtgaagcgcatctcggggctcatctacgaggagacccgcggtgtgctcaagatctttctcgagaacgttattcgtgacgccgttacctacaccgagcacgcccgccgcaagaccgttaccgccatggacgtcgtctacgcacttaagcgccagggacgcaccctctaccgattcggaggctaggtcaccaccaccagattagagtgtctgggg

SEQ ID NO: 64003 - DNA, 369 bp, Triticum aestivum
  Clone ID: PAT_TA_64003
ggggccgttctgattctccaccaggacgggacccccatcactgctgagaagatcgcgacggtggtgaaggctgccggaatcaatgtcgaggcctactggcccgcgctcttcgccaagctcctggagaagaggagcgtccatgacctcatcctttccgtcggatctggtggaggcggtgctccagctgctgctgctgctgccccggctgctggtggagctgctgccgctgcagagaagaaagaacagaaaaaggatgaggcttatgaagagagcgatgatgacatgggctctagcttgttcgactaagcagttcagattccgttctcctgtggaatcttctatgcttaggattactcatcttatgtgctt

SEQ ID NO: 64004 - DNA, 173 bp, Triticum aestivum
  Clone ID: PAT_TA_64004
caggcacccggtggtgttttctggggtcctttcgaacgactgcgcggtcgaccaaacagacaagcacagtatctgcgaagactcattcgagtcggcaacctatgttagtatatcggatatggccatgaatggggctcgattgggctgctccaagcgacagctgtaggtcctgg

SEQ ID NO: 64005 - DNA, 115 bp, Triticum aestivum
  Clone ID: PAT_TA_64005
ggggcggcagggagcggttgacggactgttctgtgtcatgggatccaccacaatggggacttaagcccccctggcaagaaacttagccaccaccggggggtccccgctggggttg

SEQ ID NO: 64006 - DNA, 255 bp, Triticum aestivum
  Clone ID: PAT_TA_64006
caaggggggttgtggcgcaagcattatggctggtgcttgtcttcgaggtgcgatccgcggatacgctgagcctggagcctgcagcaccgcgtcagtgccaccgggtgctggtattaacagacactgccaaccacgctggatttctgaacaaaaaaaaaaagctgggcagcggttttagatggatccacgctccgataggcttgcatcgccatgcactccgtctgctctagcgcccggtgggtctgttttagtgac

SEQ ID NO: 64007 - DNA, 113 bp, Triticum aestivum
  Clone ID: PAT_TA_64007
agagaaacttgaaatccctctcttgcttgtcgtgacactcagagaatagtgaaaccatttgatatcctcattagtcagctttcattttcttgaattgcatgtttgtaatctac

SEQ ID NO: 64008 - DNA, 246 bp, Triticum aestivum
  Clone ID: PAT_TA_64008
ttaggtcctatttggttcggttgtgtggatttttaaaagcagctgcgaaaaagttgctgcgaaaaacagctgtggaaaatctcatgtgaaaaagatgtaggtcatttggcaaactagctgatatagctttttcaaattttggcctgcagcggaatcattttagaaagcacgtcctgggttgcttccgcttttggttcagattttgacagcggatttctgaaatcggattctgttgggtttgacctt

SEQ ID NO: 64009 - DNA, 425 bp, Triticum aestivum
  Clone ID: PAT_TA_64009
cacaacttagtttctgggacgcttttgatattatcatggactcgtggtgaagattgtgttttgcaatttgagtcattttgttaccttttagtcgaatatgtattctgcactttgacatttgaattctttcaggtgcttagataaggctgctgtagtcttaggggaccaagagataaagtgatgcggagcatccttccatcatccccatggactctacagcaacacatccaacccctcaaggacctatgactcgagcacgtgcaagagctcttgaaaccgaggtgacatcactcctctcacaattccctttcgattcacatgagacatggttactacctcaaatggaaacgctatgcatactcaggtaccaaggagttcaccgtgaagaagctaggaagcaaggagaaccggaagcggaagacatg

SEQ ID NO: 64010 - DNA, 528 bp, Triticum aestivum
  unsure (1)..(528): unsure at all n locations
  Clone ID: PAT_TA_64010
gggatatatccatggcgctcttggctgcaaggatcgtcgtcgtcgtgagcggccttgtcatgatgatgatgatgatggcatgtctcctggcgccagcgggcgctgacgagtgcatggacttgtgccttcatgattgcgccgtcaaggggaagaacttgacccaggagcaatgccagtacgcatgcaattacggctgcccctttggcgccgcccagcacgctctatcgaatgcccccgccattgccaggaatggcgggaagaccgtccatgtcctcatccatgtcctcgcagcaacgatgtggctctagctagcagctgctccttcatcgcccgctccagcatcggcaccaatctggagctcctccatcggcgtcaaaggccatcaaagcagcaagcaagcgtcaagatgttatagcggataatacacgtatgctatgttgcatgtatgtatgtgcttatgtatctttatttatcaagcgtgaagatgctgttatatcggatatataatatacttatgctatnttttgc

SEQ ID NO: 64011 - DNA, 279 bp, Triticum aestivum
  Clone ID: PAT_TA_64011
ggactgcatcctctccgggggcacttttacatatcacactgctcgtccttgcctccgaacaattacatctacagaccaccggatatgtgcgcgcgccgccggttaccgagcgccggccatgttggtgcatggcgggtacacggagcacttcgtgggcagggggtccagtcttgcccgacgcgttttaagcgccacccgccgccttctccgtcaccgacttcgctacggagtcagagccttctctctcctccttctcatcgggcaggaagacgcgccccg

SEQ ID NO: 64012 - DNA, 420 bp, Triticum aestivum
  Clone ID: PAT_TA_64012
caacctcaccgacttcggggtcgcctacgccgttcgccgcgtcgtcagggcagccgcggagggcatcgcgcggtgcccgggctgcaagaccagcctcatcaccttcctgcggacctactcgcccgaccacttcgagcagggctcgtggttcgacggcggctactgcaacaggacggcgccgctgcaggagcgggaggtgagcatggagagcatcgcgtgggagctgaggagggtgcagagggaggagatgaggcgggtgagggcgaccaagaggaggttcggggtgctggacgtgaccaaggccatgatgatgcgcgccgaccgccaccccgacaatcacttcgacagcaggtggaggaggaacggcagcgactgtttgcactggtgcctgccggggcccgtcgacatgtggaacggcgt

SEQ ID NO: 64013 - DNA, 219 bp, Triticum aestivum
  Clone ID: PAT_TA_64013
aactcccaaaccgcaatggcaaaacgcctagccgaaaaagcatcctgctgctggtcctgctcgatgcggcgacccttttagagctccatgggaagcacggtgctggtagcgccgtaagagatatgaagggtgcgacgcaagaccactggttggcggcaccttttgaaagcgggggtactggcaaaacctggcgggaccccaacatagtgtattgggggg

SEQ ID NO: 64014 - DNA, 143 bp, Triticum aestivum
  Clone ID: PAT_TA_64014
aaaaacggggaagacaaaaagaaaaaaaaacgcgtgcccacatggctggggcggcctacatggtggcacccccggggctttcccgggcggcgcaccaccgagggccttgatggggcaaccttgaacgagccgtacttaatctg

SEQ ID NO: 64015 - DNA, 211 bp, Triticum aestivum
  Clone ID: PAT_TA_64015
atgcgcggacgtgatgccacgtaatgggtctcctatagtgaaacctaaatcaattaatggacggctttacaacgaagcgactgcgaaaaccatggtgttacccaagtaaaacatcttgctgcacatacctgtttggtcagctggcggaatagctaagagggccgtaccgatcggccttccaaacagattggcaaactgaacggggaatggt

SEQ ID NO: 64016 - DNA, 150 bp, Triticum aestivum
  Clone ID: PAT_TA_64016
gtgcagacctacggcatcagcagcgatttccatgaagcgctggatgtccgacacccggatgacgtcgtggtaggaggagcggcggatctggatggtgtggtggccgcggtgcgcgtgcgcgaggcacagcgagcagagcgccgacgcgcc

SEQ ID NO: 64017 - DNA, 345 bp, Triticum aestivum
  unsure (1)..(345): unsure at all n locations
  Clone ID: PAT_TA_64017
ctatcgcagaggttcatgttcgaggagggttgatactaccactgctgttgctcgatccccttgcccgaggtggctcagacggagtgagctccgtgtgtttcaacataatgcagtattcagtcttgacgcagtatcttatgccctcgggatcagtacgtggtcttgtttgccctcatggaatttgtagttttggccggatgtctttgctcgtgttgctgtggacattgtgcacggtaatgagtggtagcatccctagccacgggttgtattggcttagtgcccctgttgatttctgaatctgaactgttggttgccactttgcttcatcttctctctatccgnttt

SEQ ID NO: 64018 - DNA, 485 bp, Triticum aestivum
  unsure (1)..(485): unsure at all n locations
  Clone ID: PAT_TA_64018
aactaccattgggccaacattcccaacaaccattctttcagcctcaggaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgcaacaagaacaacaacaaggcgtgccgatcctgcggncactatttcagctcgcccagggtctgggtatcatccaacctcaacaaccagctcaattggaggggatc

SEQ ID NO: 64019 - DNA, 361 bp, Triticum aestivum
  Clone ID: PAT_TA_64019
aaggacggcgggtgcgaccagttacttttccgacgggaagcttgtgaccgagttctccgcgcccaactactgcggcaagtgtggcaacgacgggagccgtcatgaccgtcgccggtgacctcgcctgctccttccgcgtcctccaccctgatgatactgccgctcctcctccggctcctatttatctgtagtccaacatatatatatattcattttagtttcagacgccttgccatggagtagtaatctccagctcgtcgtgtcttcggtttattaagagtgaatttcagtttttgaatgtattgcaggtttttgtcccatttagctaaagttttactaccagatttattttaccacattt

SEQ ID NO: 64020 - DNA, 404 bp, Triticum aestivum
  Clone ID: PAT_TA_64020
caagatcaaaagcattatctttgtttttcgcattggtgtctccaaaactacgaacaacccaagtttcctttgaatcagcacttgaacaaattgtggagctagcgaattcaagatcaaccatgctctctagcttctcacagataaagcgcagatcatgaatcgattgcctgatttgaggttctgtacccttgcacaccatctattctctttgtggagtatcagttatatgcaatcgacagcgctcgtagaaaatatcataatcctatttgaaatgttgatgcacgtggagatgtatgagagttgtgttttgcgtttcattatcttgctgttgaggcaagcactatgtctgcatattgacggtttcctttggggaaatcaacggggaaacttgttcttctgaaaaa

SEQ ID NO: 64021 - DNA, 494 bp, Triticum aestivum
  unsure (1)..(494): unsure at all n locations
  Clone ID: PAT_TA_64021
gaaggacaaggaacacgccaaagaggcctaaccggcgaaggaaaagaaggacaagaaggagaagaaagaaaagagcaaggagaagaaagaagaaggtcggagaggtaactgacacggccaagctgagggcaaagctagagaagatcgatgtgaaaatcgatgacctgaaggcgaagaagcaggagattgtggctcgactcctcgagctcgagggtaaggcagcagaggctgcagcaccagcgagcggctgaggtttcgacaggttgttgccttgagaagaatgaaacagctttcaggcaatgcatgcagctagtgacatcttattattgttctttcgattggcatattattgtgctttaatcttcctggagctacatatttgcatccagcattgcatgatcatctagatttggtgcacacaagtgtccaccttgtatcgaatcccggggtaactgtggcatgaatgtacctcttaaagatccacntttaattaa

SEQ ID NO: 64022 - DNA, 507 bp, Triticum aestivum
  Clone ID: PAT_TA_64022
tggatgagacgtgctggagcgactatgttttctgcaaggagactggcaacatgtactgctgctcgaagataatggcggagatcacggcgaaggaggaggcggccaacagggggctggacctggcagtggtggtgccgtcgatgacgatcggccccgcgctgcagcagaagctcaatctgggcatcgcctttatcaaccgctacctcacgggcgccaagaagacctgccccaacgccgtggccggctacaccgacgtccgcgacgtcgcccgcgcccacgtcgtcgtctacgagcgcccggacgcacgcggcaggtacctctgcatgggcgccgtgctgcaccgtgcccatttcctccagctgctccgagaccttttcccgcagtaccccatcaccgacaagcgtgaagatgacggcaagccgatggccaagccgtacaggttctccaccagaggctgagggacctcgggttggagttcactcccctcaagagagtttgtacgacatg

SEQ ID NO: 64023 - DNA, 132 bp, Triticum aestivum
  Clone ID: PAT_TA_64023
tgaaaaccaccactagtttgtgcccatggttaccttctccaacgaggagcttctgcaggcgcacaccgagctctaggacctcaccttccatgtatgacgcactgatgtttactaaataggctggaatttttt

SEQ ID NO: 64024 - DNA, 331 bp, Triticum aestivum
  Clone ID: PAT_TA_64024
atctctctctctctctctctctggtctcttctttatctttatcggtctctccatctccctgtggagggatggatcatactgctctgcgtttcagttggagattaaacggatatttggggcttctctctattgcatgcatgctgacgttctcgtgcatgggacatcttagctattatatcgaggcatctagagctgatatcctgtccgaacttttacaagcactgcgtgcttaataaccttgacgttacccaagtttataggggctggctacatccacttttatctggtgtcgtaatatatagggggcacgtaccagatcgcgttcccaaca

SEQ ID NO: 64025 - DNA, 220 bp, Triticum aestivum
  Clone ID: PAT_TA_64025
cgttaattgtgaaacaatacagatatttatttacatgtggagtacttacctatcagcgcccttgctaaacagtaatatcctcccctctggctctggttccttcacttattacagacatccgtcttcgtgagctactgaattccaagacatttaggagctcatattttctgtaagaggatgctaaaggtcaaatttacgtaataaacaatatcctttaatg

SEQ ID NO: 64026 - DNA, 534 bp, Triticum aestivum
  Clone ID: PAT_TA_64026
acctctgcgaccgcgatagctagagtggaagagtagatcgacgggcatggcgatatgaggaaggaggtcctcctggcggccatgatgctggcgctggtggtggcggcgccgggcggggcgcgtgccgcgtgcgtggtggggcagctgacggtgtgcatgccggcgatcaccaccggtgccaagccgagcggcgcgtgctgcgccaacctgcgcgcgcagcaggcgtgcttctgccagtacgccaaggacccctccctcggcgcctacatccgcagcccccacgcgcgcgagaccctcgtcacctgcggcctcgccgtcccgcacagctaggcgccaggccgcctagcgagtatgtatggctcagctatagctgcctccgccgtccatcagatgagagatgagactatagctagcctagctggtgagtgcgcgatgcgttcatgccgcatgcatccatgttcctgttcgatggatgatgatggaataaaataaaagatgttggggatgatgctggataaaatgaccgacttgtgt

SEQ ID NO: 64027 - DNA, 330 bp, Triticum aestivum
  Clone ID: PAT_TA_64027
tcctctcaggtccaacgcgcgcaactcgtcagaaatggagacgacttccgataccccacgctccgtcgtccgagcagacggccacggcggcggcgggggccatgttctcctcctcgccttcccggcggcgcagggccacctcaaccccatgctgcagctcggccgtcgcctcgcctaccacggcctccgccccacgctagtcaccacgcgccacctcctcgccaccgtcccgccccctttgccccccttccgcgtcgccgccatctccgacggtttcgatgaaggcggcatggctgcgtgcccggacttccgggagtacgggcgccggct

SEQ ID NO: 64028 - DNA, 447 bp, Triticum aestivum
  unsure (1)..(447): unsure at all n locations
  Clone ID: PAT_TA_64028
cacactgcgcgagagccgacgccggtcttagtctgagagaagagggcaagaggccatggcgagcgagcgcaatggcgacggcggcaaggagcgcgccgggggagaacggcaacggcggcggcggcggagtgtccttggagatgccggagatcaggtacaccaggctcttcatcaacggggccttcgtcgacgccgtctccggtaagacattcgagacgagggatccgcgcaccggggacgtgatcgccagcatcgctgaaggcgacaaggaggatgtggacctggcggtcaaagcggcaagagaagccttcgatcatggcaaatggcctcgcatgcccggatccgaaagggggcggatcatgatgaagtacgcggacctggtggagcagcacgcggaggagctgaccctgctggagagcctggacngccgcaagccgcgcatggcga

SEQ ID NO: 64029 - DNA, 462 bp, Triticum aestivum
  Clone ID: PAT_TA_64029
ctgccacgccccaccccggcttaccgttctaccggcagccgccgctgcgcgcccctccggcacgcctacccctaccccaagtgcccccacacccgcgagctttcaccgccggtgacccgacccaattcgctcgggtgttggaggcactgacagcacaagcagcttccatgaagctgcgcggccacccctagcccccttcacctccttcctcccacttgcacacatgagaaggaattggatcagagtcggtccctcaatctaaaccaagaggagtgcccattgaacatgatggtgtgcagatcgcggagagttgcatcggcaagcgtcgactcatatcttgaagtgccatggaggaaagcttgtgaggatgcaggggccgttggtggtgttggacttatcgtaggttgaaccacatcttgcttttctttggtcaatctgctctcttgtctctctgagtcataa

SEQ ID NO: 64030 - DNA, 273 bp, Triticum aestivum
  Clone ID: PAT_TA_64030
tataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcaactatatacgttttaatggtaaccaactcaaaaaaaaaaaaaaaaaagaagaaattgaaaggcaaaaaacacaaaa

SEQ ID NO: 64031 - DNA, 415 bp, Triticum aestivum
  Clone ID: PAT_TA_64031
ggtgctgcttgcggcgggttagcgtttactactgcgtttgggggaatgccggcgactactcatggcagaccagttcagggaagctcgaccacgggcggtggaggtgtacgctgaggtgctggacgaaggatgtagcacttggctactgggggagcctcatgctccaggaagcgtgtggtggcagccttaccgaggcttatgcagtaacaagcatccgcgcccccacgaccgaatacatgcgtgcctccgcaaggaagacgactcagacgagagaaggacgttcaggagcacggcccggtacccatgacctccctcagattcagtgacgactcgtgcaatgcgcatttttcctttttgttccccacatattatgctgatgacggacgccacactactcgatttggagcattttgat

SEQ ID NO: 64032 - DNA, 513 bp, Triticum aestivum
  Clone ID: PAT_TA_64032
tgttcttcgacctcttcccgcacctagcagagtggtgaagccaagaaagccaactgacggcattgtacatgagtagacaaagaaatgctgctggtgctattcaacgagatcgattctaacctcaaagcgcccatatcccaatgacgagctcgtcgacgatgtccaccacgttgcagtcgcgccatgggccccgaatgcgaaccccgtgacatggactggtccgatgagccggtactgcgatccggcgacttgtgccattcaaccatacagttatggccctcctcgtgggagcttcaaagatttggcgcgaccctgcaacaggtggccccttggaagctgtgcagccacagccgcagctggattgagatcctcgttctcgacgttgctacccttacgctagacacggtgttcgtcaacctggagagcgaattgacaaaacgtgtggagagcggcgagggcaccttttacaaggaccatgcgacaagtcccaatggcaaggacgttggcaacatg

SEQ ID NO: 64033 - DNA, 350 bp, Triticum aestivum
  Clone ID: PAT_TA_64033
tcaattataacctcatggtcgctccagatctgcaacgtcaagcgtggggacctgcacacagcgtgataatggcgccatgggccccaaaggcgaaccccgaggaatgcatctggaacgatgaaccgaactgccatctccggtacttgggcgatcaaccatacagtgatggccctcttacggggacctaaaaagatttggcgctaccctggaacaagtggacagttgaaagttgtgcaaccacagtctaagctgggaattagatcctcgttctcaacgttggtactgttacaaagacacggtgttccacaaactggagagtgaattgactaaacttttggaagtggcgaggt

SEQ ID NO: 64034 - DNA, 460 bp, Triticum aestivum
  Clone ID: PAT_TA_64034
tgtaatccgacgcactatagggcatgctggtacgtctgaaagggccggtccgaatgcccggtgagagtcacgcgtatcaacaaggagaacagtggagaggtatgatggtagatacaaccatacttgccctatgacgatgcaagggcaaaggaaaagccttatattgatagcaagggtatttatgttattagaagacatgtgaaggttaaccttgtccgcaagcactgttctggagctaatgacttgggaagcgaggatatgcctggtgcaactagccatggtatgagggttcaagcatacctataagatggttactgacaagatatcgggacaaccgaggcaatctataaagcaacagtgggaattaccaaaaaaccaatacctgataccaggttctatgaccgctctgctccgatttacacacaatctagagacttgcctccttaaaggttatagatgc

SEQ ID NO: 64035 - DNA, 457 bp, Triticum aestivum
  Clone ID: PAT_TA_64035
cttcccgcacctagcaaatggtcagccacgaatgccgactgacggctttgcacttgagcagacaaagatatgctgctgctgctattcatcgagatcgattcttacctcatagcgcccagaccccaacgacgagctcgtcgacgaggtccaccacgttgcagttgcgccatgggccccgcttgcgaaccccgtcgacatggcctggtccgttgtgccggtactgcgatccggcgacttgtcccattcgaccatccagttctcgccctcctagtaggagcttaatagctctgccgggaccctgcaacaggtggccccttggaagctgttcagccacaggctgagcgggattgagatcctcgtcctcgacgttgctacccttccgctagacacagagttcgtcaacctggagagcgaatcgacaaaaccgctggagagcggcgagggcaccttttacaag

SEQ ID NO: 64036 - DNA, 325 bp, Triticum aestivum
  Clone ID: PAT_TA_64036
ggaaatttggcacgactgccggtaccggcaacggaattcccgtttcggcccttgcgtttgaatttttcatgcacacctgcaaaggagctcatgagtaaaaaatgcttatataggagctatattcgctgcaagttgaacggagtgagtttgagaaccacatgggaaggacacatggatcctcacgtttattgccggtgagccgaggagtccatgaccaggggtgaatttgttggccgctgtgatttctttgagcgaacaactgaagcgagctactgaactaactgggaccatatgagcaccctggttgcttttagccaggttgatg

SEQ ID NO: 64037 - DNA, 264 bp, Triticum aestivum
  Clone ID: PAT_TA_64037
gatacccggctcggtgcgtgttgagctgacctctgatgacgtcggtgggtcggacaaggtggctggagtacggccctggggggtcattgttgctatggggaggagaccatgacgatagaaggagtgtacggacgtctgagctggttgggggaacgactgaacggagatgtaagcctggctgagcagaatgacgaacataggatgttcgtgtagcttggagtggaggaggacttatgatgacgtcgaagcctagagattggcact

SEQ ID NO: 64038 - DNA, 187 bp, Triticum aestivum
  Clone ID: PAT_TA_64038
atcaatcataacctgatggtggtgcatagctgaccgtcaagagtttgtgtccgacacactagcgtgtaatgggccttgggcccattggcatctgggaggaatgcacgggaacgatgagctgaacggccatctccctacttgggtgatcaaccatacagtgatggccctctgacggggacctacgaag

SEQ ID NO: 64039 - DNA, 431 bp, Triticum aestivum
  Clone ID: PAT_TA_64039
gggattgctttaacgactatgctgctgcctttaacattggaggccacggctatcgccctgtgagtcactaacgagaactctttattttttttcatgttggcatgaccttgactagactgtgtccgctcactttggcttacttaaggtcctgcggtgtccctgtttttatgagggggagaacctgtctaatgatgaattgaaagcacatcctacctcgatgggtagagcaaccacctcgtgctatctagttcgcagagtgcaaacaagaactgcatgatacacgttctctgttgatagaggccttcgctgaatacacggctaaattggaaattgacctcacatacactcacaagtgattgggggatcgatggagagtctaggtttgggttcgtggtaactgatctaataatgagaggtggcttcttggatta

SEQ ID NO: 64040 - DNA, 386 bp, Triticum aestivum
  Clone ID: PAT_TA_64040
ggcatgaaagcccactgacggttttggattttagctttttaagaaatgcgtgctgttgctctttaacgagagcgatactaactttattgcgcctagacaccaacgacgagcttgactagaatgttcacgacgttgcagcttactcatgcggcccggattgccaactcccttatacttggactgacccgttgtgccggtactgtgaaccggagactagtcccatgtgtccatgcacatctagtcctatgtggtggcgataaagagatctagaacgacatgagacaggtggtctgctcgtacgtgcctaacactatgcgccaaggtgatgagaaattagacctccacgctgctcccatgttgtttgacagctgggatcaaagtcccgg

SEQ ID NO: 64041 - DNA, 513 bp, Triticum aestivum
  Clone ID: PAT_TA_64041
gtgttctccgacctcttcccgcacctagcaaatggtaagccaagaaagccaactgacggtattgcacttgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggttggagagcggcgagggcaccttttacaaggaccatccgacaagcccaatgccaggacgttgccacatgacg

SEQ ID NO: 64042 - DNA, 543 bp, Triticum aestivum
  unsure (1)..(543): unsure at all n locations
  Clone ID: PAT_TA_64042
ttggcgacagtgctttcgcatgagattgggcacgctatcgcgaggcacttgccagagatgatcaccaagggcatgtggtttactatcctgcagcttatcgtcctacagtttatttacatgccagacttaattaatgcaatgtcgacattactcctcagactgcccttctcacgaaggatggaggtagaggcagatcacatcgggctcatgcttcaagcatctgctggttttgacccacgcaccgctcccaaggtctacgagaagctaggacaaatcgcgggcaatcaatcagtactgaaaagctacctctctactcatccttcgagtaagaagcgatcggagctcttgtctcgagccaaggtaatggaggaggcgatgcagctatacagggaagcttgcgccggccacgggaccgaaggtttcctctaaggttgcagtttcgaactctcctgcgtgcggcgtaagtcgtttggtggcggagggtgcctggcgccgaaacatgcccctttgtgnctgcacagtgacggccaataagaagagtgt

SEQ ID NO: 64043 - DNA, 493 bp, Triticum aestivum
  Clone ID: PAT_TA_64043
tcagtgttctcctgcctcttcccgcaccttgcaaatggtaagccaagaaagccaactgacggcattgcacttgagctgacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgcgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagcccca

SEQ ID NO: 64044 - DNA, 502 bp, Triticum aestivum
  Clone ID: PAT_TA_64044
cctcttcccgcacctagcaaatggtaagccatgaatgccaactgacggtattgcactcgagctttcaaagaaatgctgctgctgctattcaaggagatcgattttaacctcaaagcgcccagaccccaacgacgagcttgtctacgatgtccaccacgttgctgtagctccatgggccccgaatgcgaacccctgttacatggcctggcccgttgtgccggtactgcgatccggcgacttgccccattcgaccatccagttctcgccctcctagtcggtgcttaagagatctgccgcgaccctgcaacatgtggccccttcgaagatgctcagccacagccgcagggggattgagatcctggtcctcgacacatgttccctttcgctagacacggagttcgtcaacctggttagcgaattgacaaaacggctggagagcggcgagggcaccttttacaaggaccatccgtcaagccccaatgccaatgacgttggcaacatg

SEQ ID NO: 64045 - DNA, 378 bp, Triticum aestivum
  Clone ID: PAT_TA_64045
ttgtacgtatgccggcagcatagcagagagaggcgtccacgaactgtaactgaccgccttgaacttgaggacacccagaaatgctgctggtgatgttcaacgagatcaattataacctatggggctctagcccaccgtcaagagttgggcgatgaccaccacggtgaaatggcccttgggccccataaggctaactcggaggacatgcactggaacgatgagctgatctgccatctccggtacttggccatacaaccatacagtgatggccctcctactgggaccttcaaagatctggcgctaccctggaacaagctgaccgttgagagttgtgcaaccacagcctaagcttggaactggatcctcgttcacaacgtt

SEQ ID NO: 64046 - DNA, 203 bp, Triticum aestivum
  Clone ID: PAT_TA_64046
tcggtgttgcaaaaaagcagctgtagatcatagcccttagatcacacagaccctttattatccctacaaacaacaacacgtgtactagcttgtctctgctcttttagattacttcacctagacgtcttctacctttccttatgacttgaatcacccccgttttttcttttcttgtaaacacatatccaacccatatttaataa

SEQ ID NO: 64047 - DNA, 394 bp, Triticum aestivum
  Clone ID: PAT_TA_64047
tccggttgttacagttacagtttgggctcatgtccatatactatcccttacatgaactctgatgatggtcttcaaagactattaaccgtactcgactttttatggtgccttggcatactatcacctagagtctcagtacctagtcgttatggatcagaatgcaactccctggttgtatttcctttcaaacacatccgatctcaaagtatacacgcacaattagtgctatttcggacgaaatgtgctaactgtagctccatgagacactgtctatgtcattacgctcctgtcacttcataccaaggtttatcgcaatacgatctaaactgactctctaggtatccacggctcgcaagagagtgctagattgggtccgggttaactggtctcatga

SEQ ID NO: 64048 - DNA, 364 bp, Triticum aestivum
  Clone ID: PAT_TA_64048
acccagtctttttaaattcccacactcggtgcgttacgagtgctaaccgactgtattacagatgatcctcttccaccccgaccgttgttgcactcgcaacaaagaggtgattccacaggcttatagcgcccagtatctactatcaagaggttatcaatatccaccacgacagagttgtccatggaccccctaggggctccccggcggcatagactggaccaaaatgcccaatctgccaggacaggacttgagcccttgaagcacacattcatctccatctttacaaaccttaaacagattctaggcgctcctatgtcaagcgtgccgttcctaacttgtcataaccatgcgcagcgtggttata

SEQ ID NO: 64049 - DNA, 458 bp, Triticum aestivum
  Clone ID: PAT_TA_64049
cgcacctagcagatggcgacgccaagaaaggcatctgacggtattgcacatgagcagacaaagaaatgctgctggtgctattcaacgagagcgattctaacctcaaagcgcccagatcccaatgacgagctcgcctactatgttcaccaccttgcactcgcgccatgagcgcccaatgcgaaccccgtctacatggcctggtacgctgtgccagtactgagatccggggacttgtcccattcgaccatccaaatatcgccctcctcggtggcgcttcagagcttcaacgagaccctgccacaggtggccccttcagaagctgtgcagacacagacgacacgaggtcgagatcctggtcctggacgttgctccccttccgctagacacggagttcgctaacctggagagcgaattgacaaatcggctggagagcggctagggcaccttgtacaatgacc

SEQ ID NO: 64050 - DNA, 460 bp, Triticum aestivum
  Clone ID: PAT_TA_64050
tccaccttttcccgacctagcaaatggtaagccaagaaagccaactgacggcattgcacatgagctgacaacgaattgctgctgctgctattcaacgagatcgattgtaacctcaaagcgcccagatcccaatgacgagctcgtcgacgatgtccaccacgttgcaggcgcgccatgggccccgaatgcgaaccccgtcgacatggcctgggccgttgtgccggtactgcgatccggcgacttgtcccattcgaccatgcaagatctcgccctcctcgccggcgctttagagcttcggcgcgaccctgcaacaggtggccccttcgaagctgttcagccacagcccgagcggtattgagatcctggtcctcgacgttggtccccttccgctagacacggtgttggtcaacctggagagcgaattgacaaaactgctggagagcggcgagggcacctttta

SEQ ID NO: 64051 - DNA, 390 bp, Triticum aestivum
  Clone ID: PAT_TA_64051
gcacttcgttcatctagcggatgcggattcctttaacaactgatgtacctgttttgaacattctaaagccaagggcttttgcccatctacaatagctaacaggaactcgtgattatctttacaaatcccagcacctttactagactttatatgattctttcggtcacttgacctagagactgctaccttttcttatcattgaatcaaccccgagttctttttcttttaaacacatgccaacccaaagtataagcgcccacctagtcctatctagtcctaaaaatgcgaactagagctacatgagactctatctctgtcgttacgagcctaacactgtctaccaagcttaatcggactaagaccgcacaagcactcacaagttatataggg

SEQ ID NO: 64052 - DNA, 269 bp, Triticum aestivum
  Clone ID: PAT_TA_64052
ctgacccttttccgcggagacgcctggggcgaaaaccactgcttagttataggcctgtgatgcagtggtattaccctggctagtatacggccgttcaaggagctgcaggagctggccgatggaacgctgagtggtatgtgtggatttcatggcgagagattaccggcaggcccaactgctgttgctgtgcgttcagcggttccgatctaccagactgtccgtaaccaatatacaagcttgtgtacgtgttggtcaaccttgtgctgggc

SEQ ID NO: 64053 - DNA, 285 bp, Triticum aestivum
  Clone ID: PAT_TA_64053
ttcgttcgaatttcaagggcttttgcccatctccataactgggaagaactctttcttttgtttggaaattccaaaacctttactcgacttttcctgctgatgcagcttacttcacctagagtcgggtaccttaacttatcattgagggaaccccttttttatttttctttgaagcacatcccaacccaaagcctgagcgaccacctaggcctatctagtccgtaaaatgcgaactagaactacatgagacactatctctgacggtactaacctaacactctctac

SEQ ID NO: 64054 - DNA, 485 bp, Triticum aestivum
  Clone ID: PAT_TA_64054
ggacttatccctgcacgtaggcaaaggcacaccaagaaagccaactgacgtgtttgcacatgagcagacatggaattgctgctgctgctcttcaacgggatcgatagtaaccacaaagcgcccatattgcaatgacgagatcctgaacaatgtgcaccacgacagctgggctcaaagtgcccctaatgcgaacccggttgtcttgggctgagcccatgagccaagactgacagactgcgactcttcccattctagcataacaatttaaccctgatggtaggctcttcagagcttaaagaatgacctgtgcctacgtgtgcccttcctagctgaggagcttcatgacccgaggcattgagatgctactggtcgacgttgctccacttccgctagacacagagctcttcaacctgcagagtgaattgactaaacggatagagagctttgagggcaccttttacaaggaccatacgacaagccccaat

SEQ ID NO: 64055 - DNA, 212 bp, Triticum aestivum
  Clone ID: PAT_TA_64055
cgacctattcccgacctatcagatggcacagccagaaagcctactgactgtgttgcacatgagcatacaaagaagtgctgctgctgctatgcacctggatcgatagtaacctctaagcgcccatattgcatggacgtgatcgtggacaatgtgcatcacgtcacatggcgggcctatagggcccctaatgcgaacctgtgtcgtcttgggct

SEQ ID NO: 64056 - DNA, 526 bp, Triticum aestivum
  Clone ID: PAT_TA_64056
actagcctcacactttgttcatgtagcggatttggacttctgtaacaactaaggacactgtaaataacattggaaagccacgggcttctgcccatctccaataccttacatgaactctaccttttctatacaaattccaaaacctttactagactttttatgctatctttagctaacttcacctagagtcttttaccattgattataaccgaatcaacccctcttttaaacacatttcaaacacataccatcccaacgtatatgcgcccacctagtcctatctatgccgaaaaatgctacactaaaactccatgagacactatctatgctgacactaacctaacactttataccagagcttaatctgactaagacctaccagacacttacaggttgtatgagggtcgaaggaaaggctagggttgggtgctgtgataactgctgtcatctggcgagacagctacgagggttcaaaagggtgaacaaaatgcatgtgtaaaaccgaatccttgacgggatccatgag

SEQ ID NO: 64057 - DNA, 240 bp, Triticum aestivum
  Clone ID: PAT_TA_64057
cctgagcatgccacacacaatgcgaacgcaataacgcctgtgtccactaccctaacaactgggcgactcaccggcgatccagcgcgtgagctgaccatgatgtaaccatgaccgatgatgctgctgtcatacccttatcagaccgtgatcatacaactggcgtacatcatggcctttcatggccattgggcgcctgtgtatgatctcatgagaaatgatgaactgagttgacctgttcgc

SEQ ID NO: 64058 - DNA, 468 bp, Triticum aestivum
  Clone ID: PAT_TA_64058
aggcctgatccctgaccgggtgcgggcgccagcgcgaagccttctggcgtctgtgcgcatgaccagacactgaatgtgcgctgctgctctgcacgggagcgaccatgacctaatagggaccagtgacgatggtcgatgtccttgacgaggtccagtacgttccactggcgccatgatggccctttgcgaaccccgtcgatatgggctggtgcgcatggccaatgatgaaatgcgtgcacttgtccgattggtgcatgcacatctggcccttcttgtcagcgctacagagactaaccaagaccctgcagctggtggtcccttagctgatagacgagctcaatcacacgaggactgagatcgtcactggccgcggtgctacaattgcgctagacacgagagccctgaacctgcccagcgtaatggccttgcagctgatgagcctttagggcgcttgttacatagaccata

SEQ ID NO: 64059 - DNA, 399 bp, Triticum aestivum
  Clone ID: PAT_TA_64059
ctctaaactgcacttcgagcttttgcggtacctatcacatggtaggccacgagagccaactgtcggcattgcacagtgatcttgcccagatacgctgctgctgctgttctacgagatcgattttcacctccaagcgccctgactcgactgacgagcgttgttttcgatgtccaccaccttgagagttgctccatggtgccacgaatgcaatccccgccgacatggctctgtttcagagagccggtaccgcaatgcgtagactcgcaccatgcgaccattcagtcgtagcactcctactaggagctcatgagacactacgtgtgcctgtaccaagcggacactttgtagctgtcctaacacagacaggaccgcactgagactctcagtgctatatcgggc

SEQ ID NO: 64060 - DNA, 329 bp, Triticum aestivum
  Clone ID: PAT_TA_64060
gctcatttggatcgctttacacatcttatggccgctgttgctaacagtcggaagttcacggctcttgcccagatacgctggcgctgatgtactacgagatcgattttcacctccaagcgccctgattcgactgacgaggtcgtcgtcgatgaccaccacgttgtggtcgcgccatgggccctgaatgcgatccccgtctacatggtctggttcgatgagccggtactgcgatgcgtagacttgtaccattcgaccattcagttgtagacctcctagtaggagctcctgagattctacgtgaccctgcaacaggtggacccttcgtagct

SEQ ID NO: 64061 - DNA, 434 bp, Triticum aestivum
  Clone ID: PAT_TA_64061
cggacgcgtggggcaaaatttcctgcttagttatagttctgtgattcattgctaataatcgtgcttctatacggcccttgaaggatttccaggtgctgttcgatggaatgctcagtgggatgtgtgaattttatggtcagattttcctgccaggttgaatagctgatgcagtgcattgagtgttttccatctaccagatttttcctaatcgttatgcaggcttgtggatgttttggtcgagcttgtgcttggattataaatgtgacgtttttagctctgtgaaagtaaagatgcctcgatataatttgtgcccataatacatgtttttttaatgataagatgtatcacatatgctgcaggttttgtatgaatttccattccgacctttcttgatctcaactgctcttaatttgttttattgttccaccaatttt

SEQ ID NO: 64062 - DNA, 461 bp, Triticum aestivum
  Clone ID: PAT_TA_64062
gttctccgacctcttcccgcacctagcaaatggtaagccaagaaagccaactgacggcattttacatgagcagacaaagaaatgctgctgctgctgttcaacgagatcgattctaacctcaaagcgcccagatcccaatgacgagctcgtcgacgatgtccaccacgttgcagtcgcgccatgggccccgtatgcgaaccccgtcgacatggcctggtccgttgtgccggtactgctatccggcgacttgtcccattcgaccatccagttttcgccctcctcgtaggtgcttcagagcttcaccgtgaccctgcaacaggtggtcccttctaagctggccaagcacagccgcagcggcattgagatcctcgtactcgacgatgctccccttccgatagacacggtgtccgtcgacctggagagcgacatgaccaaacggctggtgagcggcgagggcacct

SEQ ID NO: 64063 - DNA, 295 bp, Triticum aestivum
  Clone ID: PAT_TA_64063
actcgatagttagtcaaccgcaacaaagaggcgagaccaaaggtatatagcgcaccagatacctactaacacagatggtatacatatagccaccacaaacagagattctccatggaccccgtaggtgacccttggcggcacagactggacccaaatgcccaatctagcaggacagtatttaagcaagtgaagcatagattcatctccatcttcacaaacctgagacacattcgaggcgatcatatgtcatgtaggccgttcctaatttgtcataactatgcgcagcggggttata

SEQ ID NO: 64064 - DNA, 382 bp, Triticum aestivum
  Clone ID: PAT_TA_64064
gctataacgtgttctccgacctcttcccgcacctagcaaagaggtgagccacgaaagccgactgacggcattgcacatgagcagacaaagaaatgctgctgctgctattcaacgagatcgattctaacctcaaagcgcccagatcccaacgacgagctcgtcgacgaggtccaccacgttgcagtcgcgccatgggccccgaatgcgaaccccgtcgacatggcctggtccgatgtgcctgtactgccatccggcgacttgtgccattcgaccatccagttctggccctcctagtgggagctaaagagatctgccgggaccctgcaacaggtggccccttggaagctgttcagccacagcctgagctggattgagatcctcg

SEQ ID NO: 64065 - DNA, 220 bp, Triticum aestivum
  Clone ID: PAT_TA_64065
gttctagatgtgcgagcgctccgctttaccgttcttgattcagtgatggcacaatcggaggggatgctttgttgcttgtaccgtcttgattaagtaactttctgtgatcctgtgcgcgaggaactggatggatgctggtgtgtcttctatgataccgcttgagatgaataaatgcttgttactcctctgaacttttgtgacaaactcctttccactaacg

SEQ ID NO: 64066 - DNA, 325 bp, Triticum aestivum
  Clone ID: PAT_TA_64066
tctacgacctcttcccgcacctagcaaatggtgagccaagaaagccaactgacggcattgcacatgagcagacaaagaaatgctggggctggtatccaacgcgatcgattctgacctcaaagcgcccagatcccaatgacgagctcgtcgacgatgtccaccacgttgcagacgcgccatgggccccgaatgcgaaccctgtcgacatggtctggaccgccgtgccggtactgcgatccggcgacttgagccattagaccattcagttctcgcactcctagtcggtgctatagaggtttgccatgaccctgcgacacgttgcccc

SEQ ID NO: 64067 - DNA, 367 bp, Triticum aestivum
  Clone ID: PAT_TA_64067
gtttggtttatttgaagagtggaaggacggtgttccacgagcagtacagggcgtggggcttcatacaagatcaaacaattccttgcgctgacttttgcaactgggtagctacgggccagggaaatttttatgacaccctggatgtgatactcgtctggacgtgacatcaattaatcatgtacatgaaaaaaaaaaaggcgcgttaaggatcaagtactaccggctgcagatacttttatggcactaaattattatggcgcgttacacgctgatgaaactgggtacaataatgctgagaatcctttgcgtggtatacaaaggcgaccacgcttcacatgcagctatggatgacccctgacgccatacc

SEQ ID NO: 64068 - DNA, 296 bp, Triticum aestivum
  Clone ID: PAT_TA_64068
tattccaatgacaagatcttctatagactttttctggttctttagcttacttgagctagagtgtgcgaacctttgcttatcattgaatcaaccccttttctttttgtttataaacacatccgaacccaaagactaagcgcgcacctagtcctatctagtccgaaaaatgtgaactactacttcgtgagacgctgtctctgtggagacgaacataacactctgtaccaagtttgattggctttagacctcacaaacactctcacgttatatagggcgtgaaagaaagtgtagggttg

SEQ ID NO: 64069 - DNA, 333 bp, Triticum aestivum
  Clone ID: PAT_TA_64069
tcccgccgtagctatgggattaggaatgtcacctgacggcttgcacatgagcatcacaaagaaatgctggtgctgctattcaacgagatcgattctaacctcattgtgctcatatcccaatgacgagctcgttgatgaggtccaccaggttgtataggctccttgagccccagaatgcgaacctttgtcgaatggtctggaacgctgtgcctgttctgctatccggcagactttgaccatacaaccataccgttctcgtcgtcctatttggagctaaaaaggtttgccgtgacctctgtgacaagctgtcctttggaagttcgacactcacag

SEQ ID NO: 64070 - DNA, 153 bp, Triticum aestivum
  Clone ID: PAT_TA_64070
cctccgaccggtgcccgcacctagcaaagagggcagcgcacgaaatgctcaacctgatcggcatatgttacatggaggttattcacccgaagatgcctgctgcctgctattcaacgtgatcgattctaacctcaaagtcgcccatgatcctca

SEQ ID NO: 64071 - DNA, 183 bp, Triticum aestivum
  Clone ID: PAT_TA_64071
acactttgttacatctagcggatttggatttctttaacaactaaggctcctgtttttaacattttaaagtcaaaggctcttgcccatctccaatagctaacaagaactctttttcttcaatcaaactactgacttttgttttactactcacaagctctccttctatatgatcacccttttttt

SEQ ID NO: 64072 - DNA, 230 bp, Triticum aestivum
  Clone ID: PAT_TA_64072
tacatctagcggatttggatttctttaacagctaaggttcctgtctttaacattttaaagtcaagggctcatgcccatctccaatagctaacaagaaccttcttctttcaaatccaaacgactgacttttgtcttactacttactaagctttcctttttatatgacaccctttttttttttaaacacatcaaccaagttacccccacctatccttctagacgaaagcaac

SEQ ID NO: 64073 - DNA, 347 bp, Triticum aestivum
  Clone ID: PAT_TA_64073
ggtaacgacagtgacatccctacggagccccttccattatctgtgcgtcgctgtgttcacaaataacccgtgagctacacgcaattggggcgagctaaggaaatccacagctgcacaatcgtgaagagatcaactcattggcccagagtgaaaaaatggtgttcgtcactgattgtcagcactacaaagcgctgggagtacaagagtgcgaagacaaggtttgcatatctgatgggatggattatcacgttcgtggactgctgtgcaacgtgatgcgcaaactttatgtgtgtttaaaaaaaagcgcgttagacagtctcctctgacgtattttggactatatatgc

SEQ ID NO: 64074 - DNA, 228 bp, Triticum aestivum
  Clone ID: PAT_TA_64074
gcttaactgttctccgacctcttcccgcacctagcaaatggtaagccaagaaagccaactgacggcattgcacatgagttttacaaagaaatgctgctgctgctattcaacgagatgattacctaagcgccaatcaagcagctgcacatgtccacttgatcccctggcccaagcaaccccactggctgtcgtggcgactgaccgcactgtcatcactcagtctgctct

SEQ ID NO: 64075 - DNA, 328 bp, Triticum aestivum
  unsure (1)..(328): unsure at all n locations
  Clone ID: PAT_TA_64075
tctacgacctnttcccgcacctagcaaagggtgacgccaagaaagccaactgactgcattgcacatgaacatacaaagaaatgctgctgctgctattcaacgagatcgattctaacctcatagcgcccagatgcaaaagacaagctggtcgactatgtgcaccacgttgcacaagccccatgggctcccaaggcgagcagagcagacatggtcatttccattgggacggaactgagatccggggagtagctccataccaccatccagatatgggcctcctccactgcgcttcagagctttgtcgtgaccctgtgacatgtggcccctt

SEQ ID NO: 64076 - DNA, 274 bp, Triticum aestivum
  Clone ID: PAT_TA_64076
acaactgacgactgtgggcttaacacatgaacgcccagggctatggtgcagctgctatagatcgcgagaactttttatcttattgagcaaagccacaaccgacactcgactttacgtggttcaccagcttacttcacctccagggtcctaccttgcgatctcatgtgaacaagcccttgttcgttgtgcttgtaaccgcatcccagccacatagtactagcgcccatctagttctatctactcctgaaaaatgctaactagatctacctgaaac

SEQ ID NO: 64077 - DNA, 312 bp, Triticum aestivum
  Clone ID: PAT_TA_64077
ctctaacctgttctccgacctcttcccgcacctagcaaatggtaagccaagaaagccaactgacggcattgcacatgaacttacaaagaaatgctgctgctgctattcaacgagagtattacctaaagcgccatccaatgcagctcgcacatgtccaccacgttcagccccatggcccaatgcacccctcacatggctgtcgtggcgactgatccgactgtcatcaccatcgtctgcctctgtcgcttaacttccgacctgccagggccttaagtgcacccagcgagggatgaacctcgccacgtgtccttc

SEQ ID NO: 64078 - DNA, 368 bp, Triticum aestivum
  Clone ID: PAT_TA_64078
cccgacctcttcccgcacctagcaaatggtaagccaagaaagccaactgacggcattgcacatgagcttaatttttaaatgctgctgctgctattcaacgagatcgatttcctaagcgccgaccaagcagctgcacatgccacacttgcatgcctggcccgagcacccgcactggctggccgtggcggtctggatcgcactgtcatcaccatcatctgcctctctcgcttaagtcgcgacctgcacggggccttaattgtctccagccagcgatgaatctatctcactgctccttcctgaccggctgaactgaaggatgcaaacgtgagaggcagggctttacagcatcacagccatgcagcctgcac

SEQ ID NO: 64079 - DNA, 215 bp, Triticum aestivum
  Clone ID: PAT_TA_64079
ctcacgcgtacgcccacgcgtgcggtgtgctccagttccccgtcgcagatcgcccggttcctgaaggccggcaagtacgccgtgtgggtcggcgccggcgcccccgtttacctcgccgacgtgctcgagtatctcgccgccgcggctctggagttgcccaagatcgcggctagggacaacaagatgaccctcatcgtgccgagccacatggagct

SEQ ID NO: 64080 - DNA, 195 bp, Triticum aestivum
  Clone ID: PAT_TA_64080
ctctaagtgttctccgacctcttcccgcacctagcaaatggtaagccaagaaagccaactgacggcattgcacatgagcagacaaagaaatgctgctgctgctattcaacgagatcgattaacctaagcgccaatcaagcagtctcacatgtcacacttgatccccatgcccaatgcacccgcacatggctgtcg

SEQ ID NO: 64081 - DNA, 343 bp, Triticum aestivum
  Clone ID: PAT_TA_64081
gtccggtggcggagtcacgagggccgaccgacgcgttcgaacatgaaggggacaagcaaatgctgctgctgctataagcgagacgtctaacctcaaagcgcccagaccccaatgacgagctcgtggaccatgaccaccacgttgcagtcgcgccatgggccccgaatgcaaaccccgtcgacatggcctggtccgttgtgccgagactgcgatccggcgacttgcgccattcgaccatccagttatggccctcctcgtgggcgcttcatagctgagacgcgaccctggaccaggcggccccttcaaagctgaccagccacagccggagggggatcgagatcct

SEQ ID NO: 64082 - DNA, 403 bp, Triticum aestivum
  Clone ID: PAT_TA_64082
gacctcttcccgaacctagcaaatggtaagccaagaaagccaactgacggcattgcacatgagcttacaatcaaatgctgctgctgctattcaacgagatcgattctaactacagcgcagaccaagcagctgcacatgcacacgtgagccgcaggcccgaagcacccgcacatggctggccgtggcggcgcaccgggatgtcatcgcatcagtctgcctctgtgccttaagtcgcggactgacagggccttaagtgcaccaagcgagggttgaacctgtccacgtgtccttcgtagaacgtgtcgaaccggaaggatgacaacgtgaagggaggacttacatgactcacagccatgcagagtgcaagagcgagggtaccaggcaggagttaacctaatgcatc

SEQ ID NO: 64083 - DNA, 314 bp, Triticum aestivum
  Clone ID: PAT_TA_64083
gctaacactttgttacatctagcggatttggatttctttaacaactaaggttcctgttctgaacattttaaagccgagggcttttgcccatctgcaatagctaacaagaactactctttctctacaaagcccaaaacctccactagactgcttctgctcctttagctcacttcagctagagccccatacccccccttagcattgactcaacccctggtctgtttcgttgtagcacacatctccaacccaaagtattagcgcccacctagatctatctagtccgctacatgcgagctctaactacatgagacact

SEQ ID NO: 64084 - DNA, 331 bp, Triticum aestivum
  Clone ID: PAT_TA_64084
aactgttctccgacctcttcccgcacctagcaaatggtaagccaagaaagccaactgacggcattgcacatgatctgacaaagaaatgctgctgctgctattcaacgagatatctacctaagcgccaatcaagcagctgcacatgccaccacgtgatcccctggcccaatgcaaccctcactggctgtcgtggccgctgatcgggactgtcatcaccatcgttcgctctgtggcttaagttccggactgccagggccttaagctgcgccagcgagggatgaatctcgctacgtgtccttcgtgaacggtcgaactgaagcaatgcaaacgt

SEQ ID NO: 64085 - DNA, 150 bp, Triticum aestivum
  Clone ID: PAT_TA_64085
catggcattcggcgctattgaccgtgtccatgatttcatcgagccagggcatacgatcttctggctctcagttcttgacggtgggacagctgctcgtaatggtggccaacctatcagatgaacaagttatacaactcgccatagatcatc

SEQ ID NO: 64086 - DNA, 187 bp, Triticum aestivum
  Clone ID: PAT_TA_64086
acacgatgttacgcctagcggatcaggaggtctgtaacaactgacgacccaggggttagcatttgaatttccagggctgtggggcatctgctatagatcgcaacgacttttgctgttgttgaccaaactcaaaatcgtgaagatagtcttggagcttcaccaggtgactgaagctagagggctcgac

SEQ ID NO: 64087 - DNA, 338 bp, Triticum aestivum
  Clone ID: PAT_TA_64087
gttctccgacctcttcccgcacctatgcaaatggtaagccaagaaagccaactgacggcattgcacatgagcttacaaagaaatgctgctgctgctattcaacgagacgatctaatcctcaaagcgcccagatcccaatgacgagctcgtcgacgatgtccaccacgttgcagtcgcgccatgggcccctaatgcgaaccccgtcgacatggcctggtccgttgtgccggtactgcgatccggcgacttgtcccattcgaccatccagttttggccctcctcgtaggagcttaaaagcttcgccgtgaccttgcaccagggggccccttggaagctgt

SEQ ID NO: 64088 - DNA, 250 bp, Triticum aestivum
  Clone ID: PAT_TA_64088
cgtgcatgcaggcggtggcggtcatccaggcaggggctccctagaccccggcaggggaggaggaggccccgccccaccggttcggcgggttgtcaaggaaaagcccgttggtatctttccgcggccggggttgctacatggcgcacgtgatgaaaagcctcctcgcggccgcaggggctcacgccaccctttttaatttgtaggcccccacctaggaccccccgctgtggaaggccgttggcctcccggc

SEQ ID NO: 64089 - DNA, 141 bp, Triticum aestivum
  Clone ID: PAT_TA_64089
atacgatctcttaccgaacctagcaaaaggtaagccaagaaagccaactgacggcatagcatatgagttgacaaagaaaagccgcagcagcaaaacaacgagagacgccaacgctcaaaagcgcccagatacccaaagacg

SEQ ID NO: 64090 - DNA, 226 bp, Triticum aestivum
  Clone ID: PAT_TA_64090
atgcactatacttttataggccctaaatcatactggcgcgttacacgctgactggaaaccctgcgtccaactaatccctgagaatcccttccagcgcgaatagcaaaggcccacgtcgcttcaacagtgcagctgatggaaggaccccctgacggcataacgcgtgggggggtcccagggccgtcactgaggcctaggccgtcttcttttcttctttcccgtcgcg

SEQ ID NO: 64091 - DNA, 377 bp, Triticum aestivum
  Clone ID: PAT_TA_64091
gtggctggatttcatcattaaaacctcactgcttgtttcctgaaaccgggtgacgatgggtcttccactcatttataggacatggcattcggcctattaaccgttcatgattcatcgaccgggctagatctttggtctagtcttgcgtggacagtgcctatggagcaactataataatagtttaaattcgcatagatatttgtttccagcgtgttgaagtgatttagggtgtaatcatagctaggttaacgtaggcgcagatcatgagatggctgagtaccaccgctttggtgtttatccatataatgactgattatgaactggctgtaattgcaaacgtttcaggtcaacattaacaaaacttgattctacacaca

SEQ ID NO: 64092 - DNA, 273 bp, Triticum aestivum
  Clone ID: PAT_TA_64092
ttgttacatctagcggatttggatttctttaacaactaaggttcctgttactttaagccagctttgcatctcatactacagactctttttttttacagatcaaaacctttactaacttttgttttactactaccaagttttaccttttatattgatacccttttttttttaacacatcaccaagttacgccactagtctatttccgaaaatgcactaactctaacacttttgtgtcaacctcactttaccactaatggtagactacaacctac

SEQ ID NO: 64093 - DNA, 391 bp, Triticum aestivum
  unsure (1)..(391): unsure at all n locations
  Clone ID: PAT_TA_64093
ttgttacatctagcggatttggatttctttaacaactaaggttcctgtttactttaagcaagcttttgccattcatagctacagactttttttttttacgatccaacctttactagacttttgtttttactacttacaagttttactttttatatgataccctttttttttttaacacatcaccaagttacgccactagtctattgtcgaaaagcactaactctgaaactatttgtgtcaactacactttaccactaacgatagactcaacctacagattgggtgaagaagtagttggtgggaactgttaaaagaagagtctggtaaagaggcaaagataanatcaagttacggtctagtaaatgtgaactgtataagataatagtaatgt

SEQ ID NO: 64094 - DNA, 197 bp, Triticum aestivum
  Clone ID: PAT_TA_64094
gtggctggatttcatcattaaaacctcactgcttgtttcctgaaacagggtgacaatggtcttcatatctatgacatgcatgggcttaccgatcaggatacaccaggataactttggttcagttgcgtggcagtcctatggagaaccacaaaatagtataatcctaacatttgtttccagcgagctaatgtgattta

SEQ ID NO: 64095 - DNA, 234 bp, Triticum aestivum
  Clone ID: PAT_TA_64095
gcacatgagcactcaaggatatggtgctgctgctattcaacaagagcgatcgtgacctcatagcgcggcagaccgaacgacaagctactctacgaggtccaccacgttacagccgcgccatggtgccacaatgccaaccctgtgaacatggcctgtttcgttgtgcttgtactgcgatcccacgactaggccatgcgaccatccagttctatctctcctggagggcgctaaata

SEQ ID NO: 64096 - DNA, 273 bp, Triticum aestivum
  Clone ID: PAT_TA_64096
gttacatctagcggatttggatttctttaacaactaaggttcctgttaacatttaaagttaggctttgccattcaatactacagactgtttttttttacaaatccagacctttactaactttctgtttttagctacttcacctaagcttctactttcttatatgataacccttttttttttttaaacacatccacccaagataagcgccacctatctattagtcaaaatgcactaaactctgaaccttcttgtgtcaactacactttaccact

SEQ ID NO: 64097 - DNA, 419 bp, Triticum aestivum
  Clone ID: PAT_TA_64097
gttctccgacctcttcccgcacctagcaaatggtaagccaagaaagtcctgcggcttgcacatgcttcaagaatgtgtgtgtatcacggacgtttacctaagcgccaatccatgacgagctcgcacatgccaccacttgagcgcgcaggcccgaagcaaccgcacatggctgtcgtggccgctgatcgggatgtcattcaccatcagtctgcctctgcgccttaagttgcggactgacagggccttgagtgcagccagcgacggttgaatctgttcacgtgtccttcgtgaacggtctaactgaagcaatgcaaacgtggagcggaggccttcaagcatcacagcatgcagactgcacatacccgagggtagccgcctagagttacacctaatgcatcgattttcgtgcttgcgcgtcg

SEQ ID NO: 64098 - DNA, 189 bp, Triticum aestivum
  Clone ID: PAT_TA_64098
ttttaacattatagagttctgggcttctgcccatcttcactagatcacaagaactctttctctgatttacaaatcccaacaccactactagagtttctctggttcactagctcactagacctagagccttctacatcatctgatcatcgcaataacccctttcttttattctcttacacacatcccagc

SEQ ID NO: 64099 - DNA, 254 bp, Triticum aestivum
  Clone ID: PAT_TA_64099
tcaacactttgttacatctagcggatttggatttctttaacaactaagtctgttaacatttaagtcgggctttgccattcatgctacagactttttttgtttacaaatccaaacctttactgactttttgtttttagctacttacctaagctttccttttatcatgataccctttttttctttacacatcacccaagttagcgcccctatctattgtcgaaaatgcactgactactgaacctatttgtgtacac

SEQ ID NO: 64100 - DNA, 426 bp, Triticum aestivum
  Clone ID: PAT_TA_64100
ttctccgacctcttcccgcacctagcaaatggtaagccaagaaagcctgacgctgacatgcatcaagaagctgtgtgtttaacgagacatttacctaaggccaatccaatgcagctgtgcatgccaccacgtgcatgccctggcccaagcaaccccgcactggctgtcgtggcgtctgcaccgactgtcatcaccatcagttgcctctgtgccttaagtcgcgacctgacggggccttaagtgcaccacagcgagggatggactgtccacgtgtctttcgtgaacggtcgaactgaagcgatgcaacggtgaagcggaggacttaaggcctcacagcccaagcggcgtgcaatgacccagaggtagcacgctaggagttcaacctaatgcatcgcatgttcgtgcttgcgcgatcgtctactgcct

SEQ ID NO: 64101 - DNA, 435 bp, Triticum aestivum
  Clone ID: PAT_TA_64101
taacactttgttacatctagcggatttggatttctttaacaactaaccctgtttaatttaagtcggctttgccatctcatagtacagactctttttttttcaatcccaaaccttctaacttttgtttttactactacctaagttttccttttttatatgataaccttttttttttaacacatcacccaaagatagccccacctatctattgtcgaaaagcactaactctaacacttttgtgtcaacctaacactttacactaacgatagactcaacctacagattaggtgagaagctagtggttggtactgttaaaggaagactcttgataaaaggacaagaaaaaatcatttacggtctagtaatgtgcactaataaataatagtaatgtggatgataataacggtgcagaacattactgtcatttttttatat

SEQ ID NO: 64102 - DNA, 430 bp, Triticum aestivum
  Clone ID: PAT_TA_64102
ttctccgacctcttcccgcacctagcaaatggtaagccaagaaagcctgcgcttgattgactcaagaaagctgtgtgttcaacggacatttacctaaagcgccaatccatgcagtctcacatgtcaccactgcatgccaggcccgatgcaccccgcacatggctgtcgtggccgctgatcgcactgtcattcacatcatttgcctctgtgccttaagttgcggacctgcacagggccttaagtgcacccagcgagggatgaacctgtccacgtgtccttcgtgacacggttgaactgagagcatgcaacggtgaagcgggagcctttacaagacatccagccaagcagcttgcacatacccagaggtagacgctaggagttacactcaatgcatcggatgttctgcttcgcgatcgtctactgcgctacg

SEQ ID NO: 64103 - DNA, 246 bp, Triticum aestivum
  Clone ID: PAT_TA_64103
taacactttgttacatctagcggatttggatttctttaacaactaactcttttaacattaaagccgggcttgcctctcatagctacagactctttttttttcaatcaaaacctactagactttctgttttactactcactaagtctttacctttctatattgataacccttttttttttttaaacacatcacccaagatagcccacctatctattatcaaaagcaactaaactctgaacctatctt

SEQ ID NO: 64104 - DNA, 427 bp, Triticum aestivum
  Clone ID: PAT_TA_64104
gttctccgacctcttcccgcacctagcaaatggtaagccaagaaagcctgcgcttgcttgactcaagaagctgtgtgtttaacggacatttacctaagcgccaatcaatgcagctcgcacatgtcaccactgcatgccctggcccgaatgcaccccgcacatggctgtcgtggccgctgatccgactgtcattcaccatcagtctgcctctgtgccttaacttgcggacctgccagggccttaactgcacccagcgacggttaatctgtccacgtgtccttcgtacacggttgaactgaaggatgcaaacgtgaaggggagcctttcaggccatcacagccatgcagactgcacatacgccagaggtagccgcctaggagttacacctaatgcatcgcgatgtcgtgcttgccatcgtctactgcct

SEQ ID NO: 64105 - DNA, 203 bp, Triticum aestivum
  Clone ID: PAT_TA_64105
attataacctgatggtggtgctagctgaacgtgaagagttggtgtgatgacacactggcgtgataatgggccttgggcgccataggctatctgccgaggaatgcacgaggaaagatgagctgatcggccatctccggtacttgggtgaacaaccatacagtgatggccctcttacggggaccaaaaaagaactggcgctaccc

SEQ ID NO: 64106 - DNA, 277 bp, Triticum aestivum
  Clone ID: PAT_TA_64106
ctctttcgtcgccgtcgattcgaacctcccccaaatcagcagcagtcgaccggaggcgccgccatggcccgtaccaagcagaccggccgcaagttcaccggcgggaaggcgccccgcaagcaggttgccaccaagggggggaggaagtcggggccgaccaccggcggagtgaagaagccccaccgctacaggccggggaccggggcgcttcgggagatccgcaagtaccaaaagagcacggagctgctgatccgcaagctgccttttcagcgcctgg

SEQ ID NO: 64107 - DNA, 178 bp, Triticum aestivum
  Clone ID: PAT_TA_64107
tagcgaggggagtacgaaagtcactgaccgccttgcacatggagcacaccaagttatgctgctggtgatgttcaccgggatcaattataacctgatggggctcatagcccaacgacaagctctggggcgcatgccaccagggtgcacatgggccttgggccccagaaggctaactgcg

SEQ ID NO: 64108 - DNA, 452 bp, Triticum aestivum
  Clone ID: PAT_TA_64108
tacgcgcagttggattgctttaacagcctaatgccgctgcccttaacactggaaaggctcacggctatcgcccatgtgcgataactatgaagaactctttattttttttgctgttgcctgaccttgactagactgtgtccgctcaatttggcttacttaaggtactgtgttgtccctgtttttatgatggggagaacccgtctaatgatgaattgtaagcacatctcagctcactgggtgagcacccacctcgtgctatctagctcgcagagagcaaactagaactgcatgtgacactgtctctgttgatacaagcctatcactacctaccagagcttaattggaatatagacctcacaaacactcacaagtgatatagggctcgtgagaaagcctaagttagggttcgggctaactgctctaataatgagagctggcttcttggattaaaa

SEQ ID NO: 64109 - DNA, 245 bp, Triticum aestivum
  Clone ID: PAT_TA_64109
taatatctaacaagaactgtttcttttttttacaaatcccaaaacctttactagactttttctgcttctttagcttactacacctacaatcccctacctttttttatgattgaatcaagcccccttgttcattccctttatacacatcctagcccaaagtataagcgcccaccgagatctatctaccccgaaaaatgctaactagaactacccgagacactatctatgtttgttaccaccctaac

SEQ ID NO: 64110 - DNA, 490 bp, Triticum aestivum
  Clone ID: PAT_TA_64110
gttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatccggcgacttgtcccattcgaccatccagttctcgccctcctcgtcggcgcttcagagcttcgccgtgaccctgcaacaggtggccccttcgaagctgtccagccacagccgcagcggcattgagatcctcgtcctcgacgttgctccccttccgctagacacggtgttcgtcaacctggagagcgaattgacaaaacggctggagagcggcgagggcaccttttacaaggaccatccgacaagccccaat

SEQ ID NO: 64111 - DNA, 568 bp, Triticum aestivum
  Clone ID: PAT_TA_64111
gtaatgccacgactgccgactgtgggcattgcacatgagcggacaaggatatggtgctgctgctattcatcgcgagcgattttaaccttattgcgcccagatcccaacgacgagctagtctacgatgttcaccacgttgctgtagctccatgggcccaccttgcgatccccgtggacatggcctggtccgttgtgcctgtacatgcgatccggcgacttgtcccattcgaccatccagttctagctctcctcgaaggcgctaaatagctctgccgggaccatgctacaggtggtccctaacaagctgctcagtcacaggcgtagtgggattgagatcctagaactactcgctggttctcttgcgctagacacagagttcatgaacctggagagcgaatcggcaaaactgctggaaagcggctacggcaccttttacgagggccatacgtcaagccccaatgccaaggacgttgccgacatgacgacctcagaggtgctagccacgtggctcatggcgattatatgcaccctcaaaattgtccattccgcgatttgtttcactgctttg

SEQ ID NO: 64112 - DNA, 131 bp, Triticum aestivum
  Clone ID: PAT_TA_64112
gcacagtgcgaatgctttaacaacttaatgccgctgccctaaacactgggtatttcacggctatcgcccactgcgtcactaagaagaactctgtctcttttttgctgatggatgaccctgactagactttg

SEQ ID NO: 64113 - DNA, 296 bp, Triticum aestivum
  Clone ID: PAT_TA_64113
aacaggaactcagaacttttttttctgtttacaaaaccctaaaccgacactagacgttctctgggcttatagctgacttcagcctagagccttgtacctatgagtgagaatcaccaacccctttttttttttactcaaacacaccccaacccaaagcatccgcgccgcacctatctactatctaggccgaaaaatgcgaactacaactacatgtagacactattgttgtagccacaaacctaacactgtgcaccaaggtgaatcggcctaagacctcacaaacacttacaagggat

SEQ ID NO: 64114 - DNA, 508 bp, Triticum aestivum
  Clone ID: PAT_TA_64114
ctctttccgcacctagcaagatggtaatgccaagaaagccaactgacggctttggacatgagcatttaaagaaatgctgctgctgctattcaacgagatcgattctaacctcatagcgcccagaccccaatgacgagctctgctacaatgtccaccactttgcagttgcgccatgggccccgtatgcagaaccccgtcgacatggactggtccgttgtgccggttctgcgatccggcgactagtcccattcgaccatgcagatctagccctacttgagggcgcttcagagatttggcgcgaccctgcgacactgtggtcccttggaagctgtccagccacagccgcagcggtattgagatcctcgtcctcgacgatgctcccctttcgcttgacactgtgttccgacaacctggagagggaattgacaaaacggctggagagtggggagggcaccttttacaaggaccataccggcaagccccaatgcctaggacgttgccacatgac

SEQ ID NO: 64115 - DNA, 515 bp, Triticum aestivum
  Clone ID: PAT_TA_64115
ccttcgacgtatgcccgcacctcagcgagaggtgcagccacgaaagccgactgacggcattgcacatgagcttacaaagaaatgctgctggtgctattcaacgagatcgattctaacctgaaggcgcccatagccgaacgacaagctcgtctgcgatgtacaccaggttgctaatgggccatgggccccgaatgcgaactccggacgacatgcgcctgctaacgatgagcctgaactgccatccgccgacttgggctatacaaccatacagtgctggccctcctcgggggagctaaaaagatctgccgcgaccctgcagcaagtggccccttgaaagctgtgcacaccacggcctgagctggattgagatcctcgttctcgacgttgctgctgttgcgatagacacggtgtccatcaacctggagagcgaattgacaaaactgttggagagcggcgaggtcaccttttagaaggaccatacgagaagtcccaatgccaaggacgtttccaacatg

SEQ ID NO: 64116 - DNA, 336 bp, Triticum aestivum
  Clone ID: PAT_TA_64116
gtctaaacctaacactttgttacatgtagcggatttggatttctttaacacctaaggtttctgtcattaacattctaaagtcaacggctgttgcccatctacaatgatctaacactgaacctctattgtttccctttacacaaacgacaagctttactagactgtccatgatgttgtagcttactcaagctccaggattgtaccctctgttatcatggactgaaccgctgtgtcttttctgttaaaacacagacctagcccataggatcagcgagcacctagccttatctagtgcgctaaataggaactacaactacatgagacactgtgtctgtc

SEQ ID NO: 64117 - DNA, 506 bp, Triticum aestivum
  Clone ID: PAT_TA_64117
gctataaccctaacactttggacatctagcggatttggatcaccttaacaactagggttcctgattttaacattttagagtcaagggcttttgcccatcttcaatagctaacaagaactttcttctcttatttacaaatcccataccctacactagacgctttttgctcttatagctcacttaacctagagccttctaccattattgatcatagcatcaacccctttttttttttactcaaaacacatcccagcctaaaggctcagctcccacctagtactatctagtccgcaaactgcgacctcgagctacactatacactatgtttcgaagctaccaactctaacactttctaccatgcttaatgagcataagacctctcacacactctcaaggtatatagggctagaaagaaagtgtaggtttgggaactggtttactgctgtgagaaagagacgtggatacttggagtgaacagagtgatcaagatgaatcagaaatttcac

SEQ ID NO: 64118 - DNA, 454 bp, Triticum aestivum
  Clone ID: PAT_TA_64118
ctctaaagcgttctccgacctcttcccgcacctagcatatggtcagccaagaaagccaactgacggtgttgcacatgagcagacaacgaaatgctggtgctgctatacaacgagagcgattctaaccttgatgcgcccacatcccaatgacgagctcgtccaccatgtccaccacgttgcattcgcgccatgggcccctaatgcgaaccccgtcaacatggcctggaacgttgtgccggtactgcgatccggcgactagaaccattcgcaccatccagttctcgccctcctcgaaagagctacagagcttccccgtgaccctgctacaggaggcccctgtgagctgatcactcacagtcgcagtggccttgagatcctacggctcgacgttgctccccttgcgctagacacagtgttcgtcaatctggagagcgaatcgactaaacggttggag

SEQ ID NO: 64119 - DNA, 442 bp, Triticum aestivum
  Clone ID: PAT_TA_64119
tagatcatgtggctggatttcatcattaaaaccttactgctcgtttgctgaaaccacaagcgttgaacagttggggacactatccactcattccaatatgatcatgggcatttggcactattaaccgcatccatgattttattgagcgcagggcttaagatcttctggctctcacttcttgactttgggacagttgaactaatggtagcacacctttcaaataaataagttataaaattcagcatagatcatctccgctctttccgagtctgatgatctgaatgatgtgttctcagggctagatcaattaatatcctatggcttcacacctcaacgcgtctagcaatccatgagagactggagcctgctacacaccaccgagctctttgggtggctgtattattcccaattatcgatagaaggcttgattgttttgaaaccg

SEQ ID NO: 64120 - DNA, 379 bp, Triticum aestivum
  Clone ID: PAT_TA_64120
ttgtacatctagcggatttggatttactttaagaactaaggtttaagattttaacattttagagttaagggcatttgcacatcttcaataggaaacaagaacttttttttctaatttacaaaacctaaaacctacactagacgctttttgatcctacagcatactaaacctagagtcttttaccattattgaacaaagaatcaacccttttttttttaaactcaaaacacatcccagcctaaagggtcagctaccactaagtactatgaaaaacgaaaactgcgaccaagagctacattatacattatgtttcgaagctaaaacttaatactaagcaccaaggtaaaaaggagataagaactctcacacgcttacaagg

SEQ ID NO: 64121 - DNA, 384 bp, Triticum aestivum
  Clone ID: PAT_TA_64121
acactacgtatcatcgagcggagcaggaggtctgccacaactgccgactgtgggcataacacatgaacgcccagggctttggtgcagctgctatagctcgcgagagctttttatcttattgagcccagccacaaccgacacgcgactttaccaggttcaccagcttactttagctccaggggcccaccttgcgatctcagtggaccaggcccgtttcgttgtgcctgaaccgcatccagccacattgtatcatgcgcccacccagttctatctctcccgaaaagtgctaactagatctacctgaaacactatacatgtggccactaacctaacagtcagtaccaggcttaatgggaatgagaccctacaaccactcacaggttc

SEQ ID NO: 64122 - DNA, 392 bp, Triticum aestivum
  Clone ID: PAT_TA_64122
cgtgttctccgacctcttcccgcacctagcaaatggtaagccaagaaagccaactgacggcattgcacatgagcagacaaagaaatgctgctgctgctattcaacgagatcgattctaacctcaaagcgcccagatcccaatgacgagctcgtcgacgatgtccaccacgttgcagtcgcgccatgggccccgaatgcgaaccccgtcgacatggcctggtccgttgtgccggtactgcgatcccgggacttgtcccattcgaccatccagttctcgccctcctcgtcggcgcttaaaagcttggccgggaccttgcaccagggggccccttcgaagttgtccagccccagccgaaggggaattgaaaccctggtcctgacggtggttccct

SEQ ID NO: 64123 - DNA, 420 bp, Triticum aestivum
  Clone ID: PAT_TA_64123
tgagccctgtagggatgcgggccacattgagaacgaatgacgccgctgtccacaacccaaagaactgggctaccgccgatgatccatcgcgtgcgtgaaccatgatctattctttacacgttgcggctgcctggactaccctgatgagtgcttgttcagccaactggcctagagtggccccctgggccattgttgatatgaggcggagttcatgtataatgaagaacagaccgcccgactgcgttagctgggagatcaacctatctgggatgaaagacgggcactgacactacaagagacgctgtttctggtggtacaaacctaacactgtctacgatgactcatgggcttaagacgtcactggccctcacaagtcatctaggggtcggaagaaagcctagggttgggcaagggataact

SEQ ID NO: 64124 - DNA, 322 bp, Triticum aestivum
  Clone ID: PAT_TA_64124
aagccaaaagagttaactgctgtgatcgcacatgagatatacgaagtaacgctggtgatgctgttcaaggagatcccatgtttcattcaagcgcgctgatgctaatgactaactcttgatagatgttgaccacacaactggcgtaataatggcccttaagggccactgtgtctatgtggacgagtccattacgaaagatctgctgattggccacttgcgctatttgagcgtacaactgtacccctatttgagggctgttgagaacaaagaagaaccgtggctcagggtggcccatctgaaataggcactcgcagacacaagg

SEQ ID NO: 64125 - DNA, 312 bp, Triticum aestivum
  Clone ID: PAT_TA_64125
gacctctttccgcacctagcaaatggtaaggcaagaaagccaactgacggcattggacatgagcagacaaagaaatgctgctgctgctattcaacgagatcgattctaaccttaaagcgcccagatcccaatgacgagctcgactacgatgtccaccacgttgtcagttacgccatgggccccgtatgcgaaccccgtatacatggactggtccgttgtgcctgttctgttatccggctacttgtcccattcgaccatccagatctagccctactctttggcgcttaagagcatctccgagaccctgcaaca

SEQ ID NO: 64126 - DNA, 305 bp, Triticum aestivum
  Clone ID: PAT_TA_64126
tccttgcattgcccaaagatatccccaaccaagattgcttctcctgctcaattggaaagggctggaggctcccatccaatacaacggcatggactacgtattgctctaccctcacactggataggagacctccatggacaaacgactgaaaaacatgctatacgtgctcacggacatgatcaccataatggatctatcctacatgcacttcaggtatccacgaatgaggctacatgaggctactgcccaggagcaggactctggaaatgaggaacgaagatgcaccagcgagggttggcttccca

SEQ ID NO: 64127 - DNA, 314 bp, Triticum aestivum
  Clone ID: PAT_TA_64127
gcataatttagttcctccaagtgatactcgtaatggatctgcacctacaaatctctttgtttctcagttgggtaatgagacccttataccccattcatcatcatcaaaccaactttcaaaagagtctccattgatggaagagactacggtcttatcaaggtgtcagcgccaatgaatacattagctggacaacctcaccaacttgcttcacgagcatttggtcttgacccgccaaggaaatgccatgagtaggaaccggatccaggaaggaatctacatggccatctgtgcgttgataatcctgacactcggca

SEQ ID NO: 64128 - DNA, 174 bp, Triticum aestivum
  Clone ID: PAT_TA_64128
gggctatgggccacgtgcgatctccaagaagtactcagaactctttgttgctgttgcaaaaccctgacgagacactggacgctcaatgggcgtactgctggcttcagcctagagacctgctacctatgagtgagagagccccacacccgttttttttgttgcatcaacccacac

SEQ ID NO: 64129 - DNA, 418 bp, Triticum aestivum
  Clone ID: PAT_TA_64129
acactttgtcacatataggggatgtggatatctttaacaactaaggttcctgatgataacatcaaagatccgcgggcgttggtccatctcgagtagcttacaagaactattgcgttcatatacaaatgacaagacctttactagacttcacctggttgtatagcgtactacaggcccagaatgctacctccgtttataagggcaggaacgctgtgtctgttctgttatacagacactcgaaccaaaagaccatagcgtccatctagctcctatctagtgcgaaaaaggctaactagaaccacgtgacacgctgtctctgtggagacgaacctacccattcgtaccaggcttgagaggcatgagatctcacagacactcacacgttatacacggcttgaaagaaactgtagggctgggt

SEQ ID NO: 64130 - DNA, 275 bp, Triticum aestivum
  Clone ID: PAT_TA_64130
ttactatagggaaaggtgggacgcctgccaggaccggcgccggattgcctggccatccactttccggttttggtgctgctgctatacaacgggatcgctttttaccttatagggcccagatcccaacgacaagcgtctttacgatgtccaccacgttgcagtcgctccatgggcccccaatgcgaaccccgtggacatggcctggttcgttgttgcctgtactgcgatcccagcgacatagttctattcgaccatccagttctctcccttctcgg

SEQ ID NO: 64131 - DNA, 382 bp, Triticum aestivum
  Clone ID: PAT_TA_64131
gctctaggaggatcacacgcttacgcgcgcggggatgcgacgatgtatctgttatatcgggtgacgttgattgaatgaccctggacgagtgctttacaccgacaacgagtgggaaaacggtgcctttacccacacttgattgccttggaggaatccatgattaacgaggatgtgattgacgcgacataggctccgctgccgagacacaacttgaccaccagatgtcacacctgaatggacaaatggagacaacgtgcctgctagcgtgtggatatagctgcaggaggagctgggggaccccacggctagaccggtccatttgcgagggtcttcaacgccgctactgggaatatcttggctttatttatcttaacggtcgtgg

SEQ ID NO: 64132 - DNA, 353 bp, Triticum aestivum
  Clone ID: PAT_TA_64132
gcctcatccctgcatggatggagacggacaaggcaaaagcgttaactgacgtgatcgcacaccaaacatacgagggaacgccggtgatgctattcaaggggatccaatgttacacttaagcgcccagatgccaatgactagctctgataagatgttcaccacacaacaggcgcgccaatggcccttaatgggcaccgcgtctacatggacgagtccattgtgcaagaactgctaaccggccacttgcgctatttgagcatacaactttagccctacttgagggtgcttgagactaaagaagaaccctggctcaggggggcccatctaagataggcagtcacagacacaagggc

SEQ ID NO: 64133 - DNA, 391 bp, Triticum aestivum
  Clone ID: PAT_TA_64133
agcgggaaagcattaacaactcttgtccgtttccgtaaaaacgggattttcccgggctttccccggccgtgcctcaccagggatcacttagggtcagttatgcccggttgctgacccttgattagcctttttacgtcaacttcggacaactatgggtccttttgggcccttggttcctctggggaggattccatggcgaaagatgaacttattgcccgtcttcgctcggtgggtgtaccacctgacccttctatctcgcctcgccgggaccgaagaagaactggggcgtcctggtgcttcagccggagaagcttttatatgaccctgggcctaagttggcaaatgaccgccctttcccacccctttaatggggaaaccctgggaaaaccca

SEQ ID NO: 64134 - DNA, 429 bp, Triticum aestivum
  Clone ID: PAT_TA_64134
ggcaagccaaaagagctaactgacggcatcgcacatgatttttcaaagaaatgccggtgctgctattcaaggggatccattgtaacctcaaagcgcccagatgccaatgactagctcttatacgatgtccaccacgcaacaggcgcgccatgggccccgaatgcgaaccgcgtctacatggccgggtccgttgtgccggaactgctatctggccacttgccccattcgagcgtacaactctagccctccttgtgggcgcttgagagctacgacgagaccctgccacaggtggccccttctaagctaggcagccacagacgcaagggcattgagatcctcttgctcgacgttgatcaccttccgatagacacagagttcgtcaacctgcagagcgaattgactaaacggctggagagctgcgagggcacc

SEQ ID NO: 64135 - DNA, 449 bp, Triticum aestivum
  Clone ID: PAT_TA_64135
cttccccaaaaatttccccaacctcgctcgcttctcctcctcaattggggagggagggaggctccaatccaatccaatccaatccaatccaaaatcgaatcgaatcccactggattggagccagccagcgagatacgactcaaatccgtgtcgtccgcgcgcgcgcgcatgaagacgaagctgctctactctccttgtgcttgaactagccacgactctgcctcctgctgcttcctgcccagtagcaggagccgggcacggagggaggaagatgcgcctgccggtgctgccggcgtacaccttcaactccagcaccgtcgatcgcccgccgacgacgacttaggatcctgctcctcctgctcctcctactactgagggggcagcacctgcagtctacacagtgttcctcaacatctacgacatctcccccatcaacaactacccatact

SEQ ID NO: 64136 - DNA, 391 bp, Triticum aestivum
  Clone ID: PAT_TA_64136
atctctgtacctagtagagggtatggacaagatagccaactgacggcattgcacatgaccttacaaagtcatggggttgctgccatccaccgtgaccgacagtaaccttatagtgcccatacccaaacgacaagctcactaacaatgttcacgcacgttgcagtcactccatgtaccgcgaatgccatccccttatacatggactgacccgttgtgccttttctgttatacacatactagccccatgcgaccatgcacatctagccctacttagtggcgcttaagagatctagcgctaccctgagacactgtgtctgttggaaccaacctaaccccttctaccaaggttaatagatcttagacctcaccgacactcacatgtcatttgagg

SEQ ID NO: 64137 - DNA, 523 bp, Triticum aestivum
  Clone ID: PAT_TA_64137
gttctccgacctcttcccgcacctagcaaatggtaagccaagaaagccaactgacggcattgcacatgagcttactaagaaatgctgctgctgctattcaacgagatcgattctaacctcaaagcgcccagatcccaatgaccagctcgtcgacgatgtccaccacgttgcagtcgcgccatgggccccgaatgcgaaccccgtcgacatggcctggtccgttgtgccggtactgcgatccggcgacttggcccattcgaccatccagttctcgccctcctagtcggagcttcagagctttgccgtgaccctgcaacaggaggccccttcgaagctgtccagccacagccgcatggggattgagatcctcgtcctcgacgttggttcgctatcgctagacacggagttcgtcaacctggagagcgaattgaccaaacggctggagagcggtgagggcacctttttcaaggaccattcgacaagccctaatgccaaagacgtctccaacattacatcccgagga

SEQ ID NO: 64138 - DNA, 216 bp, Triticum aestivum
  Clone ID: PAT_TA_64138
ggatttggaattctttaacaactaagggtcctgagaataacattttaaagtcaagggcttttgcccatcttcaaaaactaacaagaactctatctttactttacaaaaaccaaaacctttactagactttttctgcttattttaacttactttaactaagaggggtgggaccttttttttatgaagtgaatcaaccccttttttttttttttttaa

SEQ ID NO: 64139 - DNA, 319 bp, Triticum aestivum
  Clone ID: PAT_TA_64139
accttctctagccaaagaaagctgaggcctttctatttccccacaccacccaccagtctccttccgcctgcccccacctttactggtcggtaccggagaagagatcctccttcctctgacgccagcggccatgtccgacacgcgggtacttgcgctgctggcggcggtggaactggtggccgccgcgccggtgcgcgcgcacgcaggggcggcttgcgcggaaaaaaggaacttcaagaacccggtgaacgcggcctgggccgaactgaccaaacaggttgcttccaggctcagttggaacaaacctcccaaaaccccc

SEQ ID NO: 64140 - DNA, 310 bp, Triticum aestivum
  unsure (1)..(310): unsure at all n locations
  Clone ID: PAT_TA_64140
ttatcgaatccttcgcgcnggngncaccaaggagaaagattaagacatggagaatggagaacgccgcnnacgccgccaanancngcaagaagcccgccccacaaggcnacaagagcggaagnnacacaaaccccccgcaggcgnagggacacnagnccagccgcgggaggagaagcgncggcnnacaaaacccaggngccnagccccaaaanagcngaccttncagaacnagagcgaggccgcgcccagaaaagaccacgccaagcactccgnacgagaacgcncangaaacaaanaaagccttctcctc

SEQ ID NO: 64141 - DNA, 320 bp, Triticum aestivum
  Clone ID: PAT_TA_64141
ccggacacggaagccgggggcgacccagctcacgcatatcacggaggagggccggcggcgacgccccggaagagagcaacccgcgaacacgccgagccccacccaggcggacacgcaacgagcccgacagcggggccacagaggagagggaaccccaggccgacaaacgaggaacccacacccagcaaagccacgcagacgacaccaagcaacaagggcgagcaacacgacgaggccagcgggcgcgcggaacggacacgagaaaaacacggaaaacacaaaccaagaggacacaaaccaaaaaaacaccaacaggggcg

SEQ ID NO: 64142 - DNA, 460 bp, Triticum aestivum
  Clone ID: PAT_TA_64142
acgtctagaagtccattcaccacagcgagaaggccttaggtccgggcagctacataccgggcgcgacgaacggcagcaattcggctgggagatcaggcgggatgcactcgatcggcgaccacaccgtcattgagctcaaggggcccgacagaaccggccttctctccgagatcttcgtcgtgctggaggagctacagtgcaacgtcatggcggccgaggcgaggacacacacgacgagggtggcctgcgtgttgtactttaactacgagtcctccgcgcacgacatcgaggactcgtgccgcctgcccacgatcgatgagcggctgttgcacgtgctccacaggcactgcggtggagactacgactactgctactatcggggagcgcacactaactggttcgacggatgcacccacgtggaccgacggctgcaccagctgatgcacgcccacatagacct

SEQ ID NO: 64143 - DNA, 436 bp, Triticum aestivum
  unsure (1)..(436): unsure at all n locations
  Clone ID: PAT_TA_64143
aacgagagcgttagagacctcaaagcgcccagcccccaacgacgagcgagncgacgagggccaccacgnngcagccgcgccaggggccacgaaggcgaaccccnggaacatggccagaaccgcngngccggcaccgcgaaccggcgaccaggcccattcgaccatccagtactcgcccttctcgagggcgctaaagagctccgccgggaccctgcaacaggtggccccttagaagcagaccagccacagccgcagcggcaatgagagcctaggaccccacagagcgtccctagcgctagacacggagtacgagaacctggagagcgaaacggcaaaactgctggagagcggcgagggcgcctcttacgaggaccatacgagaagccccaaagccaaggacgttgccgacatgacgcccgaagagcggctagccacg

SEQ ID NO: 64144 - DNA, 470 bp, Triticum aestivum
  unsure (1)..(470): unsure at all n locations
  Clone ID: PAT_TA_64144
ccacgaaagccaactgacggcaacgcacacgagatgacaaagtaacgccgcagcggccacgcaacgagagcgaggggaaccaaaaagcgcccagaccccaaggacaagcnacgcgacgaggaccaccagcgggcagccgcgccaagggcccccgaancgccaacccacgcaagacaaaggcacagggcccgaagagcacggcacgcgccgaacccagcgacccagacccagacgaccagccagngagacggccgccccgagggcgcgaaagagcaacgacgagaccccgcaacagggggccccgacgaagaagccagccacagacggagcggcaaagagagcccccgaccccacggagacccccgaccgccagacacggagcacgacaacccggagagcgaacagacaaaacggccggagagcggcgagggcaccccaaacaaggagcagccgacaagccccaaagccaa

SEQ ID NO: 64145 - DNA, 490 bp, Triticum aestivum
  unsure (1)..(490): unsure at all n locations
  Clone ID: PAT_TA_64145
cccagcgaaaggccagccaagaaagccgacggacggccagctcaggaatgacacagaaangccgccgccgcgaaacaaggagagcgagacgaaccgcaaagcgcccagacccaaangacgagcgcggggaccaggggcaccagccgggcagaacgcgccaagggccccgaaagcgaacccagaggacacggcccgggccgangagccggaaccgcgaaccggcgacaaggaccaaccgaccagccacggcncgccccccgaggcggagcaacagagcaccgccgagacccagcgacaaggggccccaaagaagcaggccagccacagacgcaagggcgacgagagccgagagcacgacgcgggnccccaggcgcgagacacgagagccgccaaccaggagagcgaanggacaaaacagccggagagcggcgagggcaccgacaacaaggaccaaacgacaagccccaaggccaaggacgccaccaacacg

SEQ ID NO: 64146 - DNA, 209 bp, Triticum aestivum
  unsure (1)..(209): unsure at all n locations
  Clone ID: PAT_TA_64146
cggcccctgaaaccacaagtgccgaacataaggggaaaccacccacgcagggaaaaacgggcaggggcaaggggcacnaccagccgcacccccaaanncagagagccagggcagaagacccaccggagacgaggccacgacggngaaacagcggacacaaacgggagcaaaccaagcagaaaaaacagccaaacaaaccggcaaagagc

SEQ ID NO: 64147 - DNA, 539 bp, Triticum aestivum
  unsure (1)..(539): unsure at all n locations
  Clone ID: PAT_TA_64147
ccaggatggatgccggcacccagcaagagggcagccacgacaagccgactgacggccgagttttggagcttatacagaaangccgctggtgcgattcaacgagagcgattctaacctcaaagcgcccagagcccaacgacgagcgcgtcgaccaggcccaccaggttagcaacggcgccatgggccccaaaggcgaaccccgaggaatggccaggaacgatgagcctgaacggccatccggcgacttggcccatacgaccatccagtgctggccctcctcgggggagctaaaaagaactgcgcgcgaccctgggacaagtggccactgggaagctgtgcagccacaggctgagcgggaatgagatcctcgatcacgacgctgctgcctttgcgctcgacacggtgtccgaagcacctggagagcggaacgacaaaactgctggcgagcggcgagggcacctataagaaggaccatacgacaagtcccaatgccaaggacgttgccaacatgacgcgcgacgagcggctagccacggcgc

SEQ ID NO: 64148 - DNA, 413 bp, Triticum aestivum
  unsure (1)..(413): unsure at all n locations
  Clone ID: PAT_TA_64148
attaaaaccttactgcttgattgctgaaaccacaggtttttgacttattggggcacnagccacccagaggaaacggagcaggggcatgcggcactatgacccgcacccaagagngcagagagccagggcagaagaacagcgggcccacagcgcacgacggcgggacagcngcacaaaagggagcaaacccagcaaaaaaaccagncacacaacgcgccacagagcaccaaagcccgacccgagccgacgngcggaaagaggagatacgaagagccgccgcaaccagtagcccatgggaaaaacagctcagacgcgcgagcaagccatgagagactggagctgacagtcaccaccgagcgcttgggggtgcgatagtattcccaaaaatcaaagaagcttgacttttatgaaac

SEQ ID NO: 64149 - DNA, 425 bp, Triticum aestivum
  unsure (1)..(425): unsure at all n locations
  Clone ID: PAT_TA_64149
gaacacgagggaaccggacgcgcagcagagaggcgcgccacgacagccgacggagcgcagaagctctggagcggacagggcaangccgcagcgtgcgatacaacgagagcgagccgaaccgcaaagcgcccagaccccaacgacgagcgcgccgaccaggaccaccagggtgcagacgcgccaggggcccccgaaagcgaaccccagggacaaggcccggaccagtgagccggaaccgcaaaccggcgacaagcaccaagcgcccacccaggcccagcccgaccggaaagcgcgaacaagaactgccggggccacgaacccggaggacacgaaccagacacacaccaccacagcgaacgggaaacgaccccacaaacacccccaagcaacacagggctggaaagaaagaccaggagagggcacgg

SEQ ID NO: 64150 - DNA, 395 bp, Triticum aestivum
  unsure (1)..(395): unsure at all n locations
  Clone ID: PAT_TA_64150
ccggggcgacccacgttgccgcgttggtcccgcngacgcccacgaacaaggactttgaaaaaccgaagccggcncacaccacagcgagaaacggaggcgagaagcccacgagcgccacaagaagaggggggcaccacaggccccaaaccaagaaaacaacagnccgacnaacaggaaccccgaggaaaanggggcgaaggcagcccgagacgagcccgggaaaacaccgaccgcacagaccccaaaagcccaaggcgccccgacaggaaaanacaccccagcgaagccaccaacaggaccccgaggacggaganacaccaccgacagccagcccaagcaccaaccgcgcaccaacaaagacagggagaaaggaggaagcaangacaaaaccccaa

SEQ ID NO: 64151 - DNA, 280 bp, Triticum aestivum
  unsure (1)..(280): unsure at all n locations
  Clone ID: PAT_TA_64151
caaaagggcagccacgaaagccgaccgacggcaccgcacaatagcaatcaaagaaacgccgcgcggccaggggcgagagcaaagagaaacgccggagcccacaccccaacgacgagcgagncgacgaggaccaccacagcgcagacgggccaggggccccgaaggcgaaccccggcgacaaggccgaggaaagacgagccggaacgagcgaacacgggcgacgaggaccaaacagaccagaacagagcaagcccaaccgacggggagagcaaaaaaagaa

SEQ ID NO: 64152 - DNA, 469 bp, Triticum aestivum
  unsure (1)..(469): unsure at all n locations
  Clone ID: PAT_TA_64152
caaccccgcaaagggccagccaagaaagccaactgacggcanngcacaatagcagtcatagaaangccgccgccgccanggaacgagatcgaagctaaccgcaaagcgcccacancccaangacgagcgcgnngacgaggaccaccacgcggcagacgcgccaggggccccgaaggcgaaccccgacgacacggcccggaccagagagccggaacggcgacccggcgacgaggcccaaacgaccaaccagcgcacgcccgccgcgggggcgccacagagacacgccgcgaccccgcaacaggcggccccgacgaagcagaccagccacagccgcagcggcaaagagaaccacgaccacgacagagccccccggccgccagacacggaggacgacaacccggagagcgaanagacaaaacggcaggagagcggcgagggcaccnanaacaaggaccaaccgacaagcccc

SEQ ID NO: 64153 - DNA, 480 bp, Triticum aestivum
  Clone ID: PAT_TA_64153
tgccgcagctgcaattcaccgcgagcgcttctaacctcatagagcccagagccccaccgacgagcgcgtcgacgaggtccaccagcttacagaaccgccaggggccccccatgcgaaccccgtcgcaagccctggtccgtagtgcctgtacacgccatccgagcgacttgtgctatgcgaccatccagttctagccctcctggaaggagctaactagaactgccgggaccactctacaggtggtcactaacaagctactcaaccacaggcgaagtgggaatgagatcctcgaaccacacgcaggttctcttgcgcttgacacagagtccagcgacctgtagagcgaaacgacacaactgatggggagcggcgagggcgcctataacgagggccctacgacaagccccaaagccaaggacgttaccgacatgacgcccgcagagcggctagccacagtactatggcagatgcagcacgctc

SEQ ID NO: 64154 - DNA, 273 bp, Triticum aestivum
  unsure (1)..(273): unsure at all n locations
  Clone ID: PAT_TA_64154
gagcttctgcattatttcacggcgaccgccggcaaggacgagaagaacgctctcggaggcgaggcccaaccgaccaaggcccncgacaagggccccacgnagaagaacccggacgacgcccccggcccnaacacgggggagagcacgacggagccngacacggacgccagcggacagacgaacgagaggagaagcacccagaagnggccggacagcggggagaggacaagcccgaagacgcagcagccacgggcgcaccaaacgcaggcgccc

SEQ ID NO: 64155 - DNA, 292 bp, Triticum aestivum
  unsure (1)..(292): unsure at all n locations
  Clone ID: PAT_TA_64155
ggggccagccacgaaagccgactgacgggctagcacatgagcattaaagatatggtgcagcggccacccaccgagagcgagagtaaccttaaagcgcccagaccccaacgacaagcgcgncgacgagggccaccacggnagcagcgccccacgggccccgaaggcgaaccccggggacaaggccgggaccgccgagccgggacggccagccggagacgagccccaagcgaccaaccagngctcgcccgccccgacggcgcgagaaagaaccgccgggacccggagacagggg

SEQ ID NO: 64156 - DNA, 321 bp, Triticum aestivum
  unsure (1)..(321): unsure at all n locations
  Clone ID: PAT_TA_64156
agccaagacagccgactgacggcatagcacacgagcagataaagaattgccgcngcngcaanncaacgagggcgangcgaaccggaaagcgcccagaccccaacgacgagcgcgnngacgaggaccaccacgccgcagccgcgccaggggccccgaaagcgaaccccggcgacacggcccggaccggagggccgggaccgagaaccggcgacaagggccaaccgaccacccagggcncgcccgccccgacggcgcgaaagagcaccgccgggacccagcaacagggggccccgacaaaggaagcccaaccacagccgcagc

SEQ ID NO: 64157 - DNA, 368 bp, Triticum aestivum
  unsure (1)..(368): unsure at all n locations
  Clone ID: PAT_TA_64157
taacaactaaggggcttggatttaacattcnaaagcttagggtttttgcccancnccaaaagccaacaagaacgctttcggggcnaaacacagcccaaaaccngnacgagacgggggccgcggcnanagcacacgacacccagaggcagcaaccccggcagaacaacgaagcaaccccggngcgncnggacgagaaacacagcccaacccaaagnagaagcgcccacccaggccnaacnaggccgaaaaaggcgaaccagaaccacaggagacacnancncgggcgnnacgaaccnaacaccgccnaccaagccnaancggaaaaagaccncacaaacacccacaagnnaaanagggcgcgaaagaaa

SEQ ID NO: 64158 - DNA, 163 bp, Triticum aestivum
  Clone ID: PAT_TA_64158
cagaaggcgaaccgcggaggcaagcacgaggaacgacgagacggaacggcgacccggggacgcggggagaacaaccaaccagggaaggccccccgacggggagcgaaaaagaaccggcgcgaacccgggggcagagcggacccgaggaaagccagcgcacacc

SEQ ID NO: 64159 - DNA, 296 bp, Triticum aestivum
  unsure (1)..(296): unsure at all n locations
  Clone ID: PAT_TA_64159
cagccaagaaagccaaccgacggcatcgcacacgagcaataaagattgccgccgngccaccaacgagagcgagggaaccgaaagcgcccgagcccacgaccagcccgnngcgaagccaccacgacgcagacgcccaagggccccgaaggcgaaccccgaagacgggacaggccgaaggccggacagcgaccggcgacgagcccaaacgaccaacagagccgccccccgggggcgcggcagagcaacgccagaccccgcacaggcggccccaagaagcaggccgccacagccgagcg

SEQ ID NO: 64160 - DNA, 449 bp, Triticum aestivum
  unsure (1)..(449): unsure at all n locations
  Clone ID: PAT_TA_64160
aagacagccgactgacggcatagcacangagcagctaaagatttggngcagcngcnanncaacgagagcgantttaaccgcaaagagcccagaccccaccgacgagcgcgnngacgagggccaccacgccgcagncgcgccaggggccccgaaggcgaaccccgacgacaaggcccgggccgaagnggccggacagcgaaccggcgacaaggcccaagcgaccacccagnncncgcccgccccgaaggcgcgaaagagcaccgccgggaccccgcaacagggggccccnaagaagccagccagccacaggcgcagcggcgaagagacccccgaccccgacgcagcgcccccaccggcagacacggaggncgggaacccggagagcgaaacgacaaaacggcgggagagcggcgagggcaccnnnaacaaggaccanccgacaagcccca

SEQ ID NO: 64161 - DNA, 177 bp, Triticum aestivum
  unsure (1)..(177): unsure at all n locations
  Clone ID: PAT_TA_64161
ccaagggccccaaaggcgaaccccgcggcgnggccgaggaacgagagccggaacgcgcganccgcggagcgagggccaaacaaccacacagagatggcccnccgccggggagcaacaaagaaccgccgcgacccggcaacaagcggcccgagggaagcggaccacccacagccgcag

SEQ ID NO: 64162 - DNA, 231 bp, Triticum aestivum
  unsure (1)..(231): unsure at all n locations
  Clone ID: PAT_TA_64162
gaggcggccaccaggccagagcagggaaccaaccccgggncggggagcaggcaaacacaacccaacccaaaggagaagcgcccacccagnccganccagnccgaaaaacgcgaacnagaacgacaggagacacnagccggggcgcacgaacccaacacncacgaccaagcggaangggaanaagaccccacaaacacacacaagngacanagggccagaaagaaagcccag

SEQ ID NO: 64163 - DNA, 236 bp, Triticum aestivum
  Clone ID: PAT_TA_64163
agcagatgagagattcctggcgaaggacgagaccaaacaggaaccaggggagatgaagaccaaaaggccaacccgcaaccggcggccgaggcgcacggaggagacgacaagctagcagggcgaaacgggaaagagccctaaaccggccaggcggcaagagactgacaaacagcacccagccccaagagccagggcccacccacaccaaccagatgcgcctccagccaagtggaaca

SEQ ID NO: 64164 - DNA, 258 bp, Triticum aestivum
  unsure (1)..(258): unsure at all n locations
  Clone ID: PAT_TA_64164
ccccacccacaaccggcacgagacggggccagcgccaccagcggacagcaccgagaggggcccaccaggccaaaccagagaaacaaccccgggccggagagccgggaaacacaccccaacccaaaggacaagcgcccacccagncctagccagcccgaaaagagcgaacaagaaccgcaggagacacgaaccaggggggcacgaaccaaacgcncaccaccaagcgcaangggaacaagaccccacaaacacacacaa

SEQ ID NO: 64165 - DNA, 233 bp, Triticum aestivum
  unsure (1)..(233): unsure at all n locations
  Clone ID: PAT_TA_64165
aaccgcacggcgcccacaccccaacgacgagcgcggcgacgagggccaccacgnngcagccgcgccaggggccccgcaggcgaaccccgaggacaaggcccggacacgaggggccggacagcgaaccggcgacaaagaccaagcgaccacccaggcctagcccgcccggagggcgcgaaagagaaccgccgggaccccgcaacagggggccccgaagaagccgcccagccaca

SEQ ID NO: 64166 - DNA, 316 bp, Triticum aestivum
  unsure (1)..(316): unsure at all n locations
  Clone ID: PAT_TA_64166
acggcgcagcngcaaaggggaacgagagatgttaacctccgggacccccccccccaccgacaagagactggacgaggtccaccagcttacttaaccgcgaggggcccaccatgcgaaaccagtgaaccaggcccggtccgttgtgctggtacacgcatcccagcgccaaaggccaaagcgcccacccagtcctagcccggccgaaaagcgcgaacgagaactgccggggacacggtacatggggacacgaaccagacgctcagtaccagagcgaaaggggaaggagaccctacaaacactcacaggtgacataggg

SEQ ID NO: 64167 - DNA, 501 bp, Triticum aestivum
  Clone ID: PAT_TA_64167
gcgcttccttgccagggaaaacaccaccgcacatctgcccggccaagtagcagcagcggcatccatggcccccaaggcggagaagaagccggtggcggagaaggccgagaagaccacggaggcgaagaagaccaaggccgagaagcgaccgccggcgtccaaggagggcggcgagaagaaggggaagaagaagtccaagaagagcgtggagacgtacaagatctacatcttgaaggtgctgaagcaggtgcacccggacatcggcatcttctacaaggccatgtccatcatgagctccttcatcaacgacatcttcgagaagctcgccggcgagtccgccaagctcgcccgctacaacaagaagcccaccatgacgtccagggagatccagacgtgcgtgcgtctcgtgctgcccggcgagctcgccaagcacgccgtctgcgagggcaccaaggcctgcaccaagatcacctgctcctagatgggctgttccctgtcatg

SEQ ID NO: 64168 - DNA, 434 bp, Triticum aestivum
  Clone ID: PAT_TA_64168
gcgggttgagtcagagtatgaaactgaaggcgaggacattgagcactcgcccaccggtggaagggaagagctggatgaggagggatgcatctcgggccctggcattgatgtcatttgaccttaatgacctgactggagacttggaaggcctgagcccagacgaactggaggttttacaagactgggaagagaagtttaaagagaggtaccctgtggtgggtcatcttcctggtgaaaacggaacagctggtgcccagcctgatcacgaggcagagaaggcctaactctgtgtctgggttcttgtcccgttgcctgtaagttgatgtgtcttttactactgctggactgtgagcggtagagagatgtaatgcgctgacaggtgatgttgtttgtatgtgtgctgcatgagtgtgtgctactgatgcacctgcttt

SEQ ID NO: 64169 - DNA, 545 bp, Triticum aestivum
  Clone ID: PAT_TA_64169
cccacgcgtccggtttcagtctcttgagcttttatgttcaggaagatttgctacaagtttgagcacacatttgacactctgaatgccaatgttgtttgacagcacacatttgacactctgaatgccaatgttgtttgacagcacacatttgacactctgaatgccaatgttgtttgacatgacacatttgacactctgaatgccaatgttgtttgacatgacacatttgacactctgaatgccaatgttgtttgtcagtttgtcacttagcttttattatatgctcagcaagatttgatagaaggttgtgcgcctatttgacactctgcatgtttctttgcagttaccacttgtaccactgagagactgttggggcatttcaggccagactgcacccgagctgttcatcatctgtcgtgcaataaactggatccatgttgttgcccttgactaatgagtcgctattgtgatacatcctgtgtaaatgttttgctggctggatgggtatcgctggaacatgaaagtttaccttactgatgcatttt

SEQ ID NO: 64170 - DNA, 125 bp, Triticum aestivum
  Clone ID: PAT_TA_64170
agccggcggaacagggctggaggtcctctagtgggatgtactatccaaccaagctggtgattgtccctgaaaaattatggtacagccaactgtgagtgtcttcgtcctggacttgactttgccaa

SEQ ID NO: 64171 - DNA, 433 bp, Triticum aestivum
  Clone ID: PAT_TA_64171
cggacgcgtggggggcgaggcgagcgagcagcaactccaacaagctacgcagcacacaaccctctccacccccagcaatccatccatccaccccacccccaccccgttttcctcttccctccccggaggattccctgcccgagctcgacaatggcaaacgcttcatcaggagctgggatccatgatgactgcatgctgaggtgtcgggagctcaagtccaacaggatgcaccgtttcataacctacaggctggagaaccagacggagggcattgtggaccaaactggggagcgtgaggcaacctatgacgacttcaccaagaccctacctgagaacgactgccgattcgcagtgtttgacttcgacttcaccaccccggaggatgtgccaaagagcaggatcttctatatcttctggtccccctgcacggcaa

SEQ ID NO: 64172 - DNA, 363 bp, Triticum aestivum
  Clone ID: PAT_TA_64172
atgtgttggcttctcctccccactcagtcctcggttcccggcccggttcggttcgttagggtttagtagtggggaagaggaggaagaatggcggacgtcgagtaccgctgcttcgtcggcggtctcgcctgggccaccgacgaccagtccctccagaacgccttgttcaagtacggagacgtcatcgactccaagatcatcactgacagggagacgggccgttcccgtgggttcgggttcgttaccttcgcgtcggacgaggcgatgcgccaggcgatcgaggccatgaacggtcaggacctgtacggtcgtaacatcaccgtgaacgaggcccagtcccgccgctacggcggaggcggtggc

SEQ ID NO: 64173 - DNA, 418 bp, Triticum aestivum
  Clone ID: PAT_TA_64173
cggatgccaacgcacaggcaaagcattacgcctgtgcccgatacccgaaaaattgcattaccaccgccgatccggagtcgaagatgaccaatgaacaaccagtaccgctgatgcttgtgcctgaccaggatgagttcgtgcacctgcaactggcatggtcatggcccttcattgccattgtgtgtatgaggacgagaccatagataaagaggaagtgcgtgtccgcttgctgtgtgatcaacaacaactggacctgaatctgaccctgacgaaagaaaaacaagaactgcctgctgccagagctaaaagcatgagctatgatgacacaagacctaagtctgaactgggcagctggtctacaacgtacagactggtgaatcccaaaaccctcccaactcacaactttagcagcacatac

SEQ ID NO: 64174 - DNA, 295 bp, Triticum aestivum
  Clone ID: PAT_TA_64174
aattttaaaatttaaaaaaaaaaaagagaaaaaaaagaaaaaataaaaaaaaataaaacatgataaataggcctggggagttagtgtacagacacctggcgtccccatggtccttcggggcctttgttttttgggggggccgtttttgggttccctggtttcggcccggcggcctccggtttttggtttttcttttggggccccttgtttgttttttcggggccggttttttccccggcggtgggggtggcacccctgggggccgccctttttgtcccttggtactaatctccct

SEQ ID NO: 64175 - DNA, 303 bp, Triticum aestivum
  unsure (1)..(303): unsure at all n locations
  Clone ID: PAT_TA_64175
gccctgcagggacgcggacgcacagcgtgaacgcctttacgcctttgcccgataacccgaaaaatccgggtgtaccatcncgagcgatgccggagcgcgacgagtgacatccaatgattcaccgcatgcacgctgtgtggctgactgcttagaacgtgaggagtcggacaacgggcatctggatggaccatgggcgccatgggccatctgtggtggagggcatgacgaatgatgaactgagtgccggtctcccgtcgttggttgaacaactgacacctgaagccagactgacggcgaccaaag

SEQ ID NO: 64176 - DNA, 287 bp, Triticum aestivum
  Clone ID: PAT_TA_64176
gtacaaccttcttccttcctccttgatcgatcgctccatcggcccccggtcagagcgcgatcgccggccggccagagcaggcgcacgcagcaatggggctcacggtgcgcatcgtcgtcggcgccctcctcctcctcctcctcctggcggcgccggcggcggcggcgggcgagtgggactcgccggagtcgtgcgccacccctgtgagcgtgtaggcggcgtgcctgggcgcttccgtcacgcaccaccgcgtggactacgagcactgcgtgcggttcctgtactcg

SEQ ID NO: 64177 - DNA, 496 bp, Triticum aestivum
  Clone ID: PAT_TA_64177
cctttgctttactgttttacttaccctgtgttgtcgtcacatgttatattttcttgtctcttttttatgacttgttgggaaaggggagcccacaggacgacgcccggagcacgctgacgccgaggaacgccgttaggcgcgagctgcagaccacaatcacggcagcgacgtctacacaagcgcatcaaaagcccgggcttaggccgccaccgtaaatccgcgaaggaccaccccccgaatcgatcggcggaccggaatgctccgttccgcatccgaccaggacgcaacgccggcccccatccgcgttcctcccgacaatttcaagcacccctcgactctatcttcaaagcccttctcatctttaccaccgaggcacctagcacgctaatcggtcgctcgcccgcatttcagccttggacggaatttaccgcccgaatggccgccccacaccgccgaacggcctaggcacaggcggacacggttaccttcgcccctt

SEQ ID NO: 64178 - DNA, 580 bp, Triticum aestivum
  Clone ID: PAT_TA_64178
agacacatggtaatttctttcttttgttgggttcaaatttactattttagtatcgtttttttgttttaatttctaacatacagaccacacaatttcaactaagacaaagccaaagcatataaaacatcggcccaagtagcaaccaaagcccgttatggacaggacacggtccaagccgcacaaggaatggtctgtgtggtcgtgggattgtaaccaccaccaccttcggtgaatggggttggtgtagtggtgccaccagctacaccgtttgaagagttctacgcgactgtgactgcgagctttatactcttcagcgcattggctcggtgatttcacagattgaagtatcgaggaccagtggttgtgagagctatgttcgtggttccgctgatgtcgtacttaatgtagttccctagtatgcaactcttgtagtcgttcttgcttcactttattcatcgtgtgacccgtaccataattgaacattgtgtaacccctttgtatcacctatgtcatgtaccttttattgagcgtatttgtactattgtttcgtactttttcttgtcatcctatgctttatata

SEQ ID NO: 64179 - DNA, 436 bp, Triticum aestivum
  Clone ID: PAT_TA_64179
gtggaggcacacggctgatctcgtgaccgttgaggttcaccatgtaacattatagaacccatgatgctgacgtatgaccctgacaagattaagtccgtacaaaaggcgtgatcttggggatttgcggccaaagaaattttgggcacgagatcaagacatgagatattcagatggacgaactacattttatgatatatcaacagaacccaggagtcggactgacggaagcagaaggcgctctgtgtgatccgagacatgtaactcaaagacgaggttgccgagcacgactgcctaccataggctcagtccatggctctacaacacacatgctgggataacgctatccttactatacgataatttctaagaataacatctcataatattgtgatagggtaatattggatatgcatatataaactgtattttccaacat

SEQ ID NO: 64180 - DNA, 485 bp, Triticum aestivum
  Clone ID: PAT_TA_64180
tataccgaaaaagctgaattatgaatactgcatagataagagaaatctggattacaaaaggtctagaacacatggtttgcggaataaaactagataagaacttgttttcaaaaatgtaaagtacatgctacttatagcaaaatattctgaaaccctaatactcaaaatgacgcagtattgggacggattaagaactgtactcgacccaggtggtcgagtggacggacgagtgataagctggagtcttcttctctttcttgtgctcaagtgtctggttgagtgcggaatggagaaaactctgaagctggtagtctagtaaggacgtccagtgaatgatgataagggactcgaccatgtaggagagtgattggccgagtggatggaggtggtagcactcgactaactggcagagcgaatggtcgagtgaatgatgatagtgattctcggccatgctggcagagtgactgagagagcgactgataatg

SEQ ID NO: 64181 - DNA, 428 bp, Triticum aestivum
  Clone ID: PAT_TA_64181
tttcgtttgaaactaaggatactgatatctgggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttacgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtccttta

SEQ ID NO: 64182 - DNA, 432 bp, Triticum aestivum
  Clone ID: PAT_TA_64182
tcaaggttactcccccctttcatgattttgcatctgagaatcgatgctggacagataaacaaaaaaagacccacgttctggttgatgcatgactgtgatgtgaaggtgtaaactcagctgtcattcactatgaccttttatgacataaagatatgaaagaggcaaactgcgcaagctctgatctgtgggtcaatgcccaaatattaagtagagctcattcgcctttatgttggctgtcgtgaccggcctatagctgttcttgattacctatctttattgacttgtgctatttgacattaggcttgaactgggaccgggacttcgtcttagcaacctctataatggaaaggaactgtttttgcaagaccctacttaactaatcaattgaaaccttagatagatacgagaaccacgataatgtaatgaaacttt

SEQ ID NO: 64183 - DNA, 333 bp, Triticum aestivum
  Clone ID: PAT_TA_64183
tcgctcacacgtggggttgatgccggtgctcatggcgatcggcaaccggtcccgcgacagctccggcgacgtctccaggtcctcctcgagggacacgacgggggagtcgaatgtcgtccaggagctcgggggctactgcttgagctactcctacgtcatggcgaacatgatggaggacaggaggtgcagttacgagagtgctcaggtgtctagcgagatgccaacgacgccgacaacggagcgagctggggagacgactgcggtgacgaagggggtaggggagggaccaagcgccaaaccggaagcggcgccgggagcgccgaacggagggat

SEQ ID NO: 64184 - DNA, 422 bp, Triticum aestivum
  Clone ID: PAT_TA_64184
tgcggacgcacttcgcgactgcgttaacgcctctgaccgttgcccgttcactgggtgtccaccgcggatgcggagcgtgagtcaaccatgatcgattctgctgctgtgtggctgttgggtgaccctgatgcagtcaatgtggcgtacaacatggcgcctatcagtggccacttggttctcctatggatggatctgcatggacgagatgatgaactgagaggccctcgttcgctccgttggcgatcaatggaacaccaactgtaccctgacggagacctgagagggactagcgatgaactggggctacctgtgagaggactttgataacacctggcctacactaggcactggccggcgactgacaccgttttgactgggaaaacgactgggaaaaccatgttaatacccatgttaaacatcct

SEQ ID NO: 64185 - DNA, 389 bp, Triticum aestivum
  Clone ID: PAT_TA_64185
cggaggcgttaccgcctttgcgggtcgccccacgcacttttttactaccggcgatccgccacgtgaggtcaccatggatacagcaggcccgccaaggggcgtctgccctgcttcatgtcatacatgttcgacatagggggcagggcatgctaataaaagttctgtttgcgaaaaagacgcggaaggaccttccagacgagactatcatccagcttatgatccaaatggagtgaacaactgcaccgagctggctgcatttcggctgccacagaacatgcgggccttcttgtgaaatatcggcgagaagggtctgatcacacgtggcctgagctctgctgtgcagcgtgtggttccacctaaacaaatgggaacacatatggcattaccca

SEQ ID NO: 64186 - DNA, 223 bp, Triticum aestivum
  Clone ID: PAT_TA_64186
ttgccacgccaagggagaggagagctcggagagcaccggcagcgccgtagccccccgtgaatccgcgcccggatctcccgggccggcggcgatggcgctctccgatctctcccgcgactcgctgctccccagcttactgtactccccgagctccttcgtcgccgccgtcttcgcgcgcttgcactgctccccgtggccctaccaggcgcccgacgaggccccg

SEQ ID NO: 64187 - DNA, 439 bp, Triticum aestivum
  Clone ID: PAT_TA_64187
tctcaaaggacttggtgggtttcttatccgatagcaacattgaaggctccccagatattgcagaggtcatctatgctggtcttgatattgtgactcccttgatatctttggatcttctcaagtaccctaaactaagtcgtgattattttgtacttatgtcgcacttgttggaagtgcaccctgagaaggttgctcactcaaacagggatgcttttggaagaattactggtagtcttgaatttggcctgcgtaatcaggatggcgatgttgttgagaggtgcctcacagcactaaatgcccttgcctcgtaccatttcaaagaaagacttggaggcataggagggcttggctcgcaggctatggaatctgaaggatcgaatgggaaacttcaggaaagcatatcaagtcacttcttgaggcttctactgcaactacttct

SEQ ID NO: 64188 - DNA, 379 bp, Triticum aestivum
  Clone ID: PAT_TA_64188
tcgttcctctcgtccagtctcttctcggcaaggaccaggaaggagatgacacgggcaagaagaagaagaagaagaaggggaaaggcaaggccggcaatgagaggaagaagccagcaccggcgtacattctgtggtgcaaagaccagtgggcggagatcaagaagagccccgatgcacacttcaaggaggtgtcgaacgccctgggcgccaaatggaagaccctgagcagcgaggagaagcatccgtacgaggagaggtaccggcaggagaaggaggcctacctgcaggtggttggccaggaagatgcgcgaggacgatgcgattaagctgctggacgaagagcagatgctctggactgcgaaagaaattgctgaacagt

SEQ ID NO: 64189 - DNA, 341 bp, Triticum aestivum
  Clone ID: PAT_TA_64189
cgggatttctcgaagccataaagagaggaagaggccccaaaaggaggaggcttaccaacactccggtccgtgcaagcagccgcagagcccgcctctagtaccgcaaggaaaggagggtaaaggaacctgttgcccccaatggcttcctcgcgcgccgccgccgggcccttcgcgctctgcattctgctgctcgcgtccccggccgtctccgccacgttcctgttcgacggcgggaagtcggcggcgaagagcaagggcaagggcaaggaggcggtcgacgtggagtggcggccggccaccgcgaacgtggtaccggcgaaagccgaggggcgacgggcagc

SEQ ID NO: 64190 - DNA, 330 bp, Triticum aestivum
  unsure (1)..(330): unsure at all n locations
  Clone ID: PAT_TA_64190
tcgggccacgtccctcgtccgccgggctacagccctaccaaggggcccatcacgcgtacgccggtcaccgnnnnaggggtcgtcgtcggtccaccggtcacctacccgtccatcaccaaccctccgtccaaggggcccaccccgcgcccgacggtcaccactcctaccgtcgtcgtcgggccgccggtcacataccccgcgccaccggtgatcgctccctgcggtcaccactccaccgtcggcgccggccaccactcccactccaccgtctccgtcggtcaccgctcccccgtcgacgccggggaacactcccccgtcgtcgacggggtg

SEQ ID NO: 64191 - DNA, 541 bp, Triticum aestivum
  unsure (1)..(541): unsure at all n locations
  Clone ID: PAT_TA_64191
tcgtgggaaaattctagggtggccacccctagctacgccactgcctctgcctcggggtcgcacaggcgatgaccgccgcggcggccgtcgtggtcctcgcggggggttccctcgcatttctgggccggtgcctcgtcgccagcgcgctcgtagttgccgccagcaacacgtaccttctctgcagagtcgtctacaaggtggcagtcgtcgccggtgggcacgtcctcgacgtctggacccacatctccatcgcctcctccttcttcgccttcttctgcgccagcctcgccgccgacctctcggtctaacgtcgccggccgtcacctttagtagcgtaaataagctggccttgtagcgcgagttcggttcactctcgctctgccgcacaccttgctgtttgcatgtactacgtagagccataagtgccagctcgcagcatcgatctatcttcttctacggttctaccaagcaacactacatccatggatcttagtgattatacagtaatnggcataattactggaagtagagtattattctt

SEQ ID NO: 64192 - DNA, 435 bp, Triticum aestivum
  unsure (1)..(435): unsure at all n locations
  Clone ID: PAT_TA_64192
cgtcaaacattctgctggatgaagactggaacgccaagctttcagacttcggcatggctagggaaggcccaacggagggcctcacacacgtctccacagcggtggttggcaccctggggtacgcggcaccggagtacatccagacggggcggctgaacgccaagagcgacatctggagctacggcgtgctgctctacgagctcatcacggggcggcggcccatcgacggggagcggccgaggggcgagcagaagctgctggactgggtgaagccctacatctccgacaccaacaggctgcggctgatcgtggaccccaagctggagggccgctacagcatcaagtcggtggccaagctggtcaccgtcgccaaccgctgcctcgccaggctgcccaaggcgcgctccaggatggnggaggtgctggacatggtgc

SEQ ID NO: 64193 - DNA, 425 bp, Triticum aestivum
  Clone ID: PAT_TA_64193
tctggcagctgctggggaggcctctgcagtcctacatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatcttcaacggccggaccgcgatgatggtggtggtgtgcatgatcgccccggaggccctgagcaaggtgggcctggtgcccccggagacggcgatcccgtggttccaggcaggcgcgatcccgacggagggcacctaccagtactgggccgacccatacacgctc

SEQ ID NO: 64194 - DNA, 501 bp, Triticum aestivum
  unsure (1)..(501): unsure at all n locations
  Clone ID: PAT_TA_64194
ttgaacaagtccatgagttaccagccttgtgatcaagaaggtgatcctcttccagggaccgagctaaaagaggtctggaaagccgctcctgctccaccgaatgacaagtaccagtatacatactttgcgcacaaaataaatagctttgatacagcacctaagaagctcttgccttcagactcccgattaaggcccgacagatatgcccttgagaagggcgacatgtctaaatctggggcacacaagagcaggcttgaagaacaacaaagagctgagaagaaaattcgggacaccaagggggagcaatttactccaaaatggttcaaaatgaccgaagacatctcccctacgccgtggggcgatctggaggtgtatgagtacaatggcagatacgccgagcaccgggctgcgatagacagctctagcgtcgttcgcgaggagacagacgtgagctccatcgagttcaaccngtggcagtatggtgactcgccttcccaatga

SEQ ID NO: 64195 - DNA, 443 bp, Triticum aestivum
  Clone ID: PAT_TA_64195
tttgggaagctggagggcacggccaagagcatgtacgcggcgggcaaggtgcggctggcgatgctgcaggagcctgccggagcgggccacgccaacggaaacgccgggcggcgccacgaggggagcttcgtggtctggcagctcgcgcccggcatgtggctcgtcgagatggccgtggccggccacagcgtcgccgccggcagcgacggccgtgttgcctggcgccgcacgccctggctcggcgcgcacgccgcgcggggcggatcgcgcccactccgacgcgcccttcagggcctggacccggtgatgatcgcgtccatcttctagacggccgagcacgccggcgagaagcatgtcgacggggaggactgtttcgtgctgcgcctcgacgtgggcccctcgacgctgtcgagctggagtgaccgcacggcggaggtgatccg

SEQ ID NO: 64196 - DNA, 312 bp, Triticum aestivum
  Clone ID: PAT_TA_64196
tgttaacacaaaaaaaacaaaaaagaagaaaaatacattaataaaacaacaccacataatactaaaaactaacacctgatatgttcctatcccgggcgggcggtcttatctatcccctcctccgtccccgtccctgcgcggccgtgtcttttcttttgtttggccttgcttgacttccttggccggcccgttgctccaccgcgccgggatttccccctccctgccccaccccaattgctttgccttgcatccccctcccttttggtgggcgtttgttgacacgaggcgtcccgttcccccttcccttccttt

SEQ ID NO: 64197 - DNA, 326 bp, Triticum aestivum
  Clone ID: PAT_TA_64197
aaggcagaaagcatcaacgcccgcgacccaaaacagttttacactacgaccacaagcggagccgggaagcgggcgcaggaccacagaacagagaccagccgccgctgacgcggcgacgccagacccaggacggggtcccgaccacccacatggcgaaggcacggcccggccgagggcaacgctgcgctggggaggaggccaagacaaaagatgaacggaccgccccccaccgcgggcggagagaacaaccgaaccgcgaggccgaccggacggagacaaaagaagaaccggcgcgcggcggggcagaacgaagagaggggccacga

SEQ ID NO: 64198 - DNA, 406 bp, Triticum aestivum
  Clone ID: PAT_TA_64198
cgcggagcgggagcgggagatgatcaagacagaaccggcaccgctgatgacggaggctgacgaggacgtgtacgagcacgtagagcaggcatggtcacggggcgccagggccactgagtggaggaggccgagacgaaggagaaagaggaagtgcgcgcacgcccgcggggggagcaagagcaacgggacggaagactgagggggacgggggcagaacaggaactgggagtggaagaggcgaaagaggaggaggaagacgccagaacgaaggccgaaactggcagtggccaaacaacgacaagagtgggaaaagggaagaagcaggcaacagaaaagacatgcggcaaacacccaatcccccagccggcggaagagggaagagggccgaagcgagcgcccatccaac

SEQ ID NO: 64199 - DNA, 119 bp, Triticum aestivum
  Clone ID: PAT_TA_64199
tccactgtcttccgggtaatttccattcctttgtagtacattctctgctattgggatgcgtgaattgtgatactcctacgtttaacaatttatatttatgatggcttctctctttgaat

SEQ ID NO: 64200 - DNA, 294 bp, Triticum aestivum
  Clone ID: PAT_TA_64200
tacttattagtttataggctcccagaaagccttagctgtctgtacgccagtcagaaaccagtcagaaagaagaaacagcagaagcaaggaactgtgcctagtaaccggtttggtgtcatcttggagtgggagggagttgttgtggaagatgatgatcctgacctggaccccctggtgtggtacgttctgttactggacaaggcgacaattttttcttccgatgaaatgctgaaggaaattgagggaatgagaactgaccaggctatttaagaagtctttagttggtcgaaagat

SEQ ID NO: 64201 - DNA, 330 bp, Triticum aestivum
  Clone ID: PAT_TA_64201
aatccccgaaaagctcccacttttcacccatttttccggctggtcaagataacgggggtgacagagaacacctagggctggtgcctgaaccatgtgaggtgaatgtcaaacagactggcgcaatgcatgggctgtccgagcccatgagtcactgtggaggatggcatgacgaacaagctactgctctaccggctccactcgatgggagaacaactggaccgtgatgtcaatcaggcagctacacaggaagaacagacgcaacgagtggtaacactgaaagaggagccatatgacatgctgcccaagctaaccactgtacgcatgtaacaa

SEQ ID NO: 64202 - DNA, 254 bp, Triticum aestivum
  Clone ID: PAT_TA_64202
tcttgcgttttttcacgcgtccgaccacgcgttcgcaccacgcgttcggatcgtggacggtcccggcgccgggaagcatctccaggccggctccaagaaggtcatcatcaccgctcctgccaagggcgccgacttccccacctacgtcgttagtgacaacgagggcgactaccaccatgacgtcgtgtacatcaacaggaacgttgtttgcaccaccaactggtttgagccatacaccaaggttctggacgagg

SEQ ID NO: 64203 - DNA, 321 bp, Triticum aestivum
  Clone ID: PAT_TA_64203
tttttaggaggtggtggtgtttagagctcaatagtggatgtcaagggggttcgtcgtggtcgcggccgagtgcgactaggatttgaactcgaacacggccggcatggtggtggaccgtgcttctgcctataacagagactgaacgtcgcggacctgaccggatccctgcatggtatcaggaaatggaagacctctacaagcttaagcttattggggacttaagcgattgcgagtcatgtgatgatgctcaggaaaggagacaactcatactctgggggttcgatcagtactattggagttgattataaaatacggatccgt

SEQ ID NO: 64204 - DNA, 289 bp, Triticum aestivum
  Clone ID: PAT_TA_64204
ggcgaatcggtgcgtgagtacaccatgaactaggcagcaccggtgtagctgacggctaaccctgtacaattctagtccggccaaccggagtaaacatggcccaattgggccctcggttattggtggaggagtatcatgaccaacgatgaactgattgtccaactctgttccgttgggtggacatctgatccgggatgttagtccagacggggacgaaaggagaactggtgctctcggtggctaaagcctaaagaggggcttggagacactaggtcttaagctagggctc

SEQ ID NO: 64205 - DNA, 267 bp, Triticum aestivum
  Clone ID: PAT_TA_64205
ttctcactttttccaagctggcgacggcggaggtgcggaacatggccgtcagtcagccgccccatgcggtaaaggcgcacgatcgatcacctatgggagcgccacatgtgcaacaagtggggttctgtgctggggtccgcctggagggacgagcggaggtaatacctgtcattgtgcaccgctgccgtcggtggcgcatcaacttgccggtctgtgtggctgcggcaagcaccagaggaggcttgccgcgctgtgctgcatatgtcc

SEQ ID NO: 64206 - DNA, 322 bp, Triticum aestivum
  Clone ID: PAT_TA_64206
tcgggttaccttgtctgaaaacttcctctcggccgacatatgatgacggacagcagctgcggatatgaaatgtgccttgttggatttgttggttcgttaggaagatatatctgcgtacgtttttttcgtgctgatggtggttacagcaaaagaagagtgcgtttggagtagcagctcgtgttagcatgtcgtgcgtgtccttgctctcccacctaggctgaagcgagaattggatcgtgtgtgcgcctctgtattcggcaagaagattacatgcatgtaatttgacgaagaaacatatgatggaaagactttggtctgctac

SEQ ID NO: 64207 - DNA, 489 bp, Triticum aestivum
  Clone ID: PAT_TA_64207
gcactaagaaaaagaaagagaacaccagcaattgtgccggacagcgcagccggaaaagcgttaaaaaaaacacaccagttggtgagttggaaaatactccctccgttcctaaatatttgtctttctaggtatttcaacaagtgactacatacggagcaaaatgaatgaatctacattctaaaatatgtctatatacatccgtatgtgatagttcattgaaatatctagaaagacaaatatttaggaacggaggaagtactacagatagagaagctgcaaacacgcggagctgcaaacacgcgggaagttcatgttatgccgctgcttcatattctccttggaggtggatggagcgtgcagatatcattttcttcttggtgggtggtttcgatcactctccaccatctgtgcattaatccaatacaattacagggactagttcttccggctcccttccaccgcatgcgtgggcatggctacgccatacct

SEQ ID NO: 64208 - DNA, 498 bp, Triticum aestivum
  Clone ID: PAT_TA_64208
tcgttaacatcaaactggcaaagttgggggttcttggagccctcgaagtaattgatgctgcaagaaaagctggtgttgcacttatgattggtggtatggtcgagactaggattgccatgggctttgctggccatctcgccgctgggcttggttgtttcagttttattgacctgcacacacctcttttattgtctgaagatccagtttatggtggctatgaagcttctggacctgtctacaagtttaagaatgctcgaggccatggtggttttcttcatttggacaacaataatggatggaaatgaagatggttaacgcacgccttatactccgggtttatagagcatatcagcgcattcagtatagagtgtagaagttatcacacccgacgactatcgtgtgggactcaaatgtaacacaatcaattgtaagcataatggtaaagctcacgtgtatgtactggctgaactgtaagccctgtgaggcctatgatatttg

SEQ ID NO: 64209 - DNA, 372 bp, Triticum aestivum
  Clone ID: PAT_TA_64209
tcgcccacgcgtgcggggacgcgtgggcgagcatgaatgcgaccaggagcggataataaatttgggccaggagcggcagatcgatccagtaatggaggcggcaaggggggatcctgacgacccattggtcgtcttccgcccagagcgggtcggaggatggtgggcgcgtaaccaggacttcatacggagacgcgcggagacgctgaggcgacccgacggccacgcggaggccgatgccgctgccgagcgtagcagagagccggcagcctgcaagaactacatggagggactgcatcttgccggcggtggacgaggtgcggaatgtggagtgcgcggtgtgactggaggacctggtggtcggaggcaggaagc

SEQ ID NO: 64210 - DNA, 278 bp, Triticum aestivum
  Clone ID: PAT_TA_64210
tcggctgatcattgccctccaaccaggaccctgacagttggtcatgatggtttcttggaggatgtctggtgcccatgtgtgaccgtggggaggcgtgtcagatcccgtggggatggcgtcgacgttatgaagatctagttgtactcagaggagtgcatcaacactgaatacactgtggccacctcttctgtagttaccgaacaattggaccgaaagactatgcttacgaggaccatgggactgctaccgcttggagatgcatgccttgaatgggtgca

SEQ ID NO: 64211 - DNA, 140 bp, Triticum aestivum
  Clone ID: PAT_TA_64211
ctggcgcgcatgctggtacccttaccgaatcctgcccgtgcgccccacgcatttgccgaccacctgtgagccgggcggcgcgcacaacgtgaggtgagcccgatacagtgaggccctgcggtgaccctgcctgaccctaa

SEQ ID NO: 64212 - DNA, 404 bp, Triticum aestivum
  Clone ID: PAT_TA_64212
tcgggaaagggatctcgccgaaacgcaccatggagctcgccgcaaccagcgctgctgccctccggtgatcgtgggggttggcgcttacgagggtccctacggacaggaggagtggtatgcgccctagggtgtccttggttgtctctggaggaatacatgatgaaagatggactgattgccaggctcccctcagggactaaccagctgccccgaaggcggtggatgacggggacaaggatctaaccaagcttcggggcatgggccttgtcggcggcgacccatccaaggaaaagatcctcttggaagtcactgagctgctgctacaggaggagtatcagatgaatgatgcatacgacctgctgtagaataagcagaatgaggagaatgctgggatgaaagcactg

SEQ ID NO: 64213 - DNA, 435 bp, Triticum aestivum
  Clone ID: PAT_TA_64213
tcggccaaaggttatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgtggacggtggagaacttccgcgcgctctgcaccggcgagaagggcgttggcaagagcggcaagccgctgcactacaagggcagtgccttccaccgagtgatccccgactttatgtgccagggcggctactttaccaggggcaacggcaccggaggcgagtccatctacggcgagaagttcgtcgacgagaagttcgttcacaagcacaccaagccccgggatcctctgcatggacaacgcctggcccaacaccaacgggttccagtt

SEQ ID NO: 64214 - DNA, 297 bp, Triticum aestivum
  Clone ID: PAT_TA_64214
tttgaaccggacgctgagcggagactttggtatccaccccttggggctgctcgaccctgagggtaccgagggcttgatcgagcccagggggttggcctggggctagagcgtcaacggtcgtacggggaggattgcgtgaggagagatgaactgactggacgccttcggtaggggggtgaacagcgtgaaccgagacggcagatctgacggggacaaaagaggaactggccgctccgcgtggcacataccaaagaggagccggacgacacacggtctaagcttgggacatggcgctga

SEQ ID NO: 64215 - DNA, 259 bp, Triticum aestivum
  Clone ID: PAT_TA_64215
tcgaaaaacaaaaaaaagagaaaaccatgaaaaaaacaaaacacaataaaactcaaagatgaccctgaagagattcttgtgcgtacaactggcgtcaacatggcccattcaaggccaatggggcgccctttttgggggacccaagtttccatcccctggctgcccccctttgctcttttttttagcgtcccctcattgcagttccccggccggggttctccaacgacctgacggggaaaccccgcgcgttccccaattt

SEQ ID NO: 64216 - DNA, 233 bp, Triticum aestivum
  Clone ID: PAT_TA_64216
ttttaaaaaaaaaaaaatgagaaaaaaaatgattaaaaaaaaaccgataatgcatgatggatgaccatgatgagttcgtgtgggggcagctggagtaattatgggctttcggggccattgttgctatgtggaggatttcatgtagagagatgaactgaatgtccgtgtccgctcgctgggagaacaactgaagcgagatgcctgtctgaccgggactaaagaagaactggcgc

SEQ ID NO: 64217 - DNA, 481 bp, Triticum aestivum
  Clone ID: PAT_TA_64217
tcggatctccttgatttgtacatttgctccagctccagtttgatgttctgatgccgacggtgacggatcttaccagttgcggtgaaggtgctgaacatcttctgcagagcaatggagaggtccttgtaggtgttgtacatcttgagatccaccttgcgcagtggaatctgccaagaaatggaaagtgtatgcaacatcattttcttgccctctctgacatgtaccggctgccgcacaaagcaggcatcaagtgcgcatatgtttatggttcggaaaggcgttaataattcgcgtcggcgctatggaggcgacaaacaacacacagcggatggtgtcgccttgcgcgctttctgccatgggatctcctttgtggatattttgccctacttaaagcgtttgcccatttgcatgtcatgttttattcaacatcctgtaagtatataacgaatgcaaactcgagaaaactagtttataatgggga

SEQ ID NO: 64218 - DNA, 403 bp, Triticum aestivum
  Clone ID: PAT_TA_64218
cccttgcggctcggcgccgcccctcgtgagtgaggtaagacgcccgcaagagggagcggcccagcaaggcggggtcgtgcccgtgctgtgtccatctgctgacgagtgcatcgattatgggactcgtggggcgttgccgatgcctgcttgaatccaacccgaatgattatctgatcatggatctgcgttcggtagaggtacaacagagccgacctgccaagataccggggaccaaggcccaaactatcatccgtgtactagagatatctggggagcttatgtgacggattggctcagctacgcactgagcgagaggcttgaacacgacaaatgattgaggcctggtgccaccgacctgaatgagcttgcttcagactcctcctacgacacttgaggtactacc

SEQ ID NO: 64219 - DNA, 517 bp, Triticum aestivum
  Clone ID: PAT_TA_64219
gcagaaaagccatgattcaactcgcaggggaactatttcggaaaatgggtgaagatttggatagcattgcgaaagattatacagcttctctcgactcatttatctcccagttgcccctgcagcaacacgttgatttgaagttccttctctttcgtttggacttcactgaatactacagccgtgtttcgtccaacaaatgaaatgagtgtgtgcttctaatgcggaagaaataggtgttagatacactttttggttggggctcatgaaaaaactgatgaagcaacactctaaaatccaggatgtacatgaacagttgaaaaggaagttatgatctcaaagctaagcctaatgatgaaagtgtatcagttatgtcatctgacgcacagattgttgattggcaaggaaatgattatctttctaatttctaaatatatactccctctgtcaggaaatacttgcatttttatccatttctcccgatagtattttcggatggagtattctgctagtactactc

SEQ ID NO: 64220 - DNA, 325 bp, Triticum aestivum
  Clone ID: PAT_TA_64220
cagggaggcgacgccgacgcaaagggagaaacgccaacgcccgtagcccgaaaaacggttttgagttttgggcgaaccggcgcgggagcgcaccatgaaaaagaaagaaccggcgacgctgaaggcggaccctgaagaggacgagtccgtacaactggagcaggcaaggccccggggggccatagacaaactgcggaggaggacgagaccaaagaggaagagaaagcgcgcgaccgcccgcggggggagcaagagaaacgggacgggaacctgagggggacgaaagaaaaacaggagctgcgcgtggccagagcgtgaaaagagg

SEQ ID NO: 64221 - DNA, 486 bp, Triticum aestivum
  unsure (1)..(486): unsure at all n locations
  Clone ID: PAT_TA_64221
cacacacaccgaacgcgtttgacattttccgcccaccaccaccggagggagcgagctccagccatggccggcaagtgctacccgacggtcagagacgagtacctggcggcggtcgccaaggccaagcgcaagctccgaggcttcatcgcccagaagaactgcgcgcccctcatgctccgcctcgcgtggcactcggccgggaccttcgacgtgggcaccaagaccggcggccccttcggcaccatgaaatgccccggggagctcgcgcacggcgccaacgcccggctacacatcgccgtaaggctgctcgagcccatcaaggagcagttcctcattctctcctacgccgacttttaccagctcgctggagtcgtcgacgtcgaggtgactcgggggcctgaggtaccctttccccggggagacaggacaagaccgaggcttctgcagaaggncgacttcctgatgctacccaagggtctgaccacc

SEQ ID NO: 64222 - DNA, 466 bp, Triticum aestivum
  Clone ID: PAT_TA_64222
agggatgcggacgcagcagggccaaccgcgttaacccctttccccgttaccggaaaaactgtttgacctttgggtaccctgggcgagagcgcaccaggaggcaacgatagcacgctaccagctcgtgactgactgtggccagaagtacttcaagcgactgtaccaaaggttggccatggccaacgttgatactgtccccaacaactactgaaggaacaagaacagaatgcccgccttcgctaactgcaggagcaagttaaccaaagatgggacgctagctgtttctaaagaggaacgggagctaagctagtaagacgttagctacacatttgtcactatgatgacatagcttggcacttatcgctgtgaacaaggttaccacagttacagcccgggcggtacatatgtacatggatttgcatcacgtacaaattttatcagttaatgtgatagttgagagagcgct

SEQ ID NO: 64223 - DNA, 417 bp, Triticum aestivum
  Clone ID: PAT_TA_64223
cgacgtcgagtgccaccagtgatatcagtgcagcaccgatgatgctggtggctgaccctggagagtgcggagccggacaactggcaaaaggatggaccatgggcgtcatgggtcattggtggaggagggcagaacgaatgatgaacggagagccggtcgcccgtctctggttgaacaacgaacaagtgatgcgagactgacggctgccaaagacgaactagcaattggcgctgcataggtgaaagatgagctaggagacacggaggcctaaggtcgtaactggcgctggtcacaacgttacagactgggagaatgctgaaactacgcaactaaatagcttaagagcacagccgcatatcgccagttggccagatagcgaagaagccaagagggatcgacctgatcaacatttgcaac

SEQ ID NO: 64224 - DNA, 365 bp, Triticum aestivum
  Clone ID: PAT_TA_64224
aggccgctgcccgccggatgcagccgcacacgggcgttggcggttacgcccacgcccgcgactctgactactggtttgaccaccggacactgctgtgcagcgagcaccgacgagtcagtcaataccggtgatgctggtgcctgtccgtgacgagctcgtggacgtacaacaggccgtgatatgctctttcagggccattgtgtctgtgtggaggaggccatgacaaaggatgatctgattgccctgctccgctcgctgatagaacaactgaacctacacgtcaggcatgctgggaccaactgagaactggcgctgcgtgtggtatagctgaaagaggagcgtgatgacacctggccttagcttgg

SEQ ID NO: 64225 - DNA, 146 bp, Triticum aestivum
  Clone ID: PAT_TA_64225
caggcctgagccctgcagggatgacagacgcacacgcgcgaatggcacttaacgcctatagaccggtacctcgcaaacactgggtgcaccaccgggagatccacgcagcgtgagattcacgcatgatttcaatgagtgactcgctg

SEQ ID NO: 64226 - DNA, 359 bp, Triticum aestivum
  Clone ID: PAT_TA_64226
gcgttctcacgcgttcgttcacgcgtgcgattttactgactattcacgctgtcttcatcttgcctcttggcatgatccagctgagatcggcagagatggagatccggcggcaggaggctctggcgacggccctggtgtcggtgctggcccaagaggctggagctaatgtgggcaccgctgcgatgagttacacaggcgggggacgccaggaacgggcatgtcgggacagtgcacaacaggactaatgctcgggtcgggcgctgcctgccagagactgttacaaccccggttacaacatcaacgtcacgtactggagggagctgcacgacacgacggagggggtcaaggaccgctaccac

SEQ ID NO: 64227 - DNA, 109 bp, Triticum aestivum
  Clone ID: PAT_TA_64227
gtcaccagaagaactgctgctataagagggaaaactgaaagaggtgcttgttgaccataggcctaagctcgttactggctgttgtgcggcaacgtgcctacttggaaaa

SEQ ID NO: 64228 - DNA, 172 bp, Triticum aestivum
  Clone ID: PAT_TA_64228
acaggcctgagccctgcagggactgcggacgcacagctgcgaaggcattatacgcctctgctccgttacctgtattaactgtggtgactcaccggcgatgccggtgtcatgagtgtcatcatgatgtcacctgcagcacgcgctgagtgctgctcggttgacacgctgagga

SEQ ID NO: 64229 - DNA, 294 bp, Triticum aestivum
  Clone ID: PAT_TA_64229
ggcctgagccctgagggactcccagcgcgcaggccgaaagcgtctacgcccgttgcccgaaacacagatttgagttttggccaccgcggagcctgagcgcgcgatgaccaagattgaaccagtaccgctgatggtgtggcctgaccatgatgaggtcgtgcaccacaactggcatggcatggcccttccagggcatcgctgctgtggagaggaggacatgagaagagatgaacggattgcccggctccgttcgctgacagaacaaccgaaccgtgatgccaacctgaccgagac

SEQ ID NO: 64230 - DNA, 303 bp, Triticum aestivum
  Clone ID: PAT_TA_64230
cgacgcggcgccggagcgggccatgagccagacagaatccccaccgctgctggtgcaggctgaccaggataagtcgtagccgtgcactgaggatggcactgccctccctggcattgatgctttggggaggagaccaaaagaaaagatgaacggactgcccctctccgcgggctgggagaacaaccgagccgtgatgttagcctgaccgagacgaaagaagaacctgcgcggcgcgcggcagatctagaagagggactcgatgacaccaaggctaagctcggcactggcctgtgaactacaacg

SEQ ID NO: 64231 - DNA, 299 bp, Triticum aestivum
  Clone ID: PAT_TA_64231
tactatagggaaagctgatacccgctgcacaacgcgaaaccgtatacgcctgtcgcgcgtgaaccactgtttgagttctcgccaccgcggagccagagttcgccatgattaagtgtgaaccaataccgctgctgccggaccctgacgagttagtgtacgggcccctgccgtacacatggtcattgggggacattgtcactgtgtggaggagaaccagactaaagaagaactgaatgtccacagccggtctctgtgcgaacaagcgcacaccgatctcaatttcgaacatgacgagcaga

SEQ ID NO: 64232 - DNA, 377 bp, Triticum aestivum
  Clone ID: PAT_TA_64232
tttgtccttccacgcgtccgcccacgcgtccggcctcctgccgctccgccgccagcgtcgacgtcgtccagtccaagaagccccaaggtgctggcggtggcggcgaggggacatcgtcggcggcggcgccggggattaggccggccaagggggagtcgctgtcgctggtggcgcggctgctccgggggttcaagaacctgtcccaccagatcttcgcggtgtacgacgaggaggacgaggaggaggaggagccggagaatggtgatcgggctccccacggacgtcaagcacgtcgcgcacattcggttgggacggcagcaccagcaccacctccagcgtccgctcctggaaccgtgccgcccctcctcctggcacca

SEQ ID NO: 64233 - DNA, 355 bp, Triticum aestivum
  Clone ID: PAT_TA_64233
tcttctctttttcgcgacctctggcaccagtttatttggcaagagcagtcatgctagagaagaaagaggggggagagcagcacgaccctgctgctgcttatgttcctccgcaaccgggcttactaacttagcaggacatcaccatgtttgctcatatcatgaggggtggatttggagacatgttgcgagttaccaacacaggcgcagactaaccgaactgatattatcaacgttgagcgtcacatcaatctctgcgaatgtggagtttgcgcgccacaggatgactaagcttaggagcgacctagggcccgctccttgagcgttcttacctgcgtgactcgacacatgaggatgc

SEQ ID NO: 64234 - DNA, 130 bp, Triticum aestivum
  Clone ID: PAT_TA_64234
aatgttatagcttttgtatagcgtaacctaatttacagtccgtggacgaacaccaacagcattgtgactgccaaaaccctgccgataccaatcgtaatggtactaagccacattcccctttctccagttg

SEQ ID NO: 64235 - DNA, 317 bp, Triticum aestivum
  Clone ID: PAT_TA_64235
gatgagttcgtgttcgtacggctggcgtatttatgggctccaagcttacctactggtgtatggaagattatatgtcttatgtatgagctgctaaatcgacttcactggctgtgtgttcacaaggaccggattgtcaaacccacggggacaaccaactaaatggcagtttggaaagacccacttttaaacaggtgcttgattacacaagggctccgcttggatgtgccttccaatcaacaacgaagtgtatgtgacaaatgtgacgctccctaaattaatctttttgcagcacaacttgcttttggttactcgcagtg

SEQ ID NO: 64236 - DNA, 494 bp, Triticum aestivum
  Clone ID: PAT_TA_64236
acttttgactgagacctgaatcgctctgggaccgcgcctgacaaaaaggaatgtgcggcagcattgtcaactgtgaacatgcaagaagtattgcgctcaacaggctgtcttgaggagcttgaaatgcatacggaggctaaggagatgcccaggcaacacaaggaacacgtccagattgcatcctttcatgtgtggagcaacacagactcttgcccaatttgtggatgtgactagactaccactgagtctaagaaccgatgtgaatcaagcagagctggtggaacagagagctctgatggagactatgctgagtcaagcaacagtgatacatgaaagagctcaccatgatggaagcagtatgctcgatgaaagcacaatacatgatacagatgtgacgtatgcgaagaacgccatcttcggagatggatcctaatgatgctcatctgatgaaaatgaagcatgccctattgagagcttaagccatcatcatcctg

SEQ ID NO: 64237 - DNA, 454 bp, Triticum aestivum
  Clone ID: PAT_TA_64237
tacattctttgacctgacctgctgcccaggccatggtatcaacattgaaagcctctgcaggtacacggtcgacatggactggtccgatatcaccaacacgaactgcgttctcaagggcttcaccaatggtctctgcattaaggcgcacgacgacaccaaaactgacctcgtatgcatccaatatccactacaagaacataactatggactaactctgctacccaatcatcatcaaccagaattactgtccgaacaaactatgcacctgtaaggtcgacccccaccgggtcaccgctatggacgttaccttacaaaacatcagctggacctacgacacccctgaggacatcaatctgctctgctccgaaaagaatccctgcaaatgcattacaatgtacgacgtcaagatcgagtactcttgccagtacaatcagactatgactgtctatagcca

SEQ ID NO: 64238 - DNA, 378 bp, Triticum aestivum
  Clone ID: PAT_TA_64238
tcgttaaaaataaacaaaaaaaaaacgagagatgagcaaaaaaaaatcaaaaccgctgatgctgttggtgtgtccctgacgtgatcaggtccggacaactcagctgatcatggccttgccgtgccatggcatttctgctgtgtagtggattacaaaagatgagctgatctgcctgctccgctctcttggctaacagaacaactcgaatgtgatcctgtcgtgaacgagagaaaagctgaactgtcgctgcgcgttgctgaaatagaagagttgctacacgacacctgagcttggctctggcctggcctttacaacataacgactggaatagccaagcccttacccaacttaactgtattgctttgcagccccctttcg

SEQ ID NO: 64239 - DNA, 418 bp, Triticum aestivum
  Clone ID: PAT_TA_64239
gttgacctccgcgcgcagctagatcaggcggctcgaaggggactagagatccatcgcgcgctctccggtgatgctgcgccctcggcagcagtggagactttttgctgcgggctgcaagtcaccgttggctgccgttccatgtggtgcaggtcgactacggcgtcgacgttgtgctgtgatgggcggagccagcgagagttgctgcgtccgacgtttggcaaagatgcatccgtcggggggtggtgctgaaacgatgggggatgaggaagggtgtgcagcgacgaccaattggagctgctgagagaggcggcgagcggtggagatccgactagcggcggagatccggcgggtcaagtagctctatcatggcgctcgcgtgatttgcagagtagaagacggcgtggacatggtcacatat

SEQ ID NO: 64240 - DNA, 464 bp, Triticum aestivum
  Clone ID: PAT_TA_64240
ttgtttttaagtgcaccctgacaacaggattaccggcaaggccatgtccatcatgaaacacctccatcaaacgacaatctgtcgagatagcctcgtccgcgggaggccttgtcaatgctaagcccgctacaacaagaagcccaccataacctccagggagatccagacctccgtacgccatgtactccctggggaggtcgccaagcacgacgtgtccgagggcaccaaggccgtcaccaagagtacctactattagaacgcgttgcctgaatctagcagcaaaagtagctccctgcagacggcttaaaggtcgtctgaggactctggaaatactggaagaaaatacagccctactgaaggaagaaaaatgctgaatcattgcaaatggactggcggctcgaaggccacccgcacagaagtgaggcacgcccgctggtctattggccaacgaagattccagaaac

SEQ ID NO: 64241 - DNA, 421 bp, Triticum aestivum
  Clone ID: PAT_TA_64241
aggccctgcatggatgtggacgcactgggcgaaggcgttagcgtctacgcctgtgaccggtaccactggttgtgtttgaccacacgcggagccggagcgtgcgatgaccaagattagaatcgctgctgctgttgtgtgtgcttgccctgatgaggtccggtccacacaactgacgatagcatggccctgccatggcattgctgctgtggggaggaggacatgagaaaagatgaacggcctgccccgctccgttcgctggcagaacaaccgaaccgtgatgctagcctgaccgagacaaaagatgaactggcgctccgcgtggctgagctaggagaggagctagacgacaccagggctaagctctggactgggcgttacatcacaacgactggactgagaataccctgacgctacccaactt

SEQ ID NO: 64242 - DNA, 359 bp, Triticum aestivum
  Clone ID: PAT_TA_64242
ttacgttcacgcgtccggccacgcggtcgaccacgcgtccgatcgaaatgctggtgacctttcttacagcgctttaagcatacttgctagcaagatgcctatgtactacgagtgcaatgattcatgcacttgtttacataatcgccggaaccgatttgctcataaaggtattcagatccactttgaagcgtctaagacgggagatcgaggttggggcctgcaaagatgagatccaattccagcaggcacatttatctgagaatatgcaggtgtcattgccgacaagaatgcttttgatgcagaagacgactatatgtctgagacccctccttcggagcagaacttaatatggatctatg

SEQ ID NO: 64243 - DNA, 407 bp, Triticum aestivum
  Clone ID: PAT_TA_64243
gcggacgcgcacgcacagaccgatggcgtttacgcctgtggccccaacccgaagttttgcttcaccaccccggatcctgagcgtgagttcacgatgctagagacacaaccgccgctgctggtggctgaccctgccgagttcgtgcccgtacaactgagtgtgatcactgccccgtcaccgccattgttcgtctgatgtggagcccatgaactacgatgatctcattgccctcctacggtcggtgccagaacaactggaccgtgacgtcagtcggacaagaaccatacaagaactggcgctgcttgtgccatagctgaaaaaggagctcgacaacaccaagcctaagcctgtccctggacatacatctacaacactgtgaccaacaaaacgctgacgatccccaactt

SEQ ID NO: 64244 - DNA, 446 bp, Triticum aestivum
  Clone ID: PAT_TA_64244
ccctggttggaaggcggcgccccggggggagggattaaaggctttggccggtacccgaaaaaatgggtggacaacggggaacccgggcggggggtcaaccatgattaatcaagaacggttgtggttgtgggttgcccttgagaggtcctggtcctaccactgggggaaataagggcctttgggggcaatggtttttttggggggaagtcaagaacaaaggataaacggatggcccgcttccgttggttggtggaccaatgaacccgggaggtaagcttgccgggaccaaagaaaaaactgggcttcgggggggcaaacttaaagaaggagttggttaccccaaggcttaagttgggaattggccgcggtttaccaccgtcggaatgggaaaaaccttggggtacccaaattaaatggcttggaagacaatccccttttggccagtt

SEQ ID NO: 64245 - DNA, 515 bp, Triticum aestivum
  Clone ID: PAT_TA_64245
taataaattttaaaaaaaaggaatataaaaagaaaattgaaaaaaaaaaaaaaaaaaaacaaataaacctacttcataactgggtggcctgttttctcggtctccttgcttttttagggggggggggggcctttttgggttcctcggtttccttccggcgcgtggcgcggctttttttttttttcggggctccctgtgtacacttgctgggcggtggtttcctgcggtgggggtggggtaccccctggggcccccctcttcttgtgcttgggggcgcttcccctttttcctgtttggcttttgttcgggcggccccttttgtgttgccttttctcatgtgggcctcccttcggggcgtgggggtctcccccctttggggtgcctttttccctcgggggggggggtggttttggcccgtggtctttttctcttgccttggtctctgttccgggtgttttgggtttttcctttttttttggcctttccccggtttccctcttttttttatggggggg

SEQ ID NO: 64246 - DNA, 263 bp, Triticum aestivum
  Clone ID: PAT_TA_64246
ttctgcgttctgttgaaaaccggagcgacagttcagcgaataattcaatgattaacgcagaagctattatgttgccgtctgtccgtggggtgcttgccaaccgtgcgcaatgcatggtcctatggagctccttgtttctttgttgctgagttcatgaccctaggcgaactgattgaccgtctgccctggttaggtcgttgagtgaaccattttactcgggctgtcagcctcaccgggtttactgaggttctgttttttccgaa

SEQ ID NO: 64247 - DNA, 206 bp, Triticum aestivum
  Clone ID: PAT_TA_64247
gccgagcgcgttcgctcgatcgcggcatacggcgcgcggatcgtgcggatcgcggggaattacgacgaatcggtcgtgtgcgccgcacagctcgcgcaggcgaacggctggtacgtcgtgtcggatacgtcgtacgacggctacgaagcgattccgcgcgacgtgatgcagggttatggcgtgatcgccgccgaggccgctgcaca

SEQ ID NO: 64248 - DNA, 343 bp, Triticum aestivum
  Clone ID: PAT_TA_64248
tctcaagttggttttccggtggaaaaaaaatttgtaggtcagtcaaacgcgatctatctctatcgctcccgaacccacctctttcccttccgatctggtcgccgccgaatccggcgtcgccccccaccccccacccccgcgctcggttcccgtccagattctgccacctacgacggagcgaggccgccgaagccggcgacaaaaggattcgaagcagtcggccggagctactttgacttcgacgttgaggagggcgtcggcctcagcttctggcctcccagggcccgccgccgctgggctcgaccatgtcaggtgctggcgactcggagaggagctttggccg

SEQ ID NO: 64249 - DNA, 430 bp, Triticum aestivum
  Clone ID: PAT_TA_64249
ggccagacccctgcagggatgcggtcgcacacgcgcgaaggcattgacgcctctgcccggtccccgaccaacagttctatttccgcacctccggcccgtgcgtgagcatgaataattcagaccgaccaggttggctgctggctgtcccgagtgagtgcgcgtacaaccgactggagcatggatgtcccttgccagccattgtctgtgtgggggggaatgcctgacgaaagacggactgaccgcccgccttcgctgggtgaataaacaacccaacctggatgcctgcctgacacgaacgaaagactaactgtccctgcgggtgacataaaagaggaacgagcttacagacgggctgcctttgcttgtgactggccgttaacaaccaacggactgagaagaaacaagcctggcgccacctaaattaatttgc

SEQ ID NO: 64250 - DNA, 404 bp, Triticum aestivum
  Clone ID: PAT_TA_64250
attttgttctctgggatccaacatctgttctaccggcggggctgatgacattctatggcaataccaagccacttgataagtcatggcatgtgatgggtcttggatataatccaagcatcagccctgaggttatccgtggtgctgcagtgatacactttaatggaaatatgaagccatggcttgatgttgctttcaaccagtacaaggcactgtggaccaagcatgtagacactgaaatggagttcctcacactatgtaactttggtctctgaagaaatgctccaaaaataaggcaaccaccaatatattgttcttttatgggcaaagagcccgcacgggaattatctatttttatctgtagcgaagtttcttacctttgtggtggacaactattttcgggtaga

SEQ ID NO: 64251 - DNA, 462 bp, Triticum aestivum
  Clone ID: PAT_TA_64251
tcgctagatatgaaagatgattatctgcattgggagtgttcgtactaccattgttatccaagattaaaacacctaacgcgtgcctttttttaagtatctttaatgcagcctatcggttcttaacttactaccaactactagcggagatagctttctgaaataagcatgctaagcatgaacgttgttctacttatgggaagaaccctcaggtgatgataggtcatggttctttgccatttcctttacaaaatcggctgaatcttgtgattctaagttagtatcaagtcctatatacctttctgtttgtataaattcacaactttcatggaaactgtcgaattgcgagtattaatctcaggctgctgggtatgtttgctgattgtatgctgccatgcattcactgagccatttcctgggattctacttgggaagacccatttgtaaaccgtcccttttgggaat

SEQ ID NO: 64252 - DNA, 390 bp, Triticum aestivum
  Clone ID: PAT_TA_64252
ctgggtttacttaatccactccccgcgtgacaaccgcaggcatgacgtgcgcctgctgcggctgcaccgtgaccacggacggcgcgctcgccgcgaaccggaagccatgacggggcgccgcagtgactattgctttcgcgaggcgtccacaggcactgacgactcggcgtcgccggctcgaggacgtgcagggacaacagattcgtgacccgagccggacgcgaacacaacctgacgttggtggggaacaaggagaccgacttgacgagggaggccgcgctcgaccaggagttcatacacgtcaagctatcagaacacattgggaagaagaaagcgagtctttccttaaaccatctggactgcaccttagtctgcccaactgagattacg

SEQ ID NO: 64253 - DNA, 436 bp, Triticum aestivum
  Clone ID: PAT_TA_64253
tttttctcacaatcgttttgagtggtcattcactcaatttggttcagccgtttaggcggggcgataaaaaaaagttgctgctctgtttctgcaaaacagcatttctgttgtttttgcccatagcttttcaggatcttcgagggctgataaattgatgctatacaattgtatagctacctgataccttttagttcatagatcaattttatttacttactccccatgagtattggtgttgctatggatttccaaagtccgcttcctcattattcctaaatctgaaaacagcagagatgtttttgctggttttgacacctgtaacctcataatctgaggttgaatagttggagttatttgtagatgagttccccatgaatccataaccattttgtttgcatgttttagagcttcctagcttgaagagctttgaattttt

SEQ ID NO: 64254 - DNA, 176 bp, Triticum aestivum
  Clone ID: PAT_TA_64254
gctggcacgccggccgaagccggtaccgtctatcccggtcgcccgacacgttgggttttgtcacgcgcaccagcacgggagctgaccatgatttagtccgtctcgatggagccgttggcggaccaccacgggtcccggttcggccagatgacggcgtatgtgatgataccaaacca

SEQ ID NO: 64255 - DNA, 349 bp, Triticum aestivum
  Clone ID: PAT_TA_64255
tcgcgccctttgttttatatgatgaggcgctcaggttagtttcatgatgagcagtcgcaactcatgtaacgcaattctcaagaggtcgtacatcaaaactcaatttatgtcagctcacagctcattacaaactaccctaagggccatattcttttaacgattgggggcttaagtcgtacaagatgatgcgacacgtgggcatatttgtatgttgctggtaacggccataagtagattcatgacgagcgaacgcggacagattgtttttcgtgaggggcctcagagttattacatgacaagcgagcgctactcaagaaacgcaatggcggcctacaccgggagcgacccg

SEQ ID NO: 64256 - DNA, 346 bp, Triticum aestivum
  Clone ID: PAT_TA_64256
tttttgtatgggatcaaagaggcctggtcattctatatgattgatagagcatttgccctcacagtagcctttctgatcaacatctgtatcatatctgctagtggtgctgtttgcagcgcagataatttgaaccctgaagaccggatgaattgcattgatctagatcttaacaaagctttattcttgataaagaatgtcctcggaaattggtgctcaaaggtgaccgctatagccttattggtatctgggcagagttctaccattacaggaacttatgcaggacaatatgacatgccagggtttctggatcttcagatgacaccctgggtacgaaaccttttaacta

SEQ ID NO: 64257 - DNA, 314 bp, Triticum aestivum
  Clone ID: PAT_TA_64257
aattcccttttccacccacccatactttatcttacagctcgtccccaacctcctcggtgagctattattaactctgaagggcctcatctacacgccctccctccactcgctgcaccacacccactttacgaccaactactcgctgttcgcgcccttctactactacctgaactcaaccatgaacaagactagcgaccacctctactatcgcacgctgaacagctcagcacgaagcccccgacttcgtccacctcaaccacctcaccactcccggctccctcctccacctccgcctctggttcgcctccctcacc

SEQ ID NO: 64258 - DNA, 313 bp, Triticum aestivum
  Clone ID: PAT_TA_64258
ggaggaggccgacatcgacaaggacgggcggataagcctgtccgagttccgcaagctcctccgaaccgcgagcatgagcaacctgccgagcccgtccggagttccgaatccccaggctctgtgagaatcggcgaggagcatctataggggccggggagatggtgacgagtacattagagagtttatttcttcttcttttgtgctgttttctgcgctccgtgcgatgtgagggtttctgatttgttagcatccaggttctttgtgcactggtaagggttagagataagtttcagggtaaatattttcgttgaag

SEQ ID NO: 64259 - DNA, 360 bp, Triticum aestivum
  unsure (1)..(360): unsure at all n locations
  Clone ID: PAT_TA_64259
cggagcgggagcgcaccangacccagacagattcagngacgctgccggcggaccccgaccaggacgagaccgcacaaccggagcaagcacggccacgccgggccaaaggcaccgccgcggaggaggaccaagaccaaaagaagaaaangaacggcacggcccgctcgcggggggaacaaaacaaccgagacgnaaggccaaccgggacgaaagaagaaaagaaccgccgcgcggagcagcagaaagaggagcgggaggacacgaggccaaagctaggcactgggacgggcgtacaacgacaacgaccgtgaaagaccaaggcgtacccaaaccaaatcgacatggagcagaagcacattc

SEQ ID NO: 64260 - DNA, 278 bp, Triticum aestivum
  Clone ID: PAT_TA_64260
ccgcctcggagattccgcgggccgatcccacagcgtccgtttttccacaggtttaggtgctatgggtgcggctgggggtgtcagggctcacaagggggacatggaagccgtcgactagaacttaaacggccagagcaaagaggccgagaaggtggagacacttgaatcaactgggacacacgaggtggggatgacgcgctggttcacctccgacgcgtgctgctaggacgggttcagccctgtgtacctctcacggctctgcgacagactctgccacg

SEQ ID NO: 64261 - DNA, 356 bp, Triticum aestivum
  Clone ID: PAT_TA_64261
gtctcgtcggcgcgctgctcgcgctcctcgtcgacctctccgcctcgtcgcacctcgaagcccacggccaccagcagccgcagcaggaggagggccagccctacgccccaatccccaccaccaagaaggcccccgccttcgagctcaccggcgaaatgagccccaggaaacgcgctttcctggacgagagtgaccgcgacgacccggcgccgcacgccgacaagaatggcggcgagccggaccgggacgacgtggcgctattcggtcccaagaaaggcgcccggctgccccgcagcgatgagcccgtggtccctattgtcgggtgccatggcgctgggcatgaggtggtggaggtc

SEQ ID NO: 64262 - DNA, 429 bp, Triticum aestivum
  Clone ID: PAT_TA_64262
gtccgctgtcatgggtttgtaagggtggctcggtattcagaagtttcaaatcgtaccgagcctttcaaacttcaaaagggcagtggtaggaggcggacagtggagagagatttggatcaactgcaacaatccagattgggggaggccgatggctttgaagtgattcatgtcactgggaagcatccatttctgtggcctgatcattggccagtgaaagactatgccaggatcttcgattgccttgctgtagctcctgagatagaaactgaagatgtcagggtcatattcaagattaaagatgcagggaaaaaagcaagacatgatgctgccgtttctcataatacgaagaggatcgatggtttgaaaaatcttcctgtgcagtacattgctgttcacatgagaatcgagaaagattggatgattcattgc

SEQ ID NO: 64263 - DNA, 416 bp, Triticum aestivum
  unsure (1)..(416): unsure at all n locations
  Clone ID: PAT_TA_64263
ggcccggaacccccgggccgacccacgtttgattaaaagcaaaccagcgcgagggnggaccgagaaaaaaaaaaaaaacgaaagacgcaacaaacgggccgcgcggagagagganccaagcaacacgaccgcgngaaggccacgccagaccanggcaacagggcggcggagaccaagacgaaagaccaacgganagcaccgccccgaccgggaaaacaacaacggaacccaacngaaaggccgagagggacaaaagaagaaccgaggcggcgngaggcagaacagaacgaggaccanggccacaccaagccgaagcgcagcacggaacgccaaaggaacccgcccggcagcgaaaaccaagcgcggccgaagngagagggacgggcagagagaccgctacacgcggcaggggccaa

SEQ ID NO: 64264 - DNA, 547 bp, Triticum aestivum
  Clone ID: PAT_TA_64264
tttgctgttaagaatcagaagaaaaacaagaaactagggcgtagcacggtggtgccagatgcttccttaccagatggcttacctgagttcgcttcagcggagagtatgggtgagaaaggctctagtactattgttgctgcacggcctgattttgatctgccagaagaggtggaaaaattggtggaggacgaccagatctgtcctcagattaaaaacaaaaacaaagggaaggcaaaggaaacagatgttgccaggccagaagttaagattcaggaaaagaagaaactacggcgtagtacggtggtgccagatgcttccttacgagatggcttagctgagtccgcttcagcggccagtgtggttggacaaggctctagtactgttattatcaataagatcatatcaagatcaatagagaatatgaatttggtgacatccattgacgcgcaccccactaagccatggattgtgacgggtcatgagagagggaatgtttccatttgggactaccagaagaaggaactgtgatgagtttgcaggtcaatga

SEQ ID NO: 64265 - DNA, 339 bp, Triticum aestivum
  Clone ID: PAT_TA_64265
cacccggacgcgagcgagcatgaccaagttagaaccagtgccgctgatgcttgagcctgaccaggacgagtccgtgcacctgcaacaggcatggccatggcccgtcagggccattgtgtgtatgaggacgagaccatgaagaaagaggaactgagtgtccgcctgctgtgggtgcaagaacacctgaaccgcgatgtgaccctgacgaagacaaaagaagaactgccgctgcgagaggtaaaacaggaacaggagcacgctaacactaggcctgagactggcactggccgtacaactacaacactgggaatggcaaaaccctgcccaaatcaaacttaa

SEQ ID NO: 64266 - DNA, 141 bp, Triticum aestivum
  Clone ID: PAT_TA_64266
tctgtacaggaccctttcttactttcgcgcacctgcgacgcgataggtctgctatagtggcacctaaattcaccgctctaggccgtcgcttgacaatcgtgagtctaggaaaaccctgtggcttcccaactgaactcgcct

SEQ ID NO: 64267 - DNA, 342 bp, Triticum aestivum
  Clone ID: PAT_TA_64267
tttggttgtggccgaggcggcgcgccgcgggggagcccacgtggccgaagccggttgctacgtggggccggcggtcaacgtcctggttgagctgggcctgtctctgctgctatcttgctgggtcggctacccgaatccgggagcgataccctgggagcccaggctttatcagacgctaggctgggtagctactgggctcttctgggccttcgtcatgctcccgagaaggggcatgaacgtggataggacgctgggctttgggctccttgccatatatacgcgatgcttgagtactactccctgcctttttgctcaatttaaaggctccaacggcttttccct

SEQ ID NO: 64268 - DNA, 369 bp, Triticum aestivum
  Clone ID: PAT_TA_64268
ccggagcgcggacggactttccccgttgcccgacacgctgtaagaatactgaacacccagaaacgagagagcaccatgacaaagaaagaaccggtaccgctgatgccggaccctgacgaggttgagttccggcaactgcaataatcatggcccggccggccattgcatatgtgcggatgagacgagccaaagaaaacagaacgccccgcccgctccggggcagcagaacaaccggactcacccgaccgggcgaagaagaacagacttgcggtggagagcagaaagaggagatcgcgacacgaggcctaagctaggcactggacggggctgtacaacacagcgactggaaagacaagaccctacccaacc

SEQ ID NO: 64269 - DNA, 322 bp, Triticum aestivum
  Clone ID: PAT_TA_64269
ttggacgatgccgaccggtccgattttccggtttgccacgcgctttacctttttaagcttataggcagccaccagggagacgcatgtgacttctccatctcctcgtgctgcacggtgactgagcgctgtgggtcagttgcacaccacctgtcgtcagggctacggtcacatggccactgtagccgtaggcagaagcgcatgcacagacatgaacgaacacgtgcgctgctttcgtgtgagaaagaactgagacaccacatgtgcagagacagaaggagagacgagctgcgccagtgggcgaacagagtgcgcgtgacccaaa

SEQ ID NO: 64270 - DNA, 416 bp, Triticum aestivum
  Clone ID: PAT_TA_64270
ggaggaaggaggccagcgcacagggcgaagggcctaacgccgctgcccgaaaaccggttaaatttccgaccaccagggagccgaggagagagggcaccatagaagcaccgagtaccgcttgatgctggacggctgacgagagaagagttcgtagcaacggcaagaaggcagggtcatggggggccagagccactgtgtggcggaggccaagaccaaagatgaagaggaagcggcgcccgccgcgggggagaacgagcaccgggacggagacggacggggacgaaagaagaagagagactggggcggcaggagggagagaggaacgaggagacagaagagcccaaggccgaaactgggcactggtcgacaacgtacagactgggaaaagggagaagcttgccaacacaaaagccaag

SEQ ID NO: 64271 - DNA, 374 bp, Triticum aestivum
  Clone ID: PAT_TA_64271
gcacagggctgaggcattaacgcctttgcccgttaccctttatactttgtgaccaccggcgacccggcgcgagagatcaccatgattcaaccagtaccgctgatgccggaggctgaccaggatgagttcgtgcacgtgcaactggcgtggtcatggccctccagggccattgtgtgtctgaggaggagaccatggagaaagaggaagtgcgtgcccgcctgcggtcggagcaagaacaacggaaccgcaatgtcagcctgacgaaaacaaaagaggaactgcggctgcgagtgcgaaaactggaagaggagctcgctaacactaggcctaagcctggccctggccgacgactacaacaccgcgacagcaaaacc

SEQ ID NO: 64272 - DNA, 436 bp, Triticum aestivum
  Clone ID: PAT_TA_64272
caggcctgaaccctgtggcaagcgggcacgcagggcgaaggcgttaacgcctttgcccgacgccctttacaacggtttaccaccggcgagccgtcaccagagttcaccaagattcagttagtgctgctggttcacgcttgagtgaccctgaggacggtcaagctcgtacaactgtggtcatcatgggccttcggggccatgggtagtctgccgaggagtacgtgaaaaaggatgaccggcttggctcgctgcgcgagcagcgggaacaacttgaccgccaggccgggacgacagaggcgaaggaacaacttgcgcttcgtgtggcagaggatctaagaggacctaggtcacaccagggctctgctcggcgctggacaacgttctacatcgtcatgactgggagaaacctagcgtaaccgaactgaatcacattgca

SEQ ID NO: 64273 - DNA, 156 bp, Triticum aestivum
  Clone ID: PAT_TA_64273
acacccgcgtgccttcaccatgattcaccatgaaaccgtcgatgctgctggatgtgcctgatgagtgtgagaacgtacaactggtgcaatcatcgccattagggaccttggttgctatggggcgtagggcatggcgaccgttgcacgggatgaccg

SEQ ID NO: 64274 - DNA, 367 bp, Triticum aestivum
  Clone ID: PAT_TA_64274
agtcctttacgaccgttgatcagagtgcgtacgtgacgaggattcattaggggacagttgattctgttgactgttcttggtgagtgtgggttcgtactattgggacaaaaatggtcttgatggaccttagggtctatgtgatgtatttgcaggcgaacatggagaaagatgcacagcttgagctcgctgctggagctggtgaaccgatatgactgtcttccgggaccgaaggagaagatggttactactggcgttataggtgaaagaggtgaaagaggacctaggtgatacgggtgcgaatgttcggaggttgacaacgtttttcaatgggaaaaccttggagaaacctaacataacctgcttgaat

SEQ ID NO: 64275 - DNA, 245 bp, Triticum aestivum
  Clone ID: PAT_TA_64275
agtctcagtgtcacgtacaacctggctgtaattcatggctccttcggatgccaattgcttctcttgtggaggagtctcattgacgaaagtacgaactgatttgcccgccttccgctcgcttgggtgaaacaacctgaactcgtgatgtcaagtctgaccggtgacgaaaagaagaacttggcgccttccgtgtggcagatgctgtatagaggagctttgatgacacgacggcctaagcttgggca

SEQ ID NO: 64276 - DNA, 396 bp, Triticum aestivum
  Clone ID: PAT_TA_64276
gtgaaacacagggcaagaagagaagagagaagcaaagcttgagatggcgcaaaccatggcgtgcatgaccggcctgtcgcagggcgtgcgtatcccaggcccgaccggcaggcgcgccagcaggttcaccgtgagggcgtcgcctgcggaggcggaggcctgcggccgccgtgcggtccttggtctcatggccagcggagtcgtcggcagcgcgttcgctcaagtggtgcacgccggcaccgtcggggacatcaaggatgggccaccgacgacgctctgcggtggactgcccgtgacggacaacttcgacgaggcaagggacttcgacctgcccctgaagaaccggttctacctgcaggcgctgccaccggcggaggcggcggtccgggccaagga

SEQ ID NO: 64277 - DNA, 376 bp, Triticum aestivum
  Clone ID: PAT_TA_64277
tcgtttaaaaaattaaaaaaaaaaaaaaaaaaaaaaaaaaaaaaaaaaaaaaaaaaataaaaaaaaaaaaaaaaaaataaagagaaaaagaacaaacaactgaagggggggggggctttagaggaccaaagtttacttgcggggggaatgcaagaccaaagattttctaaagggccacctaaattcaattaatgggccgctgatccaaaaacgtaggactgggaaaaccatgggaaaaccaactaaatgggttggaaaaaaataacattttctcaaggagacgaaaaataaaaaaggccctgaccgatggtctttaacaacagtagtgcaaacagaatggcgaaaggcaaccccattgtatgggagcataaagccc

SEQ ID NO: 64278 - DNA, 202 bp, Triticum aestivum
  Clone ID: PAT_TA_64278
ttcaagcgtgccttcgtccactggtacgtgggtgagggcatggaggagggagagttctctgaggcccgtgaggatctcgctgccctggagaaggactatgaagaagttggtgctgagttcgacgagggtgaggatggtgatgagggtgatgagaactactgcttctgtgattgcgatctgcagatctgcccgagtggcttta

SEQ ID NO: 64279 - DNA, 197 bp, Triticum aestivum
  Clone ID: PAT_TA_64279
ttttaaaaattttaaaaaaaaaaaaaaaaagagggtgatcagatataaaagaacgatgattctgttgggtgcatgcgagggctttgttttcgtatagagggttctatcttggatcttctgggcgatggttttttatgtgggggactgcataaccaatgatgtgccgaaagtttatctccttgcggttggtgaacatc

SEQ ID NO: 64280 - DNA, 460 bp, Triticum aestivum
  Clone ID: PAT_TA_64280
ttcggcgctgccggcaaggcggtggcgtcgcgcgcgtccttcgccgtgcgcgccgcggcgcccgagaggcccatctggttccccgggagcaccccatccttcgtggcttgacggcagtcgtttccggagacttcgagtttgacccctggggtgtaggatccgacccggagagcttgcggtggaacgtgcaggcggagctggtgcactgacggtgggcgatgctgggcgcggcgggcattttcatcccggagcttctgaccaagatcggcatccttaacacgccgttgcggtacaccgtcggtgagcatgagtacttaaccgacaccaccacccctttaataggggagcttattcccatcggctgtgccgagggccgccggtgggcaaacattaacaagcccggctgcgtaacaaggaccccatttttccaacacaagcttaccgcaccgacgttggtccc

SEQ ID NO: 64281 - DNA, 406 bp, Triticum aestivum
  Clone ID: PAT_TA_64281
tctttcacgcctgcggccacgcgtccggtgattacgatgcctcatttcacatacggtcggcgtatgctatgttatggatagctcctgtcgcaacaacatgacgagagatcggagcttctgttcccccaaaaatgtgagatggagaaccttactagcgagcggccggtcgggcggctacgttatgtgcctgagcagctgacacctgcaaagagctctctttttagaccagacgacctgtggcgatgctagccgaggccggaaacaacgactacatacttgcatcgctacgagctgagccttgacgttcttgacatcatggaggacagcataaggcccaagatgtgcccgcgcagatgccttgcttgcatgcgcatatcgccaggacctgccctttcaacatgatgat

SEQ ID NO: 64282 - DNA, 224 bp, Triticum aestivum
  Clone ID: PAT_TA_64282
attgtttggccaccttcgacactccgcctgtgtcgacgacgatataggtagcgcgatccgtgctcatcgctagggcgcgggctcccgtttcaagtcacacacccaccaccataagggccccggccgtttgatgtcgttcgacttcggccatcgcaacagatacactaagggcgctcctaccgttgttatgcaaacacctgagcctggttcgccgcttgacaagg

SEQ ID NO: 64283 - DNA, 467 bp, Triticum aestivum
  Clone ID: PAT_TA_64283
gcctttttatttagcatgccagtaatattatagctctggggataatattcttgcacactttagatgccatttgatagattgggaggacaggtaaatttacatatgacagcagagttctcttcaccaagtatatgtcaatacatgtctcaatggcatggctttgggatcgagatctaccttgctaacgttacagatcaattgtcaatagcttgttgaaaatctccccttgtttgtaatgtaaggatcttatgtaatcttaaggtttgcagctaatagagaaacccaatccaagtaaaagttttcaacccaatccaagtaaaagttttcagtattgcttaattgtgtgagtgattaacactttttggttgtgctgaatttcactcctacatagttttattgacaatttttatattcctttcattcaaatgaggcacaagatagatcacatctatcgcaacgtattggag

SEQ ID NO: 64284 - DNA, 449 bp, Triticum aestivum
  Clone ID: PAT_TA_64284
tttagcgacaacaaggaggacatgatcaacgacgggatgcacgagttattagcgcacttgcacgggcccaaagacagaatgtaccagggcggtcagtggaaggtgaggggtgacctcacagaacactgactccttacgaagagcagttccattggcttcaacaaacagatcgatcacctaaatgtggttgagaaagaccggaacggctgtttggatgtgaccaacccgacctggaacccaatgttccgccttgtgaatatttttgaggagttccgggaccagattgttctttactggaaccgctcggactcttacgaacggggaggctgggtaaactcatgatgcgcgacacgaatgcctattgaaaaacagtcaaagaatattgggagagataagcccagcctggacacatattcctcggactaagaagaagatgaggaggatgaaag

SEQ ID NO: 64285 - DNA, 420 bp, Triticum aestivum
  Clone ID: PAT_TA_64285
tgtgggatgctggcgcgcagggcggagccgttaccgaatttgcgggttgacctacacattttttgatcaccggtgatctggtgcgataggtcaccatgatgcagccaacaacgctggggcttctgggtcagcaggaaaagaaccagtcacgcgcaagcgggtgtcaacatggcatggcgcagcgcgagcacaatctggaggagaccacatgagctgaggacgactgagatgacgctttgcgctcaacagggtgaagcatttgcagcgagatggacacccgaaagctatgaaagaacagctggttgtccgggtcggactgcacgaagacgagttcgatgacatgatgttctaatactgggcagtggccggtggaccacaagcggttgactggcaaagccctggccggacgaagttaagctc

SEQ ID NO: 64286 - DNA, 345 bp, Triticum aestivum
  Clone ID: PAT_TA_64286
cctgctgggatgctgccgccccgcggggcggcggcatcgactctgccggccgccccccgaactggtttttcaccaccgacccggcgcgtggggagaccacgatgtatcaagcaccaccgctgctgctggtggcccaccctgaggagttggtgcgccaacaaggggtgtcatgagtggccctgcgccgccagttgcttctgtgtggaggacatcacgacagatgaactgctggtcgccctcctcccgttggtgggacaacaactccaccgtgatggcctgccggcggcgacaaaagaacaactgccgctccgggcggcacagctgaaagaggtggttgacgccacg

SEQ ID NO: 64287 - DNA, 164 bp, Triticum aestivum
  Clone ID: PAT_TA_64287
tttttcgaggaggagtccaggaaaaacgatgaactgaccgaccgtactcgctcggtggatgaacaactgtaccgagatggcagtctgacggagacgaaagaacaactggcgcttcccgtggcagagctaaacgaggtggttgatgacacgcggcctatgcttgg

SEQ ID NO: 64288 - DNA, 402 bp, Triticum aestivum
  Clone ID: PAT_TA_64288
ccggggggagtctggtcgtaagggttaaacttaaaaaaatctgccgaaacccctggggagggacactacagaggacgcctgccaacattttctgcattatgaaggctatacagcacttaaacgtgtttgacaagcctctcgaccaaggaagacctgatggcccttccgagtgtttttgcatgactgttctagccattgtttcaatactaccagacacaatttaacaacatctgcttcctgtgacgacgttaaggaccctggtttgctgtggtccaagatttcttgtactgctttgtttacaagtgattgggtataaacacgctactctactgctggtgattttattattcatccacatcacctttggtaagtcctgtttgaaaggtgggcttgcttcgtttg

SEQ ID NO: 64289 - DNA, 444 bp, Triticum aestivum
  unsure (1)..(444): unsure at all n locations
  Clone ID: PAT_TA_64289
acagcgcgaagagcaaaacgccncagcccgaaacacgaaaaactgggttaccaccggcaaaccggcacgagagaaaacgacagaacaaacagaccgaagaagccgatgacagacccagaagagaacgagacaaacaacaggcgaaaccaaggcccaacggagccaaagcacacagggaggagccaagacaaagagaactgatgcccccacgcacgagaggaaaaagaaccggagacaaacgaaagacaaaaaaacagcacaacgcgggacaaaacagaaagagaaacaaagaaaacacgaggacaaaacaaaggaacaggacagaagaaaaacaaacgccaatgaacagggaaaaaccccaggcaacaacccaaaaaaaaaacaccaaagcaagcaacaacacccccacaacgcacaacagggacgcaaaaaacaaaaaaggac

SEQ ID NO: 64290 - DNA, 465 bp, Triticum aestivum
  Clone ID: PAT_TA_64290
acggtgtttgtgcacccggcattctatgagggtgttgaccatacctcaataaaggccattgcatgtggtcgttcaacatgatgaactgcagatcgtgcaacaggtgagatcatggtgcacggggggcacggctactatatggaggacttacacagaatgacgaggaactgagtgtgcttgtggacttgtttggtaagcaacagaaacacgatgtccactggaacaagacctaagaaggagtgcttcttcgcatggaggagaagtacaccgggctgctgtactctaagaggctgattaccacttgtcgtgtctatagaacctggaagcatggatacaacctggacaggcgcaagaaatgtcgctaccttgaaatgctctatgccctgaagtacctgaaaatggataggactgtcccattggctgttgagagcgagaccccagccaaatgagttatgcttaccagag

SEQ ID NO: 64291 - DNA, 443 bp, Triticum aestivum
  Clone ID: PAT_TA_64291
tcgagtataacctggagaggatcatggtcggcgtgaacaccagtgtggacggcctcaagcccggcggggtggcgccgcagtccgcctggccggcggcgggaaagcgcgtgcaggtcgccccggccaaggaccggtggtcggggcttctcggcctggggggcgcttttggcgtcacggccgtctgcggcgggtcggccagggcaagcgtcttcgacgagtacctcgagaagagcaagctcaactaggagctgaacgacaagaagagggcggtgacgagcggaggcaacttcttgcgcgcctacaccgttcagctcggcagctgctagttaccctacaacttcaccggatgtcaggacctttgcaagcataagaaagttccgctcatcaccgacgacctggagatcgagtgcgaggggaaggagaagctcaagtgcggatccaac

SEQ ID NO: 64292 - DNA, 337 bp, Triticum aestivum
  Clone ID: PAT_TA_64292
tcgattttgccaatcccttatggaatgacgtactggagctccctgtcacaaatgctacaaagtcagtgataacttgatcaagacgatctacccgcatggcacaaactaccttggcggtgagagccacgtatcgtggaagagtggcacggtcctccaggactagattctgaagctgtagaatgtggacagtggctctgtggcgctacatctggaatgggctcacgcccctggtgttaccctgctaggtgcgcccgactgaatggaggtgcaacgctgctcgatgactctgcatgtatcggtccctgtttctggaatcagatgtgttagcaatttgtgg

SEQ ID NO: 64293 - DNA, 142 bp, Triticum aestivum
  Clone ID: PAT_TA_64293
tttccgcactatgagaccgcccacgcatccacggggccccggccaaggacatcgaccccggcgaagccaaaccaacagaaacaggaccgcccgcctaagccccagcactcaagggaagcaaaccaaggcaacagcagaagcc

SEQ ID NO: 64294 - DNA, 338 bp, Triticum aestivum
  Clone ID: PAT_TA_64294
aaaaaagaattgtacggatctgaagaccaatggaagctgacgcacagggcgaaagcattaacgcatttgcccgtcacccgaaaaactggtgtaccaccttttcaaccggcgcgagagttcaccaggattcagacagtaccgacgatgctggtggctgaccctgaagagttcgtggccggacaactggcatatactcatggatccttggcccccatgggccattctgaggagggggttagtgacccaagacgaaacggagagcccgacgtccggtctctgggcgaagaactgaacaccttgaagcgcagccagacggggtacgaaagaagaacgtgggg

SEQ ID NO: 64295 - DNA, 365 bp, Triticum aestivum
  Clone ID: PAT_TA_64295
tttggattttcaacggcgaacggctgagggggttctgcaggatcgagcaagtctcctaacagcggccggactgcccatttaaacagaagctcttccgaaaagccatatcatggactgaatggcgcagagccatctatgtggaagcgtacatgaaaagcgatgaacttgataacaaaattctgatcatgggaaaacaagtgaactgaaagaagagctaagtctccgaaaaattgaagaattgatacaatgctggaaactgaccaagccaggagggtgttaacggtactccacaactaggacctggtcagggagatcaatcttcgcgactggtaaaacaccacccttgcccgagctgaccttgtttg

SEQ ID NO: 64296 - DNA, 369 bp, Triticum aestivum
  Clone ID: PAT_TA_64296
tttttcgctttttcaagcgacctatgcggcgcgaattctccaggcacaaccgacgaagattctcgctggccgtggagggagccgagcccgaaccatgaacactaggggcttcctggagcctcagaagtgatttttttgatggcattgagcacagagagatacgatcatcagctgattgtttacatgagatagatgaacatcataatgagcgagctatggatggaatgcaagatctagtccttattctcaagaggataacaggtgatatagatgactcgggggctgatcattacccttggctgtacacaatggggaatgacctggaacatcaagggggttcctatttggaacagtggactcattcaagac

SEQ ID NO: 64297 - DNA, 378 bp, Triticum aestivum
  Clone ID: PAT_TA_64297
acattcggtcatcaactctgacacggatgaggaggctaacatcaagctctgaaaggccaggactgtgcaggtcggccagaaggggatcccctacctgaacacctatgattgacggaccattcgctacccagaccctctatgaaggccaacagacactataaagcatacgagctggagaccaacaagattgtggactaactaaagaaccacgatggtaacctgaccatgacgactgacgaactcaacactgggcgtgtagatgtgatcaagaacctggagaaccctagggcaacctttgagaccatccacgttgaggcagcccagggacagcaaaaacccacccgtttgggcaatgaattcaccattggcacaggcacc

SEQ ID NO: 64298 - DNA, 424 bp, Triticum aestivum
  Clone ID: PAT_TA_64298
gcctttgcccgttgccccacacactcggtgttatccggccaccccccacgcgagctcaccatagttcactcagcaccgaccatgctggtgcctgaccctgatgaggttaccaacggccaactggcctcatcatggaccaacggggccatcgcctttctgatcaagtgtacataacccaagatcaactagatcgtcgacatcgctcgcttcgagaacaacttaaccgagacatcaagctcaccgggaccaaagaagaactgcctctccacgtgcgaaacctgaaacaggacatgaacgacgccacgcctaccttcgacactggcctctctaatacaaccttgaaactcttgacaaacaagtgcctcccaaatcacaatgcgcgcaacacattccccttgattcaattcaacaaagaccgaagagg

SEQ ID NO: 64299 - DNA, 358 bp, Triticum aestivum
  Clone ID: PAT_TA_64299
acgatcgaagacttgtgacgcgatccaatggggaatgaagaccgtggcaatatcggagtcagttgggggcatggttgcgaggagcaccaggatgatgcgaggcaacagaagaggcctgtcagtgtctttaggcggtaacgctggagccatgatgcaagcagaccggaagattacaagatagagacacctcgagggacatatctggaggactggtttggaaaggcaagaactgcaatgggctgtggtcgaggatgtacaccaggcactgaggaactggcaatgtgagggcatgaaggtttacatagactccaatggcagtagagagggacagaggctactctgcggacatacatctgat

SEQ ID NO: 64300 - DNA, 357 bp, Triticum aestivum
  Clone ID: PAT_TA_64300
gctttccacgagcccggataattaacgcgagcatgctacgtcgtaactgttgttttatttcatcaaattacaacaaactgcccgccgttttacaacaacgtgactgctaaaaccatggtgttgcccaacttaatcatcttgtagcacatcatccttttgtcagctggtgtaatagtaaagaggagggcaccgatcgtcgttcttaacaatagctcagcatgattggtgaatggtacgagccctgcagcggcgcatcaagaagccgcggctgttgtggttacttccagcatgaccgctgcaatagtcagcagcgtagtagccgctgcttttgttgttttcttttccttttttgtcacg

SEQ ID NO: 64301 - DNA, 199 bp, Triticum aestivum
  Clone ID: PAT_TA_64301
gaggagccaagaccaaagaagaacaagctcgcccgaccccgaccgctgggggaacaacagaaccgagacgacagaccgacggggacaaaagaagaacaggcccaccacgaagacagagcaaaaagaggagcccagacaacaccagcgccaaagcaaggtactggcacgctggtcaaacaaccgaaagagaccgagaaaa

SEQ ID NO: 64302 - DNA, 288 bp, Triticum aestivum
  Clone ID: PAT_TA_64302
ccggcgagccaccgcgtgagtccaccatgatgtaattcagaaccgatgacactggccgccgacccacaacagttcgactgcgaacacccggcggtatcacagctctatcgcgtcgcagcacatccgcggaggaccagatgacgaaagatcaactgagcgcccacctaccgtcgttgcgaacacaagtgcaccgtgaatggagactgacacgcaccaaagaacaactcactctccgcgtggcatatcttaaatacgcgcatgatgacacgagcactaacctgggcacta

SEQ ID NO: 64303 - DNA, 318 bp, Triticum aestivum
  Clone ID: PAT_TA_64303
ttaatataaaaaaaaaaaaaaaaaaaaaaaaaaaaaaaaaaaaagggggggcggttttgggggtcccaccctgcggtccccgtcctggcaacccaggggtctttcgttggggcagccaaatttaatttcttgggcgggggtcccacacccgtggccgggaaaaccctggccatcccccagtttgagcacctggcaggccttccccttttaaccggttgggaaaaaaccaaaagggccccagcgggcggcctttccaaaaggtcggcacccttgaaggttaaagggacccgcccctgctgggtggcataaggcccgccc

SEQ ID NO: 64304 - DNA, 373 bp, Triticum aestivum
  unsure (1)..(373): unsure at all n locations
  Clone ID: PAT_TA_64304
gcggagcggaaaacgcggggggacccacgcgcccggggtaggattcccccccccacccagaccncggcacgcgggagggaccagcaccgaccgagagggcccaccccgagcggggaagaggaaggcaaggcggacgaccaggaccgcagctacgccgggggccacgccggggccaccgacgaccagagccgacagaacgccccccccaagcacggcgacggcaccgacgccaagaacaacacngacagggagacgggcacgacccgcgggcgcggggncggcaccagcgcagagaacaaggcgaagccccaggcgaacgaggccaagaacggccaggaccaggacggccgcaacaggaccgacaacgaggcgc

SEQ ID NO: 64305 - DNA, 327 bp, Triticum aestivum
  Clone ID: PAT_TA_64305
aaaacgcctgcgcccgcacccaaaaaacggggataccaccggcgacccggcgcgagagcacaccgaggaacataaaacaccggcggcgccgggggcacacccagaagagcacgagcccgcacaacgggcgaaaacagggccccggggcgccagcgaccccccgcggaggagcccaagacaaaagaagaacagagcgcccccccccgcccgcggggagaacaaccgaaccgagaggacagcccgacggggacaaaagaagaacgggcgccccgcggggcagagccgaaagaggagccggaggacacgaggcccaagccgggcacgggc

SEQ ID NO: 64306 - DNA, 491 bp, Triticum aestivum
  Clone ID: PAT_TA_64306
attgctcggcgcgggcaagcaagccatctgcacgggcggtgtgcagcgaggccgcacggacggggagcagggaggccgcgcaggcagcgagcctggcggacgcgcgggcaacgaatccatccatccacggccggtgcgggcaagcaggccatccgcgcgggcggagagcagggaggccgcgcgggcagcgagcatggcagacgcgaggacggcgagcatggcgcgcgtgggcggctcactccaccgacgacttcttccatcgggcgcgcggcggcctcttccctcgagcgcgcagcggcctcttccctcgggcgcgcggcggcctcttcctcgagcgcgcggctgtctcttccctcggcggccgagggcggcctcctccctccggcgtcggcccgccaatgctgcaccggtgcacggcggtgcccctctctctctccaggaaccagcgagcacggtcgggcggcggtgccgaaacccagggtcggagagcg

SEQ ID NO: 64307 - DNA, 362 bp, Triticum aestivum
  Clone ID: PAT_TA_64307
gtaaaaagaagggctttccacagatacataaacagtagtatgtaccaaggttactcgattgcaatgtgtgaatttatgaaatttctgagaccccccaaaaaaaaaaaaaaaaaaaaaaaaaaaaaaggaaaaaaaaaaaaaaaaaaaaaaaaaaagagacaaaaaaaaaaaaaaaaaaaaaataaaaaaaaaagaaagctaaattaaaactactgaaaaatgcaaacaaaattcaatgcacgggaaaaccactttacaaacccaagactaaaaaaaccaagtcatccccatttcaacagctttcaaaataaaaaacatgtccgcaacaaacgcaatatccaacagacgcacacccatattgc

SEQ ID NO: 64308 - DNA, 287 bp, Triticum aestivum
  Clone ID: PAT_TA_64308
accccagacagcgggcgcgaatgaacggggggtttttgaacaccgggcgcggggggcgcgaaggcgcaagggctgacataccgaaagcgccacaatacgcacgaagtgacccagatctccctggacaagaccccacgaggaaggattgagtaccagcccacctagaagcgggagagtaacacaaaacgcccggataccggccagacagatccaaagaaaaacacacccgctgcctacggaaaacaagaaggacagactgtgaaacaacaggacgactgtggaccgtg

SEQ ID NO: 64309 - DNA, 226 bp, Triticum aestivum
  unsure (1)..(226): unsure at all n locations
  Clone ID: PAT_TA_64309
gcgaaggcagaaacgccacngcccgtaacccgaagaaaaaccgggataccaccggcgacccggcgcgagagcaccaggaggaaacagaacagcaccggcgccccgggggcccccccgaagagagaaaggagccccaacaaggcggcggaaacgggggccccgggggggccagcgccaccgcggagggggagcccgacgacaagaagaagaaccgagccgcccgccc

SEQ ID NO: 64310 - DNA, 334 bp, Triticum aestivum
  Clone ID: PAT_TA_64310
cctactcgtccggccacgcgtccggtggactttgggtacctttacgagggcctcggcggggagcgcggcaagcgcaagcgccgggaggaggaggcagatgcctccgattccatggagctcgacgcctacgcgccccggccgtccaagctccgtgcagtggtctgccagtccgacccgtccaagccggaggccttcgggtgcgccacctacgacggggtcatcagcgaacacgtctcgctgcgtacatggaaggtgccacacacgctccggtcctccgcgctgatggtgtcctggaagcccgtccctatggagcagcgcgtgagggacacgtgcc

SEQ ID NO: 64311 - DNA, 451 bp, Triticum aestivum
  Clone ID: PAT_TA_64311
tgtctctctgtaagcaaacaagagattcatgctgtgttatcgagcaatgttcctcccaagcttgtgatcctccacatgaatatggccctccatgtatatgacgatataatgaggatgacagaaaatttgagcgagaaatacataattgggtacggggcatctagtacagtttataaatgtgttctgaagaactgcaagccagtggcaatcaaaaagctatatgctcactacccgcagagtgtaaaggaatttgagactgagctcgagacaattggaagtatcaaacaccggaatcttgtcagccttcaggcttactcgctatcacctgctgggaatcttctcttctacgagtatatggaaagtggcagcctctgagacgttttacatgcaccttcgtccatgaagacaaaactggactgggaggctagactccagattgctcttggcactg

SEQ ID NO: 64312 - DNA, 349 bp, Triticum aestivum
  Clone ID: PAT_TA_64312
gccatgcttaaagcctcttgcaaacgctgctgccgacggcgacggaacaggagacatgccagcaaagatggacccgaagctagaggcgtaggtctacgtgggggtgtccgtaggcgagaccggaggcgatgactggctggcccccaagatcgggcccatgagcctgtccctcaagatgatcggcgaggagatcggcgaggagaccgccaaggactcggaggaggtctggaagagcctcaaggtcaccgtccagaacagcgaggacaaggtctatgtcaaagcttcggtcgtggctctcgtcatcgagctcctcaatgagccccttaaggacacgcagaagggcaagaac

SEQ ID NO: 64313 - DNA, 276 bp, Triticum aestivum
  Clone ID: PAT_TA_64313
cagtagctcatggccggagctcaccgcacacggccacacgcacaaggtgaggtgaggcaggctcgctaggaaggaagccatggagatcgggtctctggcgccgcgtgagaggccgcacgccgtgatgatcccgtacccggctcaaggccacatcacgccgatgatgaagctggccaagctgctccacgccaggggcttccacgttatcttcgtcaacaacgagttcaaccaccggcgcctgctgcgctcccagtccggcgacaggctacgtgggct

SEQ ID NO: 64314 - DNA, 378 bp, Triticum aestivum
  Clone ID: PAT_TA_64314
tatatacctcccaagtagactatctccagcagaggaaaaacttcagccgaatcgacacgaagctccgcacccaggtggtcgctccggcggcagcaacacagtcgtcgtcatcggtgttgatgaggagcgtaggcacaaagatgacgccaagattgacagctaggagcagtcgaggagcggcactctagccggtgcatgccaatcaaatgaaggcggaggcgtagaacaacatgaccaagaagtaggcgagatcgaggcgagaaaggacggccgggtagcccgatcggcgcgataggtggagcgcatccggaagatcgaccgcatgtcgtcccggttccagtgttgcgactgattcctgagctgaaaaataaacaaaat

SEQ ID NO: 64315 - DNA, 288 bp, Triticum aestivum
  Clone ID: PAT_TA_64315
aattaaaaaaaaaaaaaaaaaaaaaaaaaaaaaaagagagcaaaaaaaaaagaaaggcaggcgaagcaaaaacagggcggccggaaaaaaaggaaacacaagcgccacaaaaagcagccgggggggccggaagagagaacccagggtccacggacaaaaaaggcagggccacagctttacaacggggcaccaggaaaaaatttatcgggcccaagcttaaagacgctggaaaacaaaacccctgggcgcgcccaaccaaaaccgacgggggcccaaccccccctaccc

SEQ ID NO: 64316 - DNA, 390 bp, Triticum aestivum
  Clone ID: PAT_TA_64316
actgtatgagtggttgatgcatgcttttgcagctcaatctgaagttcgtagaccagaaataatattgaataaatgatgcaccttgacgagttagattgtcggcagcatctcatcttctcatcttcaagtttgagttgcgccaaccacatataatgtgcctcgtcgtcgagtcaacaagcggctgccggctgcgtcttgtctccaagccctaatcagcaggtggattgattttaatgaaagaagaacgatgcatgttaatgcggtgctaacaagatttgaatctgaatgtgccttatccctattagtattgaacaaactttcaaactccacgggaccacttctgattagcacctaattaactaacttaatgctaaggagggttggtgcgat

SEQ ID NO: 64317 - DNA, 473 bp, Triticum aestivum
  Clone ID: PAT_TA_64317
gtcgtatagggagttcacggtggaggtggaggcgatcggccgcgtccgccacaagaacctcgtccggctgctgggctactgcgtcgagggagcgcaccggatcctggtgtacgagtacgtcgacaatggcaacctggagcagtggcttcacggcgacgtcgggcccgtcagcccgctctcctgggacgcccggatggacatcgtgctcgggacagccaaagggatcacgtacctgcacgaggggctggagcccaaggtggtgcacagggacatcaagtccagcaacatactgctggacaagcggtggaactccaaggtctccgacttcggcctcgccaagctccttggctccgacagcaactacgtcaccaccagagtcatgggaacatttggctacgtggcgccggagtacgcgagcaccggcatgctgaacgagaggagcgacgtgtacagcttcggggtgctcatcatgg

SEQ ID NO: 64318 - DNA, 265 bp, Triticum aestivum
  Clone ID: PAT_TA_64318
tgcctgaactccaccaaactggttttccacggccaagccggtgcgggtgtatctcatgcagcagacacagctcaatgtacatttggcggcccctgatactggtgggtactgaacaccggcagaatcatggataattgcggtggatgtgaaaatatgtggagcgagtcagagataccagatgaacggtatgggccgcctatgatggctaaaagaaaaccagcacaccacagttgcacagactaaaaggaacgaactactgattgtc

SEQ ID NO: 64319 - DNA, 218 bp, Triticum aestivum
  Clone ID: PAT_TA_64319
acgggctttttcccgcgcttgctggccttgaggaatcccaggaacagtttgaaaccctggagctggtgtgtgaccctgatgagtacgccttcgtccagactggagtacaccaggtcctccaagggcggagagggtctggggaggcttgcactaccccagatgggctgactgtcatcctgctgtcgatgggagaccgacttgtgaaccttgtgatccag

SEQ ID NO: 64320 - DNA, 338 bp, Triticum aestivum
  Clone ID: PAT_TA_64320
ggatagctcgccggcggccggccaggtgctggtggtggctgtggcgatggcggtgctgttgctggcgcagcatgcggggcgcgtcgacgccaagatgatcttgtacgacgtgatgcaggcggacgaggtgccgggccgcaacgggctgacccacgtggaagaccaggccaatcggtacagccgcggctgcgaggcctccaaggagtgcagaggctaagctctaatccagccatgctcaatgaccaatttgtactccttacattcctcagttaccttgttgctacttctgctgttgagaggaagataaaaccccgcgcgattgctatggaatttgtttg

SEQ ID NO: 64321 - DNA, 298 bp, Triticum aestivum
  Clone ID: PAT_TA_64321
tttgaacagtgcaaagttagttaggagaagggataagcataacatgagcgtaaacaggggaggttactgtagcaccagtactttatccgctggatctccaacatctagtccaagtgaggaaagggtttcgtcagggatttctctgtcctggcaggatgtctataatattgctgtcaagtggagacagatttctgaaccttgtgatccagttgtttgggtcaataagctaagtgaagagttcaattctggttttggttctcacaccccattgctttttggtcaagcgaaaattggtcgc

SEQ ID NO: 64322 - DNA, 389 bp, Triticum aestivum
  Clone ID: PAT_TA_64322
gttgctccagcaatccgaacccacccaaccaccggacgctccgcggatcctcctcgtgccccgctcgcgatctgcctccgcgagcccaaccacccctcgccggagatgcgcgcctggtgatccggaggggaggagagggccgatgaggtgcaagctccacccgtacgcgaacgcgctcggcgtctgcgcgccctgcctccgcgaccgcctcctcgtgctcgccgccgagcgcgaccgggccggggccggggccagcagcggcgccgactgcagcagcagcagcagccggggcagctcgcccgcgcgcgggcgcgccgcgtcgaccttcgccgccgacgtcgtcgtcccggcgcagcaacaccggcgctctgacgcctgcgcctacacgt

SEQ ID NO: 64323 - DNA, 259 bp, Triticum aestivum
  Clone ID: PAT_TA_64323
taccgttaccgcctctccggtttgtctcacgcattcggaagtccagatgtctcgcaccggaccgatcgcccgggactgtttgccggtggtagtgtgcttgatgccccccaacagcgccggcaagaaggactggggggactatatggccttccgccgcgccggcgtcgacatggacattgccaagaagcattatgctgggacaaacaaagctgtttatagcaccacatcgctaactccaatgtggctctatgatgataca

SEQ ID NO: 64324 - DNA, 196 bp, Triticum aestivum
  Clone ID: PAT_TA_64324
accgaggactttttgggcgtttttcgtgggaaaaaaagaaaaagaaaatgacgaggtcatttcctggcgagcgcccaaaaacaaaataaaaaaccggcggtcgctctcgggggactaatctatacaaataccgtaaccgggcggcttctgtttagcggtggtaacctaaaatctcagtgcttggagccatgttgtt

SEQ ID NO: 64325 - DNA, 155 bp, Triticum aestivum
  Clone ID: PAT_TA_64325
aaggaagctggacaatggacaaggcacacggcggccaaacatgtgaggcggagacaaatgagacgatgacagctaatgaagcccccgagagggagccaatggactgggaccctgaagggagcacagaccacgggtccacctggaaaactaaagat

SEQ ID NO: 64326 - DNA, 265 bp, Triticum aestivum
  Clone ID: PAT_TA_64326
tctgtgcacactcccaccaacacacgcggcgggagcaaagcgcggcgaggcgagcgcgcgcccgcaagaaggacgggggcggcgaggaagggaagcagcaaccgcagctggttccggcgcacaagccgaacctcccctcgcagccagacgtggacgaccccgccaagggcgggctccgggaagacgtcctcgccgcagagaaaacccatgacatggcggcgctgtacgaagacatggcggacgacggcgtgacggaaaaggacgc

SEQ ID NO: 64327 - DNA, 161 bp, Triticum aestivum
  Clone ID: PAT_TA_64327
tcatttcttttttggcttccaccttcccctcacgcgcgggacctcgtagtcgacgcctgctcggagatctcgcctcgcccgccggcagcagccatggacgccgttgactcctaggtggaccccttcgctgagttcgcaaggacagcgtccgcctcgacaag

SEQ ID NO: 64328 - DNA, 303 bp, Triticum aestivum
  Clone ID: PAT_TA_64328
tcctgggactttcccacgcgaacgttcctttctccaggatctcgctggtcgtggagctcgccttggagcgcacttcggtgttttttgcgtacgtacgaggtacgcgcttgacacggtcgctacacccgacgagcacggtgtacgtcgtctcttccaccggtgacaggcgccgggcgcgagacactgagcgccagacgtgagcgagcagggactggagggacgagagggtggctgtggaggtcgccgagccgacgccggcgctggccacctcggcgttcgctctggacttcagcttcttgatgc

SEQ ID NO: 64329 - DNA, 455 bp, Triticum aestivum
  Clone ID: PAT_TA_64329
gctcacacgaaacagacagagacagagggaacaaacaacccagaacccgcaccaccaggacaggacacgaggcaaggaaagggaccgcaggaagagagccagaagaaaccgacccgagcctcaacgcggacgaagccggaacaaacgacaaggcaaaaagggccacaaacagaaacgaaaacagccaaacaaacgggcggcggggaacccacaaaccggggaaggaaaagaaggaaagaggggccagagaaaaaccagggccgaggcgaaaacaacacaaggagcaccaccgagaaaaaaagcacaggcaaagaagaaaaacagcaagaaaacgggaaaaacaccaaggcaaaccaaagacaggcagaacaaaggaaaaaaagaaccccgaaaggggggcggaaccaccaggggcaggaaggcaaagaaaaaaaaaaaaaaaaaggggggccgaa

SEQ ID NO: 64330 - DNA, 426 bp, Triticum aestivum
  Clone ID: PAT_TA_64330
ttatttacaaaaaaaaaaaaaaaaaaaaatagggaggattttaaaagaattttgtgtggatttaaacaaaacactaaagtgttaatgattcatacacttgtcgttatttatgtggtctatataggccattgttatattatggtggggggcatgttttaaggggacacagtttgtccgccttctgctcggtgggagaacattttgtctgtggggtcccctcagtctaatcctggggaggagctgacaccccgtgtgggggggaaaaccctggggctccccgacttaaggttttaggaatgataccccttttcccctgtgggtgataatcctggagggggcccaccctatcgtccctcccaacatctcgcatttcaataggggtatgggggccgcctcttttgggggcttttatgggggggggggggg

SEQ ID NO: 64331 - DNA, 303 bp, Triticum aestivum
  Clone ID: PAT_TA_64331
ttcccgggatttcccacgcgtccgttcacgtctcccagaaatggaaactgtgaccaccaggcatttcgtatggagtgtcattttttataacagccacctaaagtgaaagatgaactgacaagcgatggtcatctgccaacggacaacaggagactggaacgtgtggtgcacgaaacgaaaagaataactgcaagccctgcgccactgcatagatgaacaacgcaacggcacatgctcttgagcatgtgacaaaccaagagcagccaactatacatcagcggttgagcgatctgaacttgatga

SEQ ID NO: 64332 - DNA, 486 bp, Triticum aestivum
  unsure (1)..(486): unsure at all n locations
  Clone ID: PAT_TA_64332
tttacgtgttcgcccacgcgtccgggcagctgctccttctgcctctgccgtttccgtcaggcagaggactgccgcggcagcatcgccactgctccaggatcagcagcaagaaaagcatgaagctgctgatccggtgccgccgccgccgccgcgatcgacgctgtaccaggcgctgacgtcgacggcgagcctggccaacctgctccccacaggtacggtgctggctttccagctgctcgcgccgaccttcaccaaccacggcgcctgcgacgccaccacggcgctgctcacgcggatcctcctcgccgtcctcgcgctctcctgcctcctcgccttcttcaccgactccctcaatggccccgacggccgcgtctactacggcgtcgccaccctcaggggcctctggctgctcgactacccgcccggcgcgcncacgccgtcggacacgttcaggtacaggctggcaccaatcgacgccgtgcacgc

SEQ ID NO: 64333 - DNA, 203 bp, Triticum aestivum
  Clone ID: PAT_TA_64333
ccaaactttgggttaccaccggcgaaccggaacgaaaggggaggatgaaccaaacaaccccggcgaccaagggaagagagcgtgacgagaagcacgaaagccaaccggccgaagaaaagcccaatgcgggcaggaagaagcgaaagaggaagccaggacgaaagacgaacaacacagaccgtcaccagcaacaagacagaaca

SEQ ID NO: 64334 - DNA, 270 bp, Triticum aestivum
  Clone ID: PAT_TA_64334
ttctcatgcgtccgcccacgcgtccgcggacgcgtgggctacagcaaaagggaattctggctggagaagagcaccggcatggattgcatggcattgcacttgaaagcgtaagtgataacagggatcgatgacaggagatattgggttcacatgccaaacacagagtttaggttccagtccgtggcgtacctgaaccaaatattcgtggatcgaggtgttctcgggagatcgactttcacttaccggtggggacctacagcctttacttta

SEQ ID NO: 64335 - DNA, 115 bp, Triticum aestivum
  Clone ID: PAT_TA_64335
ttttattttcagggaccggacgagtagtaggccaggatttactctcccgggcgagtaaggtccgttgaaccagggcgccgtgcctacgcaccaacctcgatcatggaattccccg

SEQ ID NO: 64336 - DNA, 205 bp, Triticum aestivum
  Clone ID: PAT_TA_64336
atcttgcattttccagcgatcggacgaatgagtggaccatgatttagtcagcacggctctcactgtcggctgaacctggtgagtccgagcctgtacacctgccgcaatcatggccataacgcagccatagttctttcctggacggactacataacaaaagatgatactgagtgcctcccttatttcgatgggtgagcaactgaac

SEQ ID NO: 64337 - DNA, 315 bp, Triticum aestivum
  Clone ID: PAT_TA_64337
ggcaggactcccgccggcccgttccggaccggaatggttggctcaacccacgctgtacttttcacgcgtccgcccacgcgtgcggccacgcgttcgcccacgcgtccgcccacgcgtccgaccgttaccacgagaccccgggagggccgatctctgaagggtggcaaatctctgccttgaaatataagaacgtgaattacactttcgttagtgtttttggaatcgtgttggacgcccggttagattgatgtatatacgcatgctgatatcagagggatatgccaatagttttggctagatgggattctaaaaaga

SEQ ID NO: 64338 - DNA, 287 bp, Triticum aestivum
  Clone ID: PAT_TA_64338
cggcccgtaccggtctggattgcttggcccgacccacgctgtcctttcgagcggacgcctcagtatcataacacatacgaggagcgcctcgagcttttcagctcgctccgggagagcggagtgcttgtgcatcacaggttttgatagctgccatacccattcagagtagctgccgatagaagtccactacagatgacaaaaggtgatcataccttcaatacatgtttgagtaactgagtatattagtataatggtcgagataggtaaaaaaggattcggtttattca

SEQ ID NO: 64339 - DNA, 196 bp, Triticum aestivum
  Clone ID: PAT_TA_64339
gacttctgacctattctgtagagtcacctaatttcaaatcactggccttaggtttacaacgagccgactggtaaaaccctgggggtacccaacttaatatgcatggagcacatccctctcttgccagctggaaaaatagcgaagaggtctgtaccgatcgctctccaaacaagagcgcatcctgcatggcgaatgg

SEQ ID NO: 64340 - DNA, 274 bp, Triticum aestivum
  Clone ID: PAT_TA_64340
tttcctttcaggcgtccgcccacgcgtccgaaccaggtctgcatggtccgcgcccaggtatcatgcgcactggtactgggtctgctcatggacagcaaactccttagccattccaccaacatatggatccaaggggacgtgtgctccaacacccacctgcacctcggcacatccctgaggtccaacagatgcatggggttggtgttggaggtattcaacatccatatgacatgggaagctaacttgtgcaagatgctgctctgtgatctgctac

SEQ ID NO: 64341 - DNA, 250 bp, Triticum aestivum
  Clone ID: PAT_TA_64341
tttttgaaaaggaggaggaatctagggaatctaggaataatgggcgagcgctctggaggagccagggatacaggcacgcgagggcagcaagggaaggatacaatggtggcaccgaaactcaagtctcggctcgttgcttatacagtcccgacgacttggtaaaacattggtgtgagcaaaatttttagcattactaccaatactgttgttgcaagatggggtaatacttaataggctcctacctgatttc

SEQ ID NO: 64342 - DNA, 291 bp, Triticum aestivum
  unsure (1)..(291): unsure at all n locations
  Clone ID: PAT_TA_64342
cggcggcttccagcgcctgagtccgttgctcgacccacgctgtgttcaccgcanagccggcacacgggatgcccgaggtgcagttagnnacgcggaagctattggtcgatcttgatgagaacgccccctgtcatcgggactgagtgggggctggaacggacattgcggctcgctgagccagcccatgactaaggatgaactggttggcggcctccgctcgttgggtgtacactgatccgtgatgtaagcctgacggtgacgaaatgaagaactggcactgggttgggcttt

SEQ ID NO: 64343 - DNA, 455 bp, Triticum aestivum
  Clone ID: PAT_TA_64343
ttaccaaaccccgctccaaaatccccaaatcccctctcttccgaagctactcagccatgtcggggcgcggtaagggcggcaaggggctcggcaagggcggcgccaagcgccaccgcaaggtcctgcgcgacaacatccagggcatcaccaagccggcgatccggaggctggcccggaggggcggcgtgaagcgcatctcggggctcatctacaaggagacccgcggtttgctcaagatcttcctcgagaacttcatccgcgacaccgtcacctacaccgagcacgcccgccggaagaccgtcaccgccatggacgtcgactacgcgctcaagcgccagggacgcaccctgtacggataccgtggctgatgagcctctgcgcttgctggccggccgaggcgcacaagccctggctcgcggacaaaaaattgaggagaggaaaaagctgtattttaa

SEQ ID NO: 64344 - DNA, 314 bp, Triticum aestivum
  Clone ID: PAT_TA_64344
tctgttatccaagctggcgagcaaagtggctaccgcagtgttgtcggtcatggtggtgataatggccgggccggtcgccggagtgcgcgccggcgcgctcgcgatctgcatgggcatgtactgtgaccaggtctctctcgaggatgcgttcgcgacggtgaactacacggttaacaacaaggtctgtatcttgaccttcctgtggagccataagagggtccatgaacctggtcgtgaacttgcacctgcacagcaacccgtctagcacctttcttgggcaccttcgtaaaagcctgccataatgcctgcatata

SEQ ID NO: 64345 - DNA, 419 bp, Triticum aestivum
  Clone ID: PAT_TA_64345
ttctcattaaacacgcaagccgtctgcccccgcacggaaagtgatccgtcggaggcgacgcattcgtcggcgagctaaaacgacattattcacatctcagtctggggttgcgaattccttcgggttccgtagtagacgccttagcactaagcgttaccggaatatgctttggaactcgtctgtacttaggactaagattagaaccaatagcgctttcacgcagagtcaagcatccgttgcaagcttctgcacagtatacagtgggtatatacgatgccttcggcaatacagctagtcccttttggaccgcgggtggaggcgcattgcaccggattgagagattaaaaaaaaaaaacaaagtggtttttttcgataaatttaaaagaagaaatgtagagagctgtaagaagagccctttt

SEQ ID NO: 64346 - DNA, 371 bp, Triticum aestivum
  Clone ID: PAT_TA_64346
tgttttacgggctggacctggagctccaccttgccgcgcgtgatgacaacggtgacggctacggtaacaggaacaacaacaagaacatgtgcggctgaggctacggcgccggagggcggtgcaacaacaggcggaccgtggaggcgctgagatgaaccgactttgcttgacccgacctgaccgatgattagttgtagagcggttaaccttgctttaattgcttatatgatctgcgatccgagccgatagcttagctccttgcttttcgatgagcgttgttgtacatagagttagcggtttaatccgtgatgttttgatgggtattaacatcatgtttttatttgttggttgatttaaatttcttttttcta

SEQ ID NO: 64347 - DNA, 177 bp, Triticum aestivum
  Clone ID: PAT_TA_64347
ttttcctttacggagccaccccacccaccaaagcgatccgtcggaccggcgagcggcgagcggcttgagcaagggagagatggcggacaccggggaggagactgtgcaagcgtcgcacattctgatcaagcacgaggggtcctcgcacagggcgtcctggaaggacccgatgggccg

SEQ ID NO: 64348 - DNA, 184 bp, Triticum aestivum
  Clone ID: PAT_TA_64348
accttttgtttgtgtgggtgtgggtgatatgtgtgtggtctgtttctagcgggagcgcaagttttgtggtgtgaacctttttcgcgtgaatgaataatggtgctgcgtaaaatttcagatttgttttgctgtatagagtggaggagcgcctcctaggaagtaagatgtggtacgccgtttctcc

SEQ ID NO: 64349 - DNA, 273 bp, Triticum aestivum
  Clone ID: PAT_TA_64349
cgaaggcatacacgcccgtaattgttgccttgaaaaatttttatttacccgtcagacaggacggggctgacctatggttcaggatcgacagcaactccaatgccatggtttgagagcttgtttcaagctgcgagactggtaatataatgtccagtgtgggcattaacttgttatttcgtgggaaatagtgaaacatgtgtgacgtgtttgtttgtttgccattctcattgttttactgaacatacactctgtcttgtctactttagtttaaca

SEQ ID NO: 64350 - DNA, 322 bp, Triticum aestivum
  Clone ID: PAT_TA_64350
agcattctaccaccgaaccgaacgagtgaagtgagagctgtgcacgaaaactttatcagaaaccatgaagggcaccaagctcggggcgaagctgatcctgcaggccgtcctggacatgggactgctcttacacgtgaacgcatatgttaaccccaagtgctgcaacaactgctggtacaactggggggccgacgtgtgcgacgacgcccaccacaagtgttaccaggactgttctgagggctgcgtggtgtgcactagcccctaaaagaggcgctaagcggatatgaaatccaccgtggaatgcacctgtggcggaccctgc

SEQ ID NO: 64351 - DNA, 458 bp, Triticum aestivum
  Clone ID: PAT_TA_64351
ttagtgatgccgtagtggaagcgctccctatggatgctcttgttcatctcgacactgaagcatgttcatatctacaaggtcgagtcatggtccgtgtggaagactaccatccagagcaacctgaagtctctcttcatattacctggcagccaacaccccaaagcaatgggaaggagcaattgacagaatggaagagaacccctcctggtgctttgggaagcactaccggagcgtcaaacagctggaaattgtcggggcgtgcgaggacgagttcggggtgcccaacgacctgcatcttcctgatctgcaccttctcccgcacaacctcagacggctgaaaattagttgtcctaatctgctgaatgatgaaaaccccatgccattacttgggagctggctgacgttcctgaatgtgttggaaataggggtcaagtcatacactggcgcgaccatgacct

SEQ ID NO: 64352 - DNA, 379 bp, Triticum aestivum
  Clone ID: PAT_TA_64352
ggcactggcgcggaagcccggggtcgtcccacgcgtgttctctcccgcgcgcctgctagagcgcgagcgggggctctagaagaaccaggcgtagctgcgcgcgcatgcaacaaagaaccggcttcgagagtggcacctaaacttcaacccacctggggcgccatgatacaacgtgggggactggcaagaccaaggaggtacccaactggcatcggtcctgaagcacatgtcaccaaatcgccacgctggcgtaatgagcgaacgggggaccgaaccggaacgccggttccccaaacagtggcgcagccctgaatgggaaaatggaaacacgccagggtaacaggcgcaattaagccgccggagggtgtacaagggttac

SEQ ID NO: 64353 - DNA, 222 bp, Triticum aestivum
  Clone ID: PAT_TA_64353
cttctagcggaccttcgatagggtgcggccggattcattaagcatccggagctgcgggctaccttgagagttacgaccgaacactggcgatcgcatggcgcttcggggggtggagatttctgtggagaacctgcggactgaaagatgggcagagtagatgctttcgattgctggggggacaacagagccgggaaagcccattgaacgggacaaaagaagggg

SEQ ID NO: 64354 - DNA, 116 bp, Triticum aestivum
  Clone ID: PAT_TA_64354
ggggaggaattcatggcccaagagacagtgattgggcacctggggatctaagatgagaaactgaaccgccatatgggcatggcggagcctaacgaaggactggaactgcttgtgga

SEQ ID NO: 64355 - DNA, 400 bp, Triticum aestivum
  Clone ID: PAT_TA_64355
ttttctcgtacggctcgacggataagtagctagcatgatttccggaaggaagggcggcctctggaagaaggcagtgaccaggttcgtcaaggccgggctccattttcccgtcggacgattctggcgctacctaaggaagggccgctacacgcagagagtacgttcctgcgcccccgtctacctgggcaccgcactggagtacctcgctgccacggtcctggagcttgccggcaactctgccaaggacaacacgaagacccgaatcatccctagccacctgctgttcgccggacgcaacgaccaggagctcagcaagctgctcgccggcgtcaccatcggccacagcggcgtgatccccaacatcaacttccggctgctcccttagaagtcccccgccgcc

SEQ ID NO: 64356 - DNA, 307 bp, Triticum aestivum
  Clone ID: PAT_TA_64356
atacgttttttcctaccgctcatccgaaacgtgagttgactattattcagtcagaacggctgctgctgctagttggccctgatcagattgtgcacggacaactggtataatcatggccctccattctcattgtttctatgtagaggacgctacgaccaaagagcaacttactgccccacttcgttcgttggaacaacaactgagccctgatgtgaccctgacggggaccaaagaagaactggtgctacgggcagcacaactgcaagaggaacttgttgccacgaggtcttagcatgacaactcgacc

SEQ ID NO: 64357 - DNA, 484 bp, Triticum aestivum
  Clone ID: PAT_TA_64357
tatgatctataactgaaatgaataaagaagaacaggggggatttttttggaacatggagaataataaatgccttggtgtgctgtcagggcacacttttagtgtgtagtctctgacatgccattggggggggcctgttctggggatccagggttcctgcgccgggtttgctgcgctttgggtttttttttgggacccctaattcaaatttgggggcggtgttttcacaactgctgggccgggaaaaccccgggggtccccaagcttttcttcttgtggagatttcccttttcatccaggtgctgttttgacaataaggccctctcttttggcctttctaatgggtggtgcatcctgtgggggtattgggagccccctgttcagggcattttattcggggtggtggagttggttccccccaggggaaccctttctttttccattcccgtagccccccggttttttggatttttttccttttttttt

SEQ ID NO: 64358 - DNA, 343 bp, Triticum aestivum
  Clone ID: PAT_TA_64358
ttgttgttcacacaaaaaacaaacacaaaagagggggattttttaaaaaagcaccgtcgatgtctatggcctgccccagttgaggccgctttcccaacctaccggcataaaccctggccccttattagggggcggccctcttgggggtcccaactttcctaacgctgccctgcaagcccatctcccttctttggggcccccaaagtccacttcacggcccgctttctaccaccgttggaccggggaaaccccggggggcccccccctaattggcctgggatcacacccccctttaccctgggggcttttaatgtaaagggcccccccccgatggccttcccca

SEQ ID NO: 64359 - DNA, 261 bp, Triticum aestivum
  Clone ID: PAT_TA_64359
gtgttttccggaatgacgtcgcgggagagaggaagaagataatgtgtggagcacgctgttgctacctgcccacgctatgagcagtgtgaataaccaggagcatgcatgccgtgcctgggtccgggtgcaccggaggctggcatgtgagcaggggtgcaacagtgaggcagacgaaaaaaggctggtgttaaagggaagggaaggttacgcctttcttgcaactaaagaagaacccatgtaaacctgtgtatggaggaaggg

SEQ ID NO: 64360 - DNA, 376 bp, Triticum aestivum
  Clone ID: PAT_TA_64360
tttctcgtgggcggacgcgtgggcggacgcgtgggatctatgtattactgctggggctttagtccttcgcttccagcggcggctcaagacggctgagagagtgatgggaaccgtgaagcggttcaacttcaccaaggggttcggattcatcttcgcggaggacggcagccaggacctcttcgtccaccaggactccatcaaggccgacggctaccggagtctcaacgagaacgacgttctcgagtttgaggtcataaccggcgacgacggccgaaccaaggtcttcgacgtcaccgcaccaggagggggcgcgctcgccgggggatcccgccctggccaccgctgaggtgaccgcgggggtatccgctggggtggc

SEQ ID NO: 64361 - DNA, 263 bp, Triticum aestivum
  Clone ID: PAT_TA_64361
aaaacggttgttattcaccgagtcctactggtcggggggggaggtttttgaaatgccatcaggggatttctcccataacggcgataactttggaagccaacaaaacgcggtatcatgggccgggttcaacattggctgaagatgcccggttggacgagtaccgaagcaccttgcgtgggactagtcatattgggggaagaactgaaccttgaggtaaggctgggtgctgccagagaggatctaagccttcgtctagccaatct

SEQ ID NO: 64362 - DNA, 360 bp, Triticum aestivum
  Clone ID: PAT_TA_64362
tcccatgcgatttgttaatgacacaccctgcatttgaagctgcgcgccttgttcggaagccgggggccccttgctacggctgagacataggccaggggagaatcaacagttcttactccttggtttgcacctgtgtgctgccccgtggcttcaaaccctgccatgataagcagttaagcacacaacttgctgaacgaaatgacaaggaactactgttgttggtgtcaaaacaatgatataattgggaatgtgagatcacggacatcggtcagagaaacccctgcactgtaagctgcatgcactcgtaccgtcgtacataacctgtgatggtgtgagagtatacgtgaataacgggggggt

SEQ ID NO: 64363 - DNA, 426 bp, Triticum aestivum
  Clone ID: PAT_TA_64363
tttctaagctcatcttcttctccttgaaatcttttggggttcatcagatttggaggatgtcttgcaactgtggatccggttgcagctgcggctcacactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaattaccagcgtctgatctgatggagtcgagcaagggtgcgtgtgcatgtgcctgtggtttaccttgcttcgtctcccctatgctctg

SEQ ID NO: 64364 - DNA, 222 bp, Triticum aestivum
  Clone ID: PAT_TA_64364
gtctttaccacccagagcagagccgcggcaggggggagtgtacacagcgacgggggtccttttcgccagcgcgctggtggcgatcccgagctcaatggcgctgatggaccggctgcggctgggccggctgtcggcgggcccgcgcacgaggacggaggagggcaacctgcggcagatcaagccggggcggcaccgcaacttccaggagtgggcgaagcggac

SEQ ID NO: 64365 - DNA, 334 bp, Triticum aestivum
  Clone ID: PAT_TA_64365
tgcgggatacccgaaacacgggatttctttcgagggtccggagcgagagctcaccgggacctagacagcaccgaacttgcttggggcgaggcctgacgagttggggcacggacatgagagacagtcatgggccctttgacccaggagtccactgtgttaaaagtgaacactagagacaaactggaacaacagcttaacgcttagctgggggaacaactgaacatttatagggagactggccgggaccaaagataaactgaaaatacgagcggcagaaacaaaagaggagctcgaagacacacagactaagaacggtaacaaccgaggtggtaca

SEQ ID NO: 64366 - DNA, 485 bp, Triticum aestivum
  Clone ID: PAT_TA_64366
gatggatttctatgaaaggatgggtgatacattagctatccagtacggtggttctgctgctcacaacaagatcttctgtgagcaaagagggcagtggaaggcagcaacccaatcccaggagttccttcgaacccttcaacgttactacaataatgcttacacagatcctgagaagcaggatgctataaatgtattcttgggtcatttccagcctcaacaaggcaaacctcctctgtggaagttggactcagatcagcattacaatatcggccggcaaggaactttaagtgaagaaactggaagatatggccgtgtgggaataagcgagtggtgcatgtaccacttaagtggggcactagtgactgcatggtgcctacatgtgatgtgtgcttgtgggaatatttctataagcatgtaatggttcgtctgtgttaacgtgaacacacgtctccgtgtgatttctattgtcaaaacacctacatttc

SEQ ID NO: 64367 - DNA, 402 bp, Triticum aestivum
  Clone ID: PAT_TA_64367
cccgctggatgcggacgcccagcgcgaaggcaacaacgcctctgcccgatacccgaaaaacaggtttacttccggcgacccggcgcgagcagccaccatgagtcagacagcaccgccgaagccgctggcagaccccgaggagcccgcgaccgaacaacaggcgaaaccatggcacctacggggccactgcacactccgcggaggagcccaacgacgaaagatgaacagaatggcccgccaccgccccgcagggagaacacaccgacaccgcgacgaaagcccagacggggaacgaaagaagaaccggcgcctccgagaggcagacctgaaagaggagcccgacgacacgaggcccaagctcggcactggccgccgaccaacaacgccgggactgggaaaaac

SEQ ID NO: 64368 - DNA, 218 bp, Triticum aestivum
  unsure (1)..(218): unsure at all n locations
  Clone ID: PAT_TA_64368
gtgcttccagcgngaatgaccgaggccagcgggggggccttatgcaagaagacctacaggacagcacatctgatggaagagtgaaacaacccgacccccgagcagaaccaaggccctcagagacaaaagaaaccctggagaagccagcagaacaaaaaacaaacaaaccaggggcggccgacccagggaacacaagctccacacccacgggcaaccga

SEQ ID NO: 64369 - DNA, 512 bp, Triticum aestivum
  unsure (1)..(512): unsure at all n locations
  Clone ID: PAT_TA_64369
acccacgcgtccgccatttcctgcctgaattcacattatctaagttagttgccaggtcaagcttcagacaggataggcacttggacaggaacatggatggggacaaccctgattttcagttccttcaactttatttgttcttcctctaaagatgtatgctaaaattaaaattcctttttctccaagatagagacacataaattgccataagagaagtccagagaccggcaacttttgtttgcactgttcaacttcagacaggattctcaacggagactgcgccaatttttctttcctaaggcttcgttcgtttaatcccacccccgccaggatcgagggggtatttgtcccgaaccccgntgggttttaccctcgcaggggtttggatccccgcttagcttatatgcatattcggttaaacccggacgggtttattttccatccaaaaccccctcaaacgcagggattcaccgggttttgggccacgtcttcctccgcgtggaaaaaaacca

SEQ ID NO: 64370 - DNA, 361 bp, Triticum aestivum
  Clone ID: PAT_TA_64370
ccacgacccagaacagaagggcaccgtgaattttacagaaacggtgcgctttgttacccgacgatcaaaaggacaaccccgaccaccaaaaataatcaaagaccttccgcgacatagacgatccactgagaaccgcacaactaaagacgaacaacaaggtcggacacgctgagatgaactaacaactaatcccggatgttataccacacggggacaaaagaaaaactggcgctccccacggaaaaccggaaagaggacattgaagacacgacgactaaactatgaactaagacgcctggaccaatcgccctacccaaaaaacgcccccacctacaaactaaagggacgcgcccaataaccg

SEQ ID NO: 64371 - DNA, 340 bp, Triticum aestivum
  Clone ID: PAT_TA_64371
ccctgaagagaacggggccgaacaaccggcgaaaacaaggccctccggggccaaagaggccccgaggaggagaccacgacgaaagaagaaccgaaagcccccctccgctcgctgggagaacaacagaaccgagatgtcaaccagacggggaccaaagaaaaactggcgctccccgaggcagaaccgaaagaggaacctgaagacacgaggcctaagctaggcacagaaccgacccataacaaccacccgacagggaaaaccctggcggaacccaactaaaaacccatgcagaaccaaccccctatcaacagcgggccaaaaaacaaaaaggcccagaccg

SEQ ID NO: 64372 - DNA, 404 bp, Triticum aestivum
  unsure (1)..(404): unsure at all n locations
  Clone ID: PAT_TA_64372
cacccngaggaggacggggacgaacaaccggcgaaaacaaggccccccggggccaaagacacacagaggaggagaccacgaccaaagaggaacggaaagcccggccccgcacgcggggagaacaacagaaccgagaaggcagcccgacggggacgaaagaaaaaccgagcgcccgggcggcagagcggaaagaggagaacgacgacacgaggccaaaacacggcaccgagccgccacaaaaaacagccgggacggggaaaaaccagccgagacccaacaaaaaagccacgcaacacaaaccccaccccaagcagggggaaaagccaaaaaggccgaacccgagcggccccacaaacaggggcgcaacccgaaaggagaaagggcccaggagggggaaacaaacc

SEQ ID NO: 64373 - DNA, 269 bp, Triticum aestivum
  Clone ID: PAT_TA_64373
acagaggaggagcaccacgacgaaggaacaacagaaagcccggacacggagagacgaacgaacaaaagagcggggacgtgagccagacggggacaacagaaaaccgggcgccccgcgaggcaaaggagaaagaggagaatgaggacacgacggccaaaggaggaacaagacgagccgggaacaaaagaccgaaccggaaaacgcagcgacgacccaacggaagcgacgcgcggggcaacccccgagcaaaagcgggcggaaaggcgaag

SEQ ID NO: 64374 - DNA, 371 bp, Triticum aestivum
  Clone ID: PAT_TA_64374
aacgctgctgctcgagatccgaaaaccggggctccacccccgaaccggcgcgagagaacagtgtgacttttaaaggaccgggccggctgtcccccgacccagaggagggcgaggccgaacaaccggcgaaaacagggccctacggggccaaaggaaccccggggaggagaccacgacgaaagaagaactgaatgcccgcctccgctcgccgggggaacaactgaaccgggaggacagccagacggggacaaaagaagaaccggcgccccccgcggcagagctgaaagaagagccggaggacacgaggcccaaaccagggactggccgaagaatgacaacgacgtgaccggcaaaaccccgggggaacccaa

SEQ ID NO: 64375 - DNA, 398 bp, Triticum aestivum
  Clone ID: PAT_TA_64375
acccagaagagaaagagcccagacaaccggagcaaacaaggcccaaaggggccaaagaaagactgggaaggagcccatgacaaaagaggaactgaaagacccgccacgctcgcagggagaacaactgaaccgcgaagacaggacagacggggacaaaagaagaacgggggcaccgcgaggcagagcagaaaaaaggagcacgaagacacaaggactaagcgaggcacaggccgaaggaaaaaaacagagtgacagggaaaaaccaggcgtaaccaaaacaaaaagcccagaaaaacaaacaccaaaagacagccggcgaaaaagcgaaaaggcccggaccgaacggccacccaacaaaagcacaaacagaaagggcgaaaggcgccagaagcggaaaa

SEQ ID NO: 64376 - DNA, 349 bp, Triticum aestivum
  Clone ID: PAT_TA_64376
cccgaaccggcgcgagagcacagggtgacttttagaggaccgagccccgctgtacccccgacccagaggaggaaagagaccgaacaaccggcgaaaacaaggccccacggggccaaagaagccccgaggaggagaccacgacgaaagaagaacagaaggcccgccagccgacgctgggagaacaacagaaccgggaagccagcccgacggggaccaaagaagaacaggggccccaagcggaaaaacagaaagaggagcacgagaacacgaggaccaagcacggagacgagccgacgaaacacaaaaaaccagaatggaaaaacccccgcggaaaacccaaacggaaaaa

SEQ ID NO: 64377 - DNA, 376 bp, Triticum aestivum
  Clone ID: PAT_TA_64377
ggggggcggaaacgatgcccctggccgtccgaaacccggggctacaacccccgagccggcgcgagagcgcagtgtgacttataaaggaccgggccggttgacccccgaccccgaggaagaggggggcgaacaaccgaaagaaacagggaccgaaggggccagagggcaaagcggaggagaccacgacgaaggaagaacagaaagcccgccaccgagcagcgggggaacaacagaaccgggaggcgagccggacggggacaaaagaagaacgggcgccacgaggggcaaagggggaagaggaccaacgaggacacaaggcccaaacgaggaaccgggcgaacgcaccacaaaacccgagacggggaaaaaaccagga

SEQ ID NO: 64378 - DNA, 353 bp, Triticum aestivum
  Clone ID: PAT_TA_64378
gaaacccggggctaacaaccacgaaccggagcgagagaacagtgtgggttttaaaggaccgagcccgctgacccccgaccccgaggaggagaggagagaacaaccggaggaaccaaggaccaaaggggccaaagggggaaaagaggaggagagccagaacaaaagaagaactgaaagaccgccaccgccccggggggagaacaaacagaaccgcgagagcgaagccagacggggaccaaaagaagaaacgggggcccccgagaggcagaggggaaagaggagcttgaagacaccaggcccaagagaggcacaggacagaccgcaacaaagggggggaccgggaaaacccaggc

SEQ ID NO: 64379 - DNA, 145 bp, Triticum aestivum
  Clone ID: PAT_TA_64379
acgaacgggagcatgcgacgagttgtgtttttaaaggggcgatccggttgcaacccaccggccgggggtgaacaacgcggcgactggcaaaaccatggccgcaccgaaccaaagcgcctcggaggacaagcccatgacgaaagat

SEQ ID NO: 64380 - DNA, 389 bp, Triticum aestivum
  Clone ID: PAT_TA_64380
cccacgagccggcgcgagagaacagcgtgacttttaaagcaccgaacccgcatgaacccgaccctgaagaggacgagtccgaacaaccgaacgaaccagggccccacaaggccacacggggaaaacagaggagtccacgaagaaaaaagaacagaaagaccgccaccccaagccgggggaacaacagaaccgagaccccaaccggacagggacaaaaaaaaaaccggagccccgaagggcaaagcaaaaagagcaccaagaagacacgaggcccaaacagggcacaggcccaccccaaacaaccgccgggaccgggaaaacccaggcgcaacccaaacaaaacgcacaacaaaacaacccccaaaagcccaacggacgcaaaaaacaaa

SEQ ID NO: 64381 - DNA, 525 bp, Triticum aestivum
  unsure (1)..(525): unsure at all n locations
  Clone ID: PAT_TA_64381
ccagggcgaaggcaaaaacgccgtagcctgagactccgaaaaacggggctaccacccgcgaaccggagcgagagaacagtgtgagttttaaaggaccgagcccgctgaacacccgaccccgatgaggangagacccgaacaacccggcgaagcaaggccctacggggccaatggagaaacagcggaggaggcccaggacgaaagaagaacagaatgcccgcccccgaaagaaggaggaaaaaccaaaccgggaagacaacccgacgggggacgaaagaagaacgggcgcaccaggcggcaaaaccacaaaaaggaagcccgaagacaccaggcccaaacacggcaacaggccggcaaccaacaacgacgagaaaggaaaaaccccgaacgaacccacaacaaacaacgagagaaaaaaaaaccccaaccacaagcggcccaaaaacgaacaaggaccaaaacgaacaccccacacaaccagagagcgaaaccaaaagacaaaaggaagcacgaagaaaaacaaac

SEQ ID NO: 64382 - DNA, 227 bp, Triticum aestivum
  Clone ID: PAT_TA_64382
accgaaagccccccacccctagccgggggaacaacccaaccgagacgccagcccgacggcgaccaaagaagaaccggcgccccgcggggcaaacccgaaaaaggaccccgacaacacaaggcccaacccaggcaccgacccacgaaccacaacgaccccaaccgagaaaaccccgacggcacccaacaaaaacaccccgcaacacaaccccccacacgccaacaggc

SEQ ID NO: 64383 - DNA, 233 bp, Triticum aestivum
  unsure (1)..(233): unsure at all n locations
  Clone ID: PAT_TA_64383
cccccccctggcccggtaaaaataaaataccctttcttgccccgccccccagcnggagcagagaaaagatcgatttgccaagtatagtgcaagtgtcccacatacgaaccttgaccgtctttggggagtggcaatcattgctcctttgtccgaacacgacgatctttccagcgcttgctctaccagatgcagaaggggttcaggcccctgaccttgtcccaattggaaagctt

SEQ ID NO: 64384 - DNA, 236 bp, Triticum aestivum
  Clone ID: PAT_TA_64384
cccgagagacggtcgcactgcgtatatggcttgggccatgttcttgggggagcctgacaagataactgatgccgctcctcgtggggacactgaccggagcagcctgacggacaaagaagaactgcctccggtgcagactgaaagaggagttgagacacaggcctaagctggcctggcgcgtttaccacgcagctggaaaccctgcgtacccactatcgccttgagacattcccctt

SEQ ID NO: 64385 - DNA, 144 bp, Triticum aestivum
  Clone ID: PAT_TA_64385
gctgggcgagcaggccggtcacctgtgctgaggtgcccatcattgcgcatagcctcgtgagaccgagttcatgagcaacgcggaccaagagcgccggctcaactaccacagctatcaacacgagacggacgacacgatcttccg

SEQ ID NO: 64386 - DNA, 101 bp, Triticum aestivum
  Clone ID: PAT_TA_64386
gctggtgcaatagctgaagaggccagtgaacccgccgttcacaacagcggcgccgactgaagggctgatggtacgcgcgctgagcggacaggagctcggga

SEQ ID NO: 64387 - DNA, 316 bp, Triticum aestivum
  Clone ID: PAT_TA_64387
ggtggcgtttaaagccaacccagaggaggtcgtgttacaacaactggactgggaatagcctgtcgtgacccaagttaatctgctggggagacaatgacctatgatcagctggaggaccgcctacagtgctggatgaacagcccatccgaaaggtgcgcatgctgaatgccaaagaggacctgccctgccgcgtggcataaatcacggaggacgttgtggacacgagcactaagaccggtactggttggcagcgctactacgccccgactgtgaaatctctggcgttacttaattgacacgtctggcggcacatccc

SEQ ID NO: 64388 - DNA, 266 bp, Triticum aestivum
  Clone ID: PAT_TA_64388
aaccgttgacttgctggcaccaccatgtacaggaaaggccgagggatctacaacatgtataatgggagcgggacaaaggagtgaattgctgggggctccgctagtagctcatttagcggcatgcatgcaatactgtccaagctatgatgacatctacgtttgcaaatactattgtcagagagagactgggggacattgcatgttctctattgctgggatttgcggatgcttgctaaagttgcaatgatgatgctataacatcagca

SEQ ID NO: 64389 - DNA, 469 bp, Triticum aestivum
  Clone ID: PAT_TA_64389
cccactcgtccgaatccgcccatccatccccggcggctccaggagggacatcgcagccgccggcaccggcagcggcatgccattcacatcgccctcgcgcaccatcggcggccccctcaggtcctatcccaacttgcggccgtcgaccgcggcggccaggccaggcctctccttccaccggtcccgagaccaggggacaccaaccccgtcgtccagcgctgggtgcctcagatcggcatgcctcctcccgatgcagaactgttctgggaatactactgctaatgaatgtgtccaatcaagttcatccatgtcaaactctatcaactagaaatagagttgtgtcaaagagaaggaggagtgcgtgcagggggagtggcgggtcaaggtgctctcatcggagccgctactgaccggcagatccaggcgcaccctccccgtgcgcgcaggggggtgacaggacaacgtgcgc

SEQ ID NO: 64390 - DNA, 397 bp, Triticum aestivum
  Clone ID: PAT_TA_64390
cgtacgctttttttgttcgatccatgacagggagggctttcgcggggcccagtagagccttatttctgccggaaagctgttgatgaatggccagacccttgctgactacaacattcagaaggagtccaccctccacctggtgctcagcctcaagggtggtatgcagatcttggtgaagaccctcaccggcaagaccatcacgctggaggtggagcaatatgacaccatatacaatgaaacggcgaagatccaggccaaggagggcatactaccggaccagcagcgactgatcttatgctgtgaagcaggtcgaggatggccgcactctggcggactacaacatccagaaggagtccacccttcacttggtgctccgcctacgtggtggccagtaagt

SEQ ID NO: 64391 - DNA, 338 bp, Triticum aestivum
  Clone ID: PAT_TA_64391
attgttttgtgccttggtaggcgatttgctgaaaaagggaattttttataaaaaaaaaaaagagagagtaaaaaaaaaaaagaaaaaaaaaattggggggtcgtttttgaggatccatgtttgggtccgcgttcatgggaccctatttgctcttttatggggttacctaagttcaattcttctggccgttgttttggggtggtttttttgggaaaccctttgtgttcccccggttgatcgccttgttgtcctttttttttgtggcccgttggtgtattagcggggtggccctttccgatcgtttttccgaacagttgcgcggtttgcctggttttttg

SEQ ID NO: 64392 - DNA, 366 bp, Triticum aestivum
  Clone ID: PAT_TA_64392
agaggggctggagcgccaccgcgaatcccatcccatccccgcaccgccgccgatcccgcccgcccgcccctccgcagatctccccgacattgcccgctccccggccggattcgcccagatccaccgacgccgcgcgcggtgctcccggcggcgtggcccgggccgtctgatcggggaggctcgatctttttggttggtgctgttgtctggagggtggtggcagcggagatgggcgtcggaggggagaagttccagctggggacggtgggggcgctgggcctctccgtggtgtcctccgtgtccattgtcatctgcaacaaggccctcatgagctccctcggctttacctttgctaccaccttgacg

SEQ ID NO: 64393 - DNA, 392 bp, Triticum aestivum
  Clone ID: PAT_TA_64393
attcccaatttttaccatcttcagaccagaacactatactgacaattaacatacaccttcccttcgcccccctcacattactacgaatttacaagcaagcatggatcactccttcttgggtttgttgctgtcaggggcggcggtcgcttcggattgaggtggtgcgccggcgacgtcgccggtcatcatcttcttgaactcgtcgaagccgacgcagccgtcgccgtcgacgtcgacggaggcgatcatcttctcgcagtcctcggtgctgcacccctcgccgatgcgggcgaggaccttgctgagctcggcgacggagatgcggccgtcgccgttgatgtcgtagatgtcgaaggcgtcgcgcagctcggcgtccagctcgcgcttccccg

SEQ ID NO: 64394 - DNA, 216 bp, Triticum aestivum
  Clone ID: PAT_TA_64394
cccactttgtttgcgccaaactttgggttcggaaagaaggcacaggtgtgaagacaagaacgagcaccacccgcacatgttagaggaggtgtgtcaacatgggtcaatgttttgggttggttgtgttttacgcatgaataaagcaaaatgctgtgattctgtgtacggacgagccgcggatgcgccttgcggggaggagcagaaagggatacagaa

SEQ ID NO: 64395 - DNA, 393 bp, Triticum aestivum
  Clone ID: PAT_TA_64395
gtcagtttggaggccagcatcaccgcctgccccacccacgagcgccacctaccacccaccctccaccgccaccggccagagaaagcagatcgacggccggaggcgagctcggtaggtagcgtaggtagcggccatggaggccgccgcggccatccggagcacggccgcgccgcggatgcgcctcgcggggaggagcagcaggggatccggcgccgcggcggcgcgcgcgaccccggccagccacagcgactggcagacggcctgcgccatcctctccagcaccaacgacaccccctccccgccggcgccgaaggtgaacggccagaacaacaacaacaagctggccgcgccggccatccccggctccgaggacgccgtcttcgcctggatctg

SEQ ID NO: 64396 - DNA, 388 bp, Triticum aestivum
  Clone ID: PAT_TA_64396
gcgccttcgtgttcgcccacgcgtccgcccacgcgttcgattgaaaagatgaacagatcgacaagaagttggaagaagaagacaaggaaagaaaaagattaaagataaaaactgacaagatagcaaagttttttgcggttaatatttacaaataaaaaaaaaaataaggggggggccttttttggggttccaggtttccctccgcgtgcttgggagttttttttttttttttgggggcccttaatttaatttctttggccgtggttttccaccggggggttggggaaaccctgggggttccccaatttattggcttgggggcacttcccctttttcccggttgggttattaccgaaggggcccgacctttttgcctttcccaaaattt

SEQ ID NO: 64397 - DNA, 341 bp, Triticum aestivum
  Clone ID: PAT_TA_64397
gatattatatatgcctgtgtcttgtgagcctgctggcacggtgctgcctagttgtgcaatttgcatcgtgtcttatttaagcattgaaactatcttcatttgatttctctgtgctaaacaaaattttttgagataaatctttacaaataaaagaaaagttaacatgggaaagaaacaaaatcttgatttcagaaccatgactactcaagtgttgaattgggccacctgtttggtggaacaagaaactattcctcctatcggccatcaaagactgtttttatcgggtaacttaaattcaattaactgcccactggttatacttgaagaaactgggaaaaccc

SEQ ID NO: 64398 - DNA, 333 bp, Triticum aestivum
  Clone ID: PAT_TA_64398
cggacgtgtgggatttgttgcccctctcctccagcatgcccttccctaccatggcgccttctctctctccttcccctcccatggtgcccatccctccattcccatgacacccctccccctcccttcttcatatggcgcctcattaccctctattctggtgtctgtgagtctgtccctctctcttcttgaaccctagaacacaagcagatctcaaatcctaactctctctgttattggataggttcatccgggttcagttttgcagatctgtagcaatcaagtcctaatccctttctgctgcttcagattgccagtgttgcacgagcatggaat

SEQ ID NO: 64399 - DNA, 224 bp, Triticum aestivum
  Clone ID: PAT_TA_64399
cccacgctcctgaggcgctgggcgccgtcgtgagggacagggcggaggtcgtctatgtttccaggcaaggagaaggatcgacgaccatcgtggtgaagacaggtaccggcgacgagtttcaatgtggcaagaggaatattacagtggctgcgaagactagcaagttgcgcaaggaacacaccggcgcccacctgacggtggaagcactgaacaaacttattttt

SEQ ID NO: 64400 - DNA, 219 bp, Triticum aestivum
  Clone ID: PAT_TA_64400
atacgaacccacagcgcgaaggcactaacgcttgtgaagcgaccggacaaactgggcgtctatgggtgagccggagcgggcgcgcaccatgatgaacagagtgccgctgatgcagctggatgaccagggggagtagagcggcgaacaaatgacgtaagactggtcttgcagcctcaaccgcaatggaaggaggatgccatgactactgatgaactgact

SEQ ID NO: 64401 - DNA, 560 bp, Triticum aestivum
  Clone ID: PAT_TA_64401
ggtcgactttataggatccaagctcccaaatggagaaacattgccttccgctcattgccgagagcggtatttttgtcgacatgggggggaattttatcgtgctggatcgcggttgaatatttaatgtatcccaggattgaccgtggggagatagttgctaaatacaacacaaaatcctagtctagttaaagaacgaatggtaggattatcagaagatatgccatcccagagagctattttttgaccctcttctttaagatcggcgatgaggaaaaatattaggtcacaggccgaagcacgaagatgctatattcttatggtttcctagcgagaattgaacatatttagttctcgagacggaatattgcaagcttcacttaaaagaacacgggggcatcataattgaattgccccatgttgctcactttaataaattgacatgaacttgtaacaatgcttctaaacagataaagtgactccgtcactcttgggtcgccgaagctaaccaggtctggcctacgggagaatagggagtgacactatactgaggaacgatgcct

SEQ ID NO: 64402 - DNA, 295 bp, Triticum aestivum
  Clone ID: PAT_TA_64402
aggattcttgaagttgggataaagtaatagacaattttgctaccgtcatttttgggaacagggagtttatggcattagccgctattggctcaaggaacaggagagacatctgagcgactccttgcatgtacggaattacaccagggacattaccttgcaggggtctcccttgccggaattcttgcgggaggaatatgaactatgggcagaccaggaatgtttgggtcattatgtgttgcatttgggaatttaccattcaccccaactccctgtcgatccccgggtaccgagctcg

SEQ ID NO: 64403 - DNA, 219 bp, Triticum aestivum
  Clone ID: PAT_TA_64403
tagacgtcccatagactagaagacgaacatgatcaccagcctacgctcgtgggagaacaacagaaccaccatgacacgctgacacagacgaaagaggaactggaacttctggacggacacattaaagaggagtatgatgacccgaggtctaacaatgccactggccgtctatatacactactaaggctggtaaaacaatgtggttactgaacataaatt

SEQ ID NO: 64404 - DNA, 180 bp, Triticum aestivum
  Clone ID: PAT_TA_64404
tccctgcaggtcgtctttagaggatcacccggggaggaccagattcatatacattggacccgatacagcgtcagttatttctgtagaggcaaacaccggttggcatggtggaaagactaagccatatcactcgggctaaccctggaacagttgtcgtcgattgggatggccagttaccgt

SEQ ID NO: 64405 - DNA, 433 bp, Triticum aestivum
  Clone ID: PAT_TA_64405
tatagggacgcacagctgcgagggattaacgcgtctgcgcggaacccggaaaactgggggtttattgggcatcgggtgcgtgagtggaacaggatacagtcagaatctaagatgctgctggttgacccatgatgagtatcgtgtagcaacaactggatgtgatcatggcacgttctgagccattgcgttctatgtggaggagtctaagacaatagataaactgattgccgccagtcaggtagctgggtgaacaacatgaaccatgatgttagcctgacggagactaaagaagagctcgggctccgcatcaaagtgcttaaagaggtgcttgatcactcgaggtctacggttgccaatgacgcgagttacacaacgtagagactggaaacatcctgttattacaaaatttaatccgttaacagggcatacatgt

SEQ ID NO: 64406 - DNA, 282 bp, Triticum aestivum
  Clone ID: PAT_TA_64406
gcgtttttatcggcgcggcgctggcggtcatctaccacgtggtggtgatcagggccatccccttcaagagccgcgactagtcaatccagcacctgcgaatggaatcttatcggtgctcatcgccggtcgatcgatcatgtggtggcggtgggggccgctggcgcgcgccgtcgtggatcatctgctccccgcccgcgctgtcagaatgcctgcatccgacgggctaggcctctcctctgtctgcgtgcctgcccgcagggcaaactgatgaaggttgcgagc

SEQ ID NO: 64407 - DNA, 382 bp, Triticum aestivum
  Clone ID: PAT_TA_64407
gccctagctccttagaaggataaatgaggaacaacgacataatttgcaaaacctaggattacccgtaccgagatttttgggctatggaatcgttgcccgcccaattgcccgggttgcctgtgtgttaaaggccacgcttccatggctatgatggccaaggaacccatattattaattccccagcggatttaccagattgacgttaagttaacaccggtagttggatgaaacgccagttttgtcccctacgaaagggaattgggcgttatcggttttcgcaatgtcaggggagaaatggaagtttacccagtggtggacttccaaacaaattgaccagctttgtcgttgggtggaggcccctgttcccattgattttaacatt

SEQ ID NO: 64408 - DNA, 367 bp, Triticum aestivum
  Clone ID: PAT_TA_64408
gtgtggtttatgcgcaagcggcctaatcgttggaggggcaggttgaacgcatgatccgcgctaggctatgccaccggtgggcaaccatgagctgagctggagggcgcacccggtatccggcggcggcctacgacggctaccgggaaccagaggataggcagtcggcgactcgtcgctgtcagtaccagcaccaagagacggcggagcacgacatggaccgctgacgcgaaaggttgtgcaaaggaatgcgcgctgcttgtaggctctgctgcctcggcgacatgtgcttcggatcaaagggcgctactggcgacctgaacaattaccacgacgagcaactgagcgagtgccgctaatagcagatcat

SEQ ID NO: 64409 - DNA, 502 bp, Triticum aestivum
  Clone ID: PAT_TA_64409
tccttgcgtccgcccacgcgtccgttttttttttttttttgaggcaatcatgctgaatccatttacccagtcaaccatgtacatacaacaatagtctcttctagtatgaagtgagtactaacccccgccttattacattagaatcaaagaatgaatgaatggaagtaaattaagtacataaagaatggtattccgaaaagagtcgaatgcttgcaaaatggtgcaaccacacctaaaattttgcttgcaaattaacatatgggtatcagtctatcctgcccggcccgatacaccactctgttagcgctacttcctacagtttgagtacagttcctccagcaatggcaagttaagaagaacctgagaacttctgcaattgtatgatcaaaacactgatgtcatcggtagaccccctggaacccgcggtttcgacaagccttctgcaggcggtcatgcgagataccttgtcattgccgatgcagagaggcctggcgatgtctat

SEQ ID NO: 64410 - DNA, 317 bp, Triticum aestivum
  Clone ID: PAT_TA_64410
ttattgcccgcaatggcggcgaggcggtgtcaccacctgatgctacggcggacggtatggaggtggaggcataggaggaggcgtgcgaggaggggaacgagggggaggatgtcatgcagaggaggctgatatacgactcgcatctgcactacatttactcgcagaacaaggtcacgccatgagtgtcgcatgcgctagttcttacttcgaggtcataatgatgatgctgggcattaagttgactcaaggaattatatggcgacgattattgttatcttaatcatatattattgatgtaccttctgttgttttgactg

SEQ ID NO: 64411 - DNA, 153 bp, Triticum aestivum
  Clone ID: PAT_TA_64411
tgacgcggacagagtgaatcagagttttttcatgggtaaacacagggacgaaggctaggaggacaacgactatgaacttgggagaactgaccggagccatgacgtccaaagggattaagactgtgcatctaacagcagatgctacataatgag

SEQ ID NO: 64412 - DNA, 254 bp, Triticum aestivum
  Clone ID: PAT_TA_64412
ccctcttgtacgcccacgcgtccgcccacgcgtccgcccacgcgtacgcccacgcgttcggctccaggctcagatctgggagaacaaccacaactaagtgaaatgttggctaattacacggcggaccagtgagcaaattaaggacatgtttgagttagtagatatgcatcctaatctataaaataaatggatcatatgtcatcccattgatgtgtgtgtaatgagtgaatgtatttataccttctgaatagttg

SEQ ID NO: 64413 - DNA, 120 bp, Triticum aestivum
  Clone ID: PAT_TA_64413
gacttcataccttctgtatagggtgccctaaacccaagtcactggccggccgcttacacccacgtgactggctagaccctggcctagcccaactgaaaagtctggccgcacagaaacctt

SEQ ID NO: 64414 - DNA, 417 bp, Triticum aestivum
  Clone ID: PAT_TA_64414
aggggaaccccccggggagggcccggccctgatggcaggggcgacccacccgtccttgtttgccggcgggggggctgaagacggcataccagcttatgacatcacgagcagtggtaggcacggggcgagggtgcgacgaagcgtgacagtgacagctcggtgcctgtgctgcacagatatgcttaatggattagggggctgggggaccaacatattgtgcaggtctatatgaatggcggtaggaacacaatgatcccactacggtcccggtttgagacatatccaccagtgcataagtgtgctatggaaacaatgcgatctgccgctagcgctgtgcactgaagggttggttgggacaagacggactgagctcacaggcatgcatctgcgaggaggtccgatcagtcgtgcgtttac

SEQ ID NO: 64415 - DNA, 350 bp, Triticum aestivum
  Clone ID: PAT_TA_64415
gaaaccccgggctaggccctggcctttgcacaaatagcgccccacactaggtagtggttcagactggcgcaggcgtaattgttcggtggtgtttatggtgactagcttcatctattagttgatcttttattccacggctgaggtgcgctgaaaaggagaaatgtacaagctattcacatctcccaaaaatggttgtgggtacgatactcgatttaggccacggtccagcccctaaagtccaatttactaatagccgaatcatccataccttccatgggtgaatgcccatacggcagttaacgataccgatggggaaccatgactactgttcacccagtcccaaaccatac

SEQ ID NO: 64416 - DNA, 505 bp, Triticum aestivum
  Clone ID: PAT_TA_64416
tagaggaacaccgccaacggaagggggtaagggggacatgggcatccataacagcgggttgttcaacggcaattcagcacaaaagggggaaatgattctgtaactgacagtttagatttttgtgatccgttatgcgagataaaccgatctaagcttaatattttaggggattgccatgcgtgtggcgctgttatttggtgcatgatctgagaagcatgaagtgtccatcaaatctggctaggtgatcaactaagcattgatcagagactatcaccaaaccaaatataacgtgagctctttgtatattcaaaaaaatggcgtttgggtggagccagacgctaatcaacaagcttggcaccagggagatccctggggggatcagaccgttacggccggacaactgtggcagtttgccccagatgcggctctaatggaggtgtggaataccatattggacggccccaaacgtgaatatcgaacagtgcacgggctatatagttagatg

SEQ ID NO: 64417 - DNA, 454 bp, Triticum aestivum
  Clone ID: PAT_TA_64417
gtcgactttataggaaccgcctacgccgaactgtccttcactaccaaaatgttcgcgtggcgaagcctttttgatgcttgactgcatgaatcttcaggccctggacttgtaggcttttcggccgcaactgtgactttgtgagcaaacgcgcacgatgctcttcgtagaaacagcatccattacactcttgccagaaggttgcggggagaccatcatttgatacagggactgcaaaagcgccattcttgcccatggactcgcatgggatagaagaccagcacgtcagcaaaatcgagaatcctgctgccccactacatcttttgagtgcccacgagatcacggctaatgccatggcgactgacgtagaatagctgagactattaatgggtgagagtagctgctgttgcgctagactatcatctgagcgtgcaggtggagttttattacaaatcat

SEQ ID NO: 64418 - DNA, 457 bp, Triticum aestivum
  Clone ID: PAT_TA_64418
ctcttaccagagtgttcacttgtaagctccggacactaaaagatctctttgtatgttgtaaacatatttgatcaattacaatacatcaaattggtaggtttgatcaaattagtcatggttggccatggaccaaattagacacctgtatatgatactgatgtatcttgttcatatgcaaatcccttgcttgggttgttgagaccaaaaaaaaaaaataaatcagaagaagaaaataaagatacaactgtaagacattagtgagtttggtacaaaaactataaatgaatgataaataaaagaaaagagggggggggccgttttagaggaccaaagtttacgaccccgggattgggaggtaaattattttttttagggtcccctaaattgaattaactggccgcatgttagcaaaaatttgacggggaaaaccttgtggttacccaattaaataatcttg

SEQ ID NO: 64419 - DNA, 420 bp, Triticum aestivum
  Clone ID: PAT_TA_64419
tttttatcttgcaatcacaacaccgcacacgagagaatactatctctcactagtgcaaccgctagctctagccatggcttccagggcgagcatgttggccacgatcatggcgtgcgcgctcctcctcgccggaagcacgtgcgacgctgcccgcaacctggccgacacgacccccacggctgccgctccggctgctaacgtagtacctggcctgccggccgagcccacggacacggtcaccctgatgccaccaatgccgtcggtcaccctgcccaccgtgccacaggtgacgctgccgaccatgccggccatcgtcgtgcccaaggaggtactgccacccatgcccaaggtgaccctacccaccgtgccgtacgtcaccatggcgcccatgcccgccattgtcgagcccaaggtgacgct

SEQ ID NO: 64420 - DNA, 385 bp, Triticum aestivum
  Clone ID: PAT_TA_64420
tttttgaaaaaactaaaaacattgccaagcacaacgagaacaactcagaatctagggctaggaaatgaatctcccgcagcggcgaatacacctatacctacgttggtcttccgactccttcttctcgccgcagttccggcaacccctgtcccactaccgtaggccatccccttggtcgatgggcgctcaattttctacccactgcccgggtcgctagtgaacacccctacggcgataccgtgacactccgggcccaagccctatgctttcctgatactttttctgccggatgccttctgtccattgctttcatactgacagtgaagctcctcatactccgaatttgttagcttgatacgtatacccaactctgtcattgctgact

SEQ ID NO: 64421 - DNA, 152 bp, Triticum aestivum
  Clone ID: PAT_TA_64421
cggaggcattgacgcctctggccgctacacgaaaaacgggtagtctaccggcaatccgacccgggagtacacgatgaataaagccgcaccgttgacgctgctacatgacccctgggagtacctgctcgcgcaactgctgtgatcatgcgacc

SEQ ID NO: 64422 - DNA, 400 bp, Triticum aestivum
  Clone ID: PAT_TA_64422
catcaaactgtccaccatggtgcggaaaaagcgcgtgagtactcgccgaacggcccgcgagaaaaccaagggccagttatataccggggaccacacgataaacgcccgtgcagaccgcaaaggcattacaacaggcataaggagcacgccggtgctgccaccgtttctctggggaggcgtccgtgactgagggtaaacaccttgattccccacgatttgatggcagagcaaccgaacaatgaggccatggcgacgggtactaaacaagacgcgtagttccgtgggccagaggtgaaaagaggagctggttgatacgaggcctattgtattcactgcccttcaatgtacaacttcatggctagcgaaacccaatgcatagcccgacttaaatgcgcttgga

SEQ ID NO: 64423 - DNA, 304 bp, Triticum aestivum
  Clone ID: PAT_TA_64423
ttcttacatgcggtccttcctggtgagcctagcctggggttgtaacctctgggtcctctttaagcatccacatagtgatgatctgtggccaggagacccccgagcgacaaactgccgttcaattgcttaatgtagtgtgcgcccactgccgatgatagcagaagaagactgccaccaacccgtgggacctcataactatccgagatgtgcgcctgcctgatcctgaagaagagattttcgtcagtgtgcacgatctcaaagatgcgctaggtcacccgaaggatcatgttgacagtgtcctacg

SEQ ID NO: 64424 - DNA, 150 bp, Triticum aestivum
  Clone ID: PAT_TA_64424
gctaatagtggggagccgcctctttagatgacgctggtttacttagcaccgattgcgctgttatctctccttgatgaggtcacctcagaacaatacagcaggaccacggtcttcaacgtccattgtgtgctatccgaggagttccctaac

SEQ ID NO: 64425 - DNA, 197 bp, Triticum aestivum
  Clone ID: PAT_TA_64425
gctacgtgtacggtcgaccttattttagtgctgaggagagatctataagagaagattctgctgaaggcccaccacaaagtgagcaagaaaaaaaaacacggcttggcgttgctctgctccccctttgcccccctgcggatgcttcgcttcctttttgtgatcttgggtcggggtctcctctctctggccctgctcct

SEQ ID NO: 64426 - DNA, 173 bp, Triticum aestivum
  Clone ID: PAT_TA_64426
gtgactccttggggccagacgcgggagtagacgacggggaattattgagcgaagacgcagctggcggcccacgctgaggaggggaacatcccacaaccggagtatagaccgccaggaggggacgatgattctcggtggagcacaccacgacaaaggaggaactgatcgcccgc

SEQ ID NO: 64427 - DNA, 359 bp, Triticum aestivum
  Clone ID: PAT_TA_64427
acactcgggatcttagacatgcgaacgggagtaaccacgagtgagtcaaaaacgattttgctgctgcctacccctggagagaagaggtgcgtgcaacgggttttagcatggacgtaaagggccattgtactgctcagggcgagaccatgagaaaagacgaactgatgaggcagatccattgcctgacctaacatctaaaccgggaagtcagactgactgggactaaagaagaacaggcactcccctgggcaaatctcaaatatgagctgtgacgacaccatgcctaagatagacactggccgactctcaacaagaatgtgagtgtaaaaacacttacgcaacataactcaatgatcttg

SEQ ID NO: 64428 - DNA, 354 bp, Triticum aestivum
  Clone ID: PAT_TA_64428
gcggacacgcgacgggacacgcctacgcttgatcatggccggatccacccccaggttgcctcggactggtacaagtccgaacacctcgtagggatcggcacctccggctcgctggactacactgtaagagcacacacagcaaaagatgaaccgagtgtacccgccctggtcactggaggaacacatgatccccgatgataggcctgacctctatcaaagaataaacggcgctcggtgtgctactggcttaaaagaatctggtggactctaggcacctctatgaaactgagggtacgtatgacagcactaagactgatagaacgcaaatctcgaacaaataatgcagattactaa

SEQ ID NO: 64429 - DNA, 311 bp, Triticum aestivum
  Clone ID: PAT_TA_64429
gtggtcatttccgactcccgtcgggagatccgcaggtgcgaataggtcacggagctgctcctgccgatcccctctgactagaggactgttccggacaaggcgctaaggtcgactcgcgccatccatttcttgaggcgggcgggtcaatgacagaagtactgctgagccctcctacactccttgctagctcaacagtactaaccagatctgcatctagtaggcaccagaggatcatatagactccaggacggtgatctgcgagatgagtaacttgactagaggacgcacaatcgcaccagttcaccggaggc

SEQ ID NO: 64430 - DNA, 235 bp, Triticum aestivum
  Clone ID: PAT_TA_64430
cttcttattgggagcgcgcatcgggacagggctaagccggattatggctcgaagcaacggcttgctgaccgctatgggtgccaatgcgagcaacgcgtttgactcggaggcactgagaactcgatgtctaacagttgagaaacacacatctaaggaagcactgagtgtcctgctgtgctggctgggggaacaagcgtgcccggaccacatactagcgctgacaaaaaaataaacg

SEQ ID NO: 64431 - DNA, 390 bp, Triticum aestivum
  Clone ID: PAT_TA_64431
gtcactcatccggcgcggcggctgcggacgatccaggggatcttatgtgagcatcccacgccatccacctcctatagggtgacttgagccacatacactgaccgcagtgtcacaccggtgacaatggcaagactgtgagctcccccaagttaaccgccttgcaggacttgcaccttatgccagttggcgcacttgggataaggtccaatacgcccgccctgtacaacatttcgcaacacctgaatggcctgtgtggcgagtgctgcgcgggctcattaagcgcaataagtgcggcggttgcgctcagtacgaccagtgcgtctcgctaccatcgtaaaggccatatcgttaagtgacttcgctttctttcctgccattatcgcccagttt

SEQ ID NO: 64432 - DNA, 316 bp, Triticum aestivum
  Clone ID: PAT_TA_64432
ggtactcgtgggcggacgcgtgggatcaacccctagggtttgttatcaacagaggagttaatcccccacgtctagtggggctgttatttatttcgggaagtggattggagtgttatgaacgtggtttctggacgagagacagcttgctgaaggattatttgagagccggagtgatccggtcagcgttacatctgtaaggcacttgcaattgtactgaaaaggctgagtatgtgtgatctcatagaggaaaagctgaaagaggagcttgatgacacgaggcctaatatttgaactggggggcgtccgatctagagga

SEQ ID NO: 64433 - DNA, 321 bp, Triticum aestivum
  Clone ID: PAT_TA_64433
gtgattcctgcctaccggggcgcggcatccgaccagggtcagcctgcactgcgagccgtcgacccggcccacacctgtgacggtgcaccacgagtcggccttcgagcgcgcaccctgggtcatcgttctcaaatactggcacccaggattaaagaaggccatgcactcctgcccctacctgcagcacaacggcgtgaagaggggcgctggccccggggacacaccagaacatccgccatttggggcacttgatgtaaaagagtacaccgtcaacacgaggtttattcttgacccaacgcgtggagctaccaggagctgacg

SEQ ID NO: 64434 - DNA, 413 bp, Triticum aestivum
  Clone ID: PAT_TA_64434
atgtcgttcactgtgctactacatgtcagcccactgctatgaacgtttcattgatatttgagttcatataactgaagaggaaagataaaaaagagacccctaaaatatatcgaacctatccgagataatactcacgtaaaagaaaagaagaagcaaaaatggggcggtggaatatatggagccaaggttgctacctcgtggtttctagataacaagttttctttaaagacaactaaattatattcattcgcgcagatggttacacgttgtaaactggaaaaacactggaattgccgaacataatcgcatagtaagattgaaccattagcctcaaccgggggcttaagaaataggccccaacctatggcctcttcgcaacagaaggaggatcgaaactgtgaatgggactcgcc

SEQ ID NO: 64435 - DNA, 266 bp, Triticum aestivum
  Clone ID: PAT_TA_64435
tggtactaccgcggaaacgcaacgggtagatcacgaggattaaatcagcaccggtgctgctggccgccccccctgaggagcctcatccaccgacaagcggtaatcataagggggcgcgcgcatattaggtcccatgaggaggcctccatgacggatgattaaaagtgtgcttcttcggggatcgatggtaaaacaactgcacccgtgtttaacaaccgagggcgaggaaaaaacatggggtgccccaagtaaaagaccttaaaaga

SEQ ID NO: 64436 - DNA, 302 bp, Triticum aestivum
  Clone ID: PAT_TA_64436
cgcgagcgggcgctttagaggaccctggctcacttagacgcgcatgcgccggaatatgaccatgatagggtcacgtaaatgcaactcgctggcccttggaccacagcgtccagactgaaacaagcctggcgtgcctgatcatagatgaactgcaggacatgctgctttcagcagcgggacaaatagccaagagagccaggccgaccgtcattgccaacagaagtgcagccttatttgccagagctacacgactatgtttataacactaagcgcagagagtgggatgtggttacgctcataca

SEQ ID NO: 64437 - DNA, 391 bp, Triticum aestivum
  Clone ID: PAT_TA_64437
ttcttgcgtgcggatctgtctcgtgggcctactacgattcagtgggtagaagccatgctgttggctgccacggatgaggacccggtgatccaaaaggtcaaagtacgggctgttcgaggccacaatcttgtgatggggaactcactgacacagaccaactagccctaccgtctcctctggttgggttaacagaaggagaagactatcattcagaagaaaaatgacaaagaattatggaatgatgtattggagcttactgagacaaatcctacacaggcagtgaaactttgaggctgtgatgaggattacactacagcggctgacaacacgggagtggatgcaacaaaataacttggatctaaagacgcgcaaagccggatgtaaagcatgc

SEQ ID NO: 64438 - DNA, 346 bp, Triticum aestivum
  Clone ID: PAT_TA_64438
gtgttttttggagagccgtcgcgctaggtcatgctggagtagttacgagcggtgccgctgttacacttcccatatgggggggaatcgatgcaactctgttggcaggggatccaaagacccacactgattcttgcctggagctgatgaccaaagacgcactgagtgctatccttgttttgatgtttgaacaaatggagcagagaatcatcctgacagcacctaaagaagatgtgcaactccgattacgaaagatgaaagaggagtttcgtgacaaaaagcccaagctcagagctgactgagcctatacactgcgttgactaagaaaactctggagacaacccacata

SEQ ID NO: 64439 - DNA, 297 bp, Triticum aestivum
  Clone ID: PAT_TA_64439
actcggtgttctttgcggatccagagcgtgagcggaccatgtagaagttacaagcgtacatgctcgtgcatgccactgaagagttcttgtatggacaaatgtaagaaaaatggaccggccgggccattagaacgtctgtgagtgagaaaatgacgaaagacgaacacgatagcccgcctcagctcactgggtgaacaacagaaccgggaagacagactgaaggcgaccaaagaagaactgccaccacgtgtgcaagatctataagaagagctacacgacacgaggcctaacattgag

SEQ ID NO: 64440 - DNA, 372 bp, Triticum aestivum
  Clone ID: PAT_TA_64440
tcggctatctttgcggacacgcgtccggagttcaccatgatgaatccagctccgatctggctgttgattgacccagttgagctcccgggcgcacaactggcgcaaggatcgccgaggaggaggactagagctctccggtggattccgttacgaaggatgaactcgagtggacgtctacagtcgttgggtgaacaaatggaccagcatatcggcctgactgtgacgaaagaataactgaccctcctggtggcagtgctgaagaaggaacttgacgacaccaggcctacgactggaaatgtccgctatattacaacctaaagactgttaaatagccgtcgtttcacaacttaatgactgttgaaaaccatgccg

SEQ ID NO: 64441 - DNA, 253 bp, Triticum aestivum
  Clone ID: PAT_TA_64441
cgataatgcttgcgacttccttttgccaccatagcgacagataaatagatcaaatttggcaacgtcatacacactgattgactggtaaagagctgaggacacccaacgtagtagctttcaaggctaccccatttgggtcagcatgggcaacacccaactggcctgcgctgatctggccaagcaccagttctcccagttgtagggcttatggaacgacttctacaacagaggactaagttccaacctggcggtg

SEQ ID NO: 64442 - DNA, 339 bp, Triticum aestivum
  Clone ID: PAT_TA_64442
cctatgctttcggggctaacgcggggggccacggtggagaggaaccaagcttagacccgcgagaatgccacccaagagctcaacaatagactcatgtaaaaaacaggaacagcacgcaaccctacaacgatgtatctgattgatccatgagggaacccaacaaaatcggcctactgcacaaacaatgagctgctgctaacaaaaatctagcccaagcctgaacaaaacatcaacgctaacaattgaggaggcacttttgcaaaagatacgcgcccaaccgccatatattaattgcggctaatacagtcaaaactctcaccgttgacgatacaattacca

SEQ ID NO: 64443 - DNA, 272 bp, Triticum aestivum
  Clone ID: PAT_TA_64443
agtgctccggggagggcgtcgatcaggatacagtaacatgggatgacgctattggatgcccctgctatggtgttgacctggcgaatggcgttaatgataacaagaggcacgcgggggtactcgtataagatctcaagaggaaagatgaatggattgaagagactacgaacaacgggtaaagaattggacacggatagtaagattgatgaagacaaaaaaaaaactggcgccgctctagacaatgcaaacataggagcgcgtggatacgaggt

SEQ ID NO: 64444 - DNA, 313 bp, Triticum aestivum
  Clone ID: PAT_TA_64444
gatactaccgagcttgaacagcttgacatggcacagcatctttggggaccggtgccggggttcggttttcatgaggcgtgcaaccttaattgaatgtgggagtgaaccgtcgaagaggcccttaactgcattatcctggcaagcagacctgaagagaagctgattgcctgcgacatgttgcagagaaacacctctacctaaggagaaagactgcttgcgagcacaaacgtttcttgacatgctgggcaggtattcgagatggcttatggagaaatatgatcctatcaaggagcaaggggggaatgaactgtgc

SEQ ID NO: 64445 - DNA, 335 bp, Triticum aestivum
  Clone ID: PAT_TA_64445
gctactcgtgcggacccggtctagatgaccagggggctttatacagcagcgacgctgacgttcgcggccatggcacgagacagctctgctccactgtcaatgaaatacacctcagtgacccttgtcttacaacgacttggctcacagaccgctgatctcacggaactcaattgcccttatgttcatgcccagttaaccagcttgccacatttcgaggacgcacgagccaatcggccttaccgtcaggagcccatcatttatgccgaattggacgcgccgcctaatttcgcagccagcgctctctgtgcgttgaatacactcatcgtgaccggtac

SEQ ID NO: 64446 - DNA, 441 bp, Triticum aestivum
  Clone ID: PAT_TA_64446
cggtcttttgggggaatgagtacagtgtaaatccctaaacaaggatccatgggagggcaagtgtggtgccagcaggcgaggaaattccagctacaatcgcgcatatgtaagttattgcacatacaaagcttgtggttggaccttgggccggggaggacggtccggctcacggcgagcaccgacgtactcgacccttcggccggcgatagcgctgctagccttaattggacgggtcgtgtttccggcatcgatactttgaagaaattatagtgatcaaagcaagccattggtctgtatacattaacatgggataacatcataggattccggccctattgcgctggccttagggatcggagtaatgattaatatggacagtcggcggcatttgtatttcatagtcagaggagaattttttccatatatgtaagacgaacaact

SEQ ID NO: 64447 - DNA, 289 bp, Triticum aestivum
  Clone ID: PAT_TA_64447
tttattctttctggaatgggtatatagtacaacatgaagcagttgcttttgttgcctaagataaaataaacatatgatgcactctaactttaaaaaaaggagaggatggtgaatagcacccattgcaagaatgcggaggagtccatggacaaagacgaatatgagtaccccctcatggtcggatgtgtgaaaaaatgaaacgttaagtcactctgagcattgactaaagaacaactggaacttccggcggaagatcaaagagaagagctagataacacgaggcctaatg

SEQ ID NO: 64448 - DNA, 436 bp, Triticum aestivum
  Clone ID: PAT_TA_64448
cgtgcggaaccggggctagagtggaccaagattcaggcacctgtgactatgaaggtgtctctcctttatgatgcactctaatttacaaccaaggtgatgatggtgaatagcacccattgtaataaatcggtggagttcatgaacaaagacgactagggttgcccctcgtactgtcgatggggaacaatcgtaacgtggtgtcattctgactttgactaaagaataaatggctcttccgttggaagagcaacgggaagatgtagataacatgagtcctaatctagatacgtggaaaaaaagaacaacgtcgttattgggaaaactctgaagttacccaactctattagtcttgcacaacattctccattcgccacctggcgtaatacataagatgctcatagcgaaagttcctcctaacagttgcttatgatgttta

SEQ ID NO: 64449 - DNA, 289 bp, Triticum aestivum
  Clone ID: PAT_TA_64449
tgttattcgtgcggagccggcgcgagagtggacccagattcaggcgccagcgattgcgatggtgtatcaccttgatgatgcaatctcatttcaactgaggtgaggatggtgaatagcgcccagtgtgtgaaatgcggcggagttcatgaacaaagacgactatggttacacccgtactgtcgatgtgggaacaatacgaaccgtggtgtcagttctgagctgtgactaaagaataactggatcttccggtggaagagctacgcgaagatgctagatcacacgaggccta

SEQ ID NO: 64450 - DNA, 203 bp, Triticum aestivum
  Clone ID: PAT_TA_64450
tttatcgatgctgagcgggcgatcaagggaataacgaatgacgatcgatcacgaggaaaggtaacaaactccgatgataacgctgaagctcatgtaaagaaacagtgaaaccattgaccttgtctttaattactcccgcgtggatgaattgatccaattaaataactatgctcccctcgccagagtgaaacaattagaaagac

SEQ ID NO: 64451 - DNA, 279 bp, Triticum aestivum
  Clone ID: PAT_TA_64451
tttttctgtccggcgccggcggtggagctgatcccggttcacgtacgatagcaagggcaggaagctgaccatgatggtgacgacgacggtcaactggccagaccactgcgcaccagactacgtgtcatactacattggcgttaacgacgtgaggaagccttagtcctagccgttcatcaccgggttaagcattgaataggaggtggactcgtactactgctccaaatactactgccgctcctgctgcaagtgctactgctgctgctaggtgagatcaaa

SEQ ID NO: 64452 - DNA, 379 bp, Triticum aestivum
  Clone ID: PAT_TA_64452
gctttgttttccgcctcggcgccagagaagaccacgggggattcaacagcgatgacgccgccggccgcctcagatgagtacgcgttcgcacaatttgtggatgtcaggactattcccgccatagttcactaagtgatggagtcctttgaccaaagatgaacttgatgtccccctccgattgtctggagaacaatagatctgagttgtaagccctgattgcgactaaagaagaactggcacctacgattggcagagcttatagaagatgtttgatgacatgaggccgaaacttggcactggccgctccatcaaccatcgcctgactgtggaacaacactcgagctccccaactttaattgtcttgcagaacattattttt

SEQ ID NO: 64453 - DNA, 142 bp, Triticum aestivum
  Clone ID: PAT_TA_64453
atccggagccggcgctgtagatgaaccagaatcaggtacgcttgagtgtgaaggtatatgtcctatatgatgtcacctaatttcaatttaatggacgatgatgaataacgatatgtgtgtgaatactgcggcgttaacgaat

SEQ ID NO: 64454 - DNA, 152 bp, Triticum aestivum
  Clone ID: PAT_TA_64454
ttctcatgtcccgagccggcggtatagacgacccagattcaggcacgcttgattgcgaaggtgtccctcctatatggtgccacctcatcacaactggctggacggtgttgaccaggctctagtgtgtgaatgcggacggcgttcatgaacta

SEQ ID NO: 64455 - DNA, 138 bp, Triticum aestivum
  Clone ID: PAT_TA_64455
gcgactagttcggaaacagcgcgagagaccaccgagaggcactttgtagcgattatgctggtggctgtctctgaggagttcaagtatatacaacaggtgtgctgatggtgtattcattgccattagtggcatctgtag

SEQ ID NO: 64456 - DNA, 127 bp, Triticum aestivum
  Clone ID: PAT_TA_64456
ttcttttaccgctgatccggcgcgatagttgaccaagatttattcacccccgctgacgctgctggctgtccctgatgaggtcatgtccgaacaactggctgtaccatggttccatatcgtcctttgt

SEQ ID NO: 64457 - DNA, 128 bp, Triticum aestivum
  Clone ID: PAT_TA_64457
ttctctcgtgcggagccggctccggagatgaccctgatacagtcagcattgatgacgcaggcgtctcaccttgatgaggccacgtcaatacaactggctgtgaccatgctatattatgggcccagttg

SEQ ID NO: 64458 - DNA, 237 bp, Triticum aestivum
  Clone ID: PAT_TA_64458
gcgttttatgccgaaccggcgcgagagtacaccaggagtcagttaccagcgacgtcgccgatggctcaccctgatgagaccgtgtacgatcaactggcgtaataaaggacgttacacacattcgttttatatctgaggaggacacgaccaaagaagaatttgtttgctctcctccgctcgctggttgcacaacaagtacagtgatgaccagcttgacggcgctcaaagaagaactac

SEQ ID NO: 64459 - DNA, 354 bp, Triticum aestivum
  Clone ID: PAT_TA_64459
gtttcttttgccgatccggctcttgagtgcaccaagagacattaagaaccgatgtcgctgctggtttaccgatatgagtacgcgtacttccaactggtggtagtaaggccctatctggacatagtgtttttatggaggaggccctgactaaagtatgattctgtttgccctcctccgttctctgggtgaactaacagaatagtgatgtcagtctgacagtgactaaagaagaaccgtgtcttcgtgtggaatagcttatagaggagtttgatgacacgaggcctaaacttggcactggtctgctttaattaaacatttttactgtaaaaactctgttgttaccccacttaatcg

SEQ ID NO: 64460 - DNA, 301 bp, Triticum aestivum
  Clone ID: PAT_TA_64460
tttttcaccggcgatacggctcgagagtacaccaggattcagtcagcatcgacggtgccgatggctgaccttgatgagtccgtgtcctcacaactggcgaaatctatggtccttcggtgccattgttcgtactgtggaggagtacaagaccataagatgaatagtatagccctcctccagatcgttggtgtgaacaacatgaaccgttgacgtattcctttgactgtgtactaaatgaacaactggatgctctctggtggctagagtctataagaggagctttgatcgacatctagggcta

SEQ ID NO: 64461 - DNA, 102 bp, Triticum aestivum
  Clone ID: PAT_TA_64461
gtgatcttttgggcgccggcgcgggagcaaaccatgattcactcacatgcgacgatgcagctggctgaccgtgaagagttcgcgtacgtacaactgcggtga

SEQ ID NO: 64462 - DNA, 346 bp, Triticum aestivum
  Clone ID: PAT_TA_64462
ttcatgtgcgcggactaggggggggggggacgcacgagagaatcaaagctgacgtcgccgcgggttccacgtgatgagtctcctatcgtgcaaccgaaggacaatatggtcgctcggcgctctacagatttttgacgtggaaaacatgagtagtgacccaactgaaagcccctcgtacgacagctgcgtgatacaacaggagccgttataacacatcaggcgcggaccgaagaacactctgcaactatttgctgagacagattcgagaaggggacgatcacaggagcggtgaactaagcactgcgcgtgtgttggcaacgctcagactgacaaaaccacgtggcaa

SEQ ID NO: 64463 - DNA, 365 bp, Triticum aestivum
  Clone ID: PAT_TA_64463
tttttaccgccgacccggcactagaggataccaggaattattcaccagcgttgatgcagctggctgacccataggagtacgtgtatgatacaactggggaaatcaatggacctacgtggaatttgttaatatgtggaggagacccagtcgaaaggatgaactgattgtcccgctttggtcgcttggtgaacaacatgaaccgtgatgttaccttggctgtgaccaaagaataactcggtcttctggtggaagatctgatagatgagctatgatcacacgaggcctcaagtttggtctggacgtatttaaacaaccgttattactggtaaaactcttacgcttacccactattgccttgtagctat

SEQ ID NO: 64464 - DNA, 516 bp, Triticum aestivum
  Clone ID: PAT_TA_64464
gtcaactgtcgcgccggccgcactctccgccgccccggccttctctccgaatctcaccccgcagctcggcggcctccccggcgtacatcagcaagtctgcgatgaccctcgtcgggattttcctcgcagccctcatctggtgcgccgcctacgtcgccgccgccatctcctcggtcttctagtcctctctttctccggcaacccaacccccacaagccctctccctaaacctaccccgaccccccattcccaatctttcggtagcccgacgctgaccatgggtttcgcgcagctcgtcatcggccccgccggcagcggcaagtcgacctactgctctggtctgtatcaacattgcgagacggtgggaaggaggattcatatggtcaacctggatccagctgcagagcacttcagctatcctgtatctaccgacattagagagctcatatcactggacgatgtcatggaggagctcgggatgggaccaaatggcggcctcatctattgcatggagca

SEQ ID NO: 64465 - DNA, 381 bp, Triticum aestivum
  Clone ID: PAT_TA_64465
tgttgccacgctatatatgatgatctctctctctctctatatatatatatatgtatgtatggatttgcttattgttatctcttctcaccaacggtgctgcctgcctgtgtaactcgaatccatccatcagtaacagaggctttatgatcttaccatcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaataaaaataaaaaaaaagaaataaagaataaaacaaaattaggggggggcccttttaaaagaacccaggtttacctccccgagtgctacataatatttttttttt

SEQ ID NO: 64466 - DNA, 381 bp, Triticum aestivum
  Clone ID: PAT_TA_64466
tccacgcgtccgtggactcgtgggcggacgcgtgggatttaattcaaatttccctattgtataaaaaaaaaaaaaaaaaaaaaaaaaaagaagaaaaatgacaaaaaaaaaaaaaaaaaaaaaaaaaaaacaaaaaaaaaaataaaaaaaaaaaaaaaaaagggggggccgttctaaaaaaaccaaaattaactccccggggttgccaagtaaaaatttttttattggggaaaccaaaataaaatcaatggcccgtggtttaaaaaggtgggaatggaaaaaccccggtgttacccaaattaaaatgcctaggaaaaaaaatccccttatccccaagtggggaaaaataaaaaaggcccgaaaaaaatcgcttttcaaaaa

SEQ ID NO: 64467 - DNA, 302 bp, Triticum aestivum
  Clone ID: PAT_TA_64467
acgtttacgtatccgatgacacgtgggcagacgcgtgggctttatttccagcatcacataccaccacttgaattgaacctcaagcgcacagaggaggagcggtgcaacactgccacccttgcaacagctccagcaacaaggagaagaggcctcctctcaagaggggccagatcaaggtgcaaatagccaagaccctgggcagcctcgtggtgccgatcgccaggaacagttttagaagatgagatggctgatggccaaccaagctagaagtgtggtgtggtgcttgatatgcatagggattg

SEQ ID NO: 64468 - DNA, 484 bp, Triticum aestivum
  Clone ID: PAT_TA_64468
ttcgaccacagagcggcggcggcggcggcggcggcagcgggggagagaggagagagctccagccatggtgcacgtcaacttctaccgcaactatggtaagacattcaagaaaccaaggcgtccttatgagaaggagcgtcttgatgcagaactgaagctggttggtgagtatggattgaggtgcaagcgtgagctctggagggttcagtatgcattgagcaggatccgtaatgctgcaagacacttgctcacactggatgagaagaatccccgccgtatctttgagggtgcggctcttctccgtcgcatgaaccgctatggtctccttgctgagggccaggataagcttgattacgtccttgccctgactgctgagaacttccttgcaaggcgccttcagactcttgtcttcagggctgcatggcaaaatccatccaccatgcccgtgtcttgatcaggcaacgccacatcagggttggcaggc

SEQ ID NO: 64469 - DNA, 228 bp, Triticum aestivum
  Clone ID: PAT_TA_64469
gacgctgaggcccagggcgttaacgtctatgcctgtgaccggaaaaactggatgagcttcagcacagcggagcgtgagttcagcatgattaaatcaacaccgctgatgctgttgggtgaccttgcccagttgaggtccggacaactcaagtgatgatggcatggccgtgccatggcatttctgctgtggagtggatgacaaaagataagatgaacggaccgctccgct

SEQ ID NO: 64470 - DNA, 322 bp, Triticum aestivum
  Clone ID: PAT_TA_64470
tatctgtgttccagtccaagggggcgagaggggcggcacacccatccaaggtcatactgtgtcaccacttctcttcgcccctagcaatccatatgtgttgtgttgccacttctctttttttcacatattcgtgaccaacattatcatactgtgcatcgctcttcttctatccttgtccctggcgaggctatcctggaccaatgcttgtaattccacaaacttgtaatgatggtcggtgccagccttgtctcatctacaacacccatgtttcgaggaaaaaaaatgatgggttgattgagaaaaaaaaaattaaaaacataag

SEQ ID NO: 64471 - DNA, 480 bp, Triticum aestivum
  unsure (1)..(480): unsure at all n locations
  Clone ID: PAT_TA_64471
ttgaggatggttttattcatgtcagaaatgcggtgaaccctgccaccctcgagcaaatatttggtttctcatctttggctggtgcaccaaatctgttggtattggagcaatttgataatgtattgtccagaaaagtaaatgaagttgtgaatgaaataaggcgacagagatgctcctacctaagactgagactatgccaaaagggcgacccatctggagatttcttccgttccctgttggttgaggacaaagcacccggtggcctttcttatgtagagttccttgtacatgttcacaggcaaatccagagcaagatgacctgacatgacctgcttcattgttgtgatgttttggttggtagacatcatgacggactcgatttctgcatgtggatatacaaaaagggaacaacgtttttctttgtaaacacagctatagcagatttgtaggattctagtcnttgatttacaagtcagtttg

SEQ ID NO: 64472 - DNA, 329 bp, Triticum aestivum
  Clone ID: PAT_TA_64472
gttgcatttcacaggattgaagatttgaaccatgcttgagagtccttgttcctgatctttgcatttccctgcatttctttcacgtttttttttctttctcaatggttcctttcgttaaaatggaccaacatggactgaaataataaaatttatttccaagtttcaaaaaaaaaaaaaaaaaaaaaaaaaaaaaaaccacagaaaaaaaaaaaaaaaaaaaaaaaaaaaaaaaaaaaaaaaaaaaaaaaaaaaaaaaaaaaaaaaaggggtgccaaaaataaaaaatccccatttctttcaactcaacaaatattggggggccccctttt

SEQ ID NO: 64473 - DNA, 535 bp, Triticum aestivum
  unsure (1)..(535): unsure at all n locations
  Clone ID: PAT_TA_64473
ttcaggcattgagaaatcgagcgtcaatctgctgatcactcgcatttgcgttgagcagatcacttgctgtgtagattgcaggtacaggttcctgagcttgcatgcgcatggccaaggcttgcctactccgcggtgtggggctggtggtgtgcgcactcctgcttctctcgccctctttcatggcggctgaggcaactggccggaaatgggatcacgggagagaggccacggtggccgtgatgccgatggcgggagggcgttttgcgaggaaggtgttgcgggaggagatggtccaggcagacggcgacgtcgacattgccggctctaagaggaaaagccccggtggcccagaccctcagcatcattaactgatgtcgaggtctcctcgcatgcatatttctctacaaaggcagcatatacatgggacctgaattccaagatagattgaccgatcaagctngtgttcttgtcttgatatcgtagtgaaagagatggttttgtttcataagcataggtatatacatgtattacatac

SEQ ID NO: 64474 - DNA, 482 bp, Triticum aestivum
  unsure (1)..(482): unsure at all n locations
  Clone ID: PAT_TA_64474
tgagtcntagtgggagggaaagaagagggagatcaggagatggggaagggagggaaaggcttggccgctgctgcagtgtccttcgaggtggtgaacatggcgttgtttctagtgttcatcaacaccctcttgatcatgccttttaagcttccgcccctttgttcttattatgttcgagttctgttgaaggctctgtttatttgctcgtagctaccttcttttccttaaggatatttacatttttctttttttgttttatgagctcatggttttctttctccatttctctttccttctctaccatttttctacctttttttcatctttccccttgcacctacttttttctttattctcttttcatttctttttcttttgtcttttaggtcttttttcttttcttttcttttttttcactttatcttcttctctattattcttttttttctttcttaattaatttctcgcccttcttttctttt

SEQ ID NO: 64475 - DNA, 473 bp, Triticum aestivum
  unsure (1)..(473): unsure at all n locations
  Clone ID: PAT_TA_64475
cattatccaattgcccaaccagcacttccgcaaggactggcaaatccgtgtcaagacttggtttgaccaagccggacgcaagtcccgccgacgtgctaaccgtgtgaccaaggcattgcgcattgcaccccgccccattgatggcctcattcgccccgctgtcaggtgccccaccatcaagtacaacaccaagctccgtgctggccgtggtttcaccctcgaggaactgaaggctgctggtgtccgtcgcaaggaggccatctccattggtgtatctgtcgacttcagacgtcgcaaccgttctgaagagtctctccaattgaacgttaaccgtctcaaggcctacaaagctaaactcattgtgttcccccgcaaggctggaaaggtcaagaagggtgacactgagatctctttcgncgactttgccaagcaagcgcatatcaaggtcgccaacgtcttcccggttgagcaac

SEQ ID NO: 64476 - DNA, 199 bp, Triticum aestivum
  Clone ID: PAT_TA_64476
ctgacgcgtggggttctgggataaggttaagagcgctgagaaggacgaggttacgttgcctgatcagccggaggatgaggagtcggtgatggatgaactctgatgtatcaataggagtgaagggttgatgtattcttaggcgtttgggatatggcattggcaaggcatcgaagctgcaataattttatagtatttaccg

SEQ ID NO: 64477 - DNA, 226 bp, Triticum aestivum
  unsure (1)..(226): unsure at all n locations
  Clone ID: PAT_TA_64477
tcgatcnatccgccggcgggcgctatatcggatgcgggctttctttcgggtgcatgcttcgttacgcctgtttgatagggtctcctataatctatatgcactgcccgaagttatacaacggtccgactgggaacaccctggggattccgaacaataatgacttgcccaactttcccctcttgctagatggcgcactttcgaccggtgccgtactagtcgatatgtc

SEQ ID NO: 64478 - DNA, 318 bp, Triticum aestivum
  Clone ID: PAT_TA_64478
gctgacgcccctgccggtgccgttcccgactttgcgggttgccccacgcactctgtttccacgacctgtgccaagcgtgaggaggctgtgatggatgctgcagccgcggttgtgatgactaacgatgaggaggatgcttccaagcatgtggaggactaatgggacttggatgacgaggatgctgtggatgaggacacaggtcacaagactaactgtgaggccgactctgatgactagaagaacaactagacctagatggatggctaggatgaacggaagacgaactgcttctccccggtgccatgattgaagaggagc

SEQ ID NO: 64479 - DNA, 198 bp, Triticum aestivum
  Clone ID: PAT_TA_64479
tcttttatcgcgtgcgaaaagtggatatgctatcctgtactttctgtatattatgaaagatctaattgcctatccaagaaaagaacgagttcgaacaactggagaaaaaatggaccttagaagacaatagaatggtggggcggactacaggaccaaagattacctggctggcctgctacgatcgatgggtgaacaagt

SEQ ID NO: 64480 - DNA, 336 bp, Triticum aestivum
  Clone ID: PAT_TA_64480
tcgctgacccctgtcgggtgtactcaacttccaccactagctaagctccatctgcatccatccatccatcctcccatggcgtccgtgaagctcgccgccgccgcgctggccgtcgtgctcgcgtgtgctgcgctcgccgcgacgccggcggcgacgtatgcggagtaccggccggagcccgagccctgcaagacgcaggccatgtacttcaagaactgcctccgcctcggccactgcgagaagtgctgcttcggggtggtggccaacccggcgtgctacttgcaggtggagcgggaggcgctgatcgagtgcgcgcctggccaccactgcagtcgc

SEQ ID NO: 64481 - DNA, 439 bp, Triticum aestivum
  Clone ID: PAT_TA_64481
gcttcacacaaccctctgcacccccagcaatccaccccttacccctccccggcggatgccctcccctgccgagctcgagaatggcaaacgcatcatgcggagctggtatccatgatgactgcaagctgaggtgtgtggagctcaagtacaagaggatgcaccgctgcataacctacaggctggagaaccagacggaggtcattgtggaccaaactggggagcgcgaggccacctatgatgacttcaccaagaccctccctgagaatgactgacgatacgcggagttcgactacgacttcaccacccaggaggatgtgccaaagagcacgatcttctatatcttctggaacccggacaccgcacaggtgaggagcaagatgacgtacgctagcaccaacgagaagttcaagaggaccctggacggcatccacatcgagat

SEQ ID NO: 64482 - DNA, 195 bp, Triticum aestivum
  Clone ID: PAT_TA_64482
tcttccacgcgtgcgaaaagtggatatgctatcctgaacttcctgtatattatgaaatatctaattgcctatcccagaagagaaaatgaacaaacaacaggcgtaaacatggacctaaggagccaatgatacggtggggcggagtacaggaccaaagatgagctggctgcccggctacgatcgatgtgtgaacaa

SEQ ID NO: 64483 - DNA, 189 bp, Triticum aestivum
  Clone ID: PAT_TA_64483
aaaaaaaaaaaaaagaataaacttccctagctagggacaaaaaaaaaacaatgttatttgtgtgtcaataaaatcctgtccggaacaaatgttgatagcctgttgggggccagtactcagaggaccaccctcttaataccggcggacggtgatcccaatttctatatatggcttaaataactaaaaatc

SEQ ID NO: 64484 - DNA, 255 bp, Triticum aestivum
  Clone ID: PAT_TA_64484
aatcgtactgtttgttattacccatgcggacgtcagtatttttgctctgctctatggttgtcagtcgactctccaatgttgtgtcggtaactatcagatgttgagtgtcttgaaaactttctgataattgtgggatttgctttgtaatggtaatcgtgaaattggtgtggttaaaaaaaaaaaaaaaaaaataattatcaaagtaaaaaaaataaaaaaaaaaaaaaaaaaaaaaaaaaaaaaaaaaaaaaacaa

SEQ ID NO: 64485 - DNA, 321 bp, Triticum aestivum
  Clone ID: PAT_TA_64485
ctctagtctcccgggtgaaaaccacaacactgttgggcggcggcggcgcccttggcagcggcgatgctcgagggcgccgttcccctccttggaggcgaacctggccgtgtggacggcagatgaactggaggacgggtggcatggtgcagcgggagatcggcagcgccagatctggccgcccctgcctcccctgtgtggcgagctcctacccggccggatccggtctgctcctctgcgggccgacaggtctcgcgccgttggggtaagggtggcggggattccaagaccgggagaaatcctaggccggtctcgccgggcttg

SEQ ID NO: 64486 - DNA, 247 bp, Triticum aestivum
  Clone ID: PAT_TA_64486
caacacaaacttggaccttaatttggctgtgaatttgtatgcgcaagaggaccatcctgatggccatactctgggactatatctggtactaggactgctcccgcgcacacgcagaggtactggtcgaggttcggcacggcacagggaaccgtacatcgattcttattcccaccagttgacaatccacaagacgatgtgccacctggactgacacctaatatgacactttggataccagctattgcac

SEQ ID NO: 64487 - DNA, 430 bp, Triticum aestivum
  Clone ID: PAT_TA_64487
cgctttaatggaaaaggatccaaacaaggcagttctattgttctgggcagctattaatagcggtgaacgaattgaggctgcattgaaggatatggctactgtactgaaacaagcaaatcgggctgaagaagccgtcgaagcgataagatctttccgtgaccgttgtccaaatgaagctcaggagtctcttgacaatattcttcttgacctatacaaggaaacacatggacatgaagctgcggtggcgatgaagacgatattaacatgaggttgcggcggcgatgacatcgacatcgacacgaagctgcggcggcggtgacgacatcgacatcgacacgaagctgcggcggcggtgatgacgacgacatcatcacggtgctgtggcggcgacgatgacgacatcgtcacagtgctgtcgtggcggcggcga

SEQ ID NO: 64488 - DNA, 194 bp, Triticum aestivum
  Clone ID: PAT_TA_64488
caactaccgctactaccagggtgatgaggaccagggcaactgagtgccccattctacaccctcagcgtggatggaaggatatggaccctattgaacgcaggtgccgaattgctacccccgaggaagaggcgcgccctcatacggaacgggtacagcccgtacgtgcctgatgaagaccagaagggtttgatcaa

SEQ ID NO: 64489 - DNA, 258 bp, Triticum aestivum
  Clone ID: PAT_TA_64489
ccatggaggggagctccagttcccaatccaggcaacaaggttctagttcggccagcttctcctgcaaggtgaacacggtttatgaggacaaaaacatgggcatcctcctgtacactgatgacaatggtgacttggagggcgagggcttggatgaaggcccaagactaacactgcgagatatggagatattggccaaagatagagactcgaagaacacgacagacgattggcgggagagagcgctgtggatcgtgggcg

SEQ ID NO: 64490 - DNA, 329 bp, Triticum aestivum
  Clone ID: PAT_TA_64490
aaccacctgaaacatcctataggtgccgaatgggagtgtattgtgctcgtgccatgaactcatgatcatgacatgctggcgctttttggggggccatcaagagatcgatgatccatctcctaggtcataattaggctatccgctgaattggtttgccccacctgtgaccctgtagtggcactgtatctttctttttgaactgaccacctgtagtattttctaatttggccagaagttcatttcagcctcacctttacaacagccttccagtgtccgctttagatagtgtggaatctgatcctgccaccgatcattaactcgccgaatga

SEQ ID NO: 64491 - DNA, 341 bp, Triticum aestivum
  Clone ID: PAT_TA_64491
aaaaacgcgagcactatagtaccagtaccgttcgttatgaataatatgtgcatcaagtcgaaccaagtcctactacagggtgggagggggtctataaacaaaacatgaccgacacacttgagctccaagcctaccaaccaagtctacgaccaccgggagtgaaaaacaaaaggcgataagttaaattaaaatcctcgcgaaaaggaacaaaacatacgaagcccaccaaggaatagcacgatttgcaaggtgatggggtcttcttaacatgggcctagtcccacaagaggttgatcatcgagttggccagcccggcctccttgaaggtctgctcgctcgag

SEQ ID NO: 64492 - DNA, 416 bp, Triticum aestivum
  unsure (1)..(416): unsure at all n locations
  Clone ID: PAT_TA_64492
cgaacatgcgttgttttttccgccgccaccaaagcagatccagcacgaagttctcctggcggaacaaagtgcctctccagcaaagcaggcagagcccgagccgcgcctcgaggaggaacagagcgttttttctccaatctctcgcgtcccgcactggttcagccgccgcacggatgcctccgagctcatggggttcgcggcgcgcggcctgctcgggaatggcaggtccatgcaggaggggtaccggcagttccaggagccgtcggtgttcaacgcctggtgggaggctcacacgagcagcgcgatgatgcccaggtggagcaccgcttgacctgggccggcctaaaggggtgcatgccttcccttttgacagttatncacaaggacgccgacacgatttaaatagaatgcctctg

SEQ ID NO: 64493 - DNA, 264 bp, Triticum aestivum
  Clone ID: PAT_TA_64493
ccaatacccccggaggcacgaccgcacacaaggggggggctcaataaaaaaagcggggcgaacaacaccgccaccggcacgaacaagaaaccaaccaccgccaaccaagcccccagaaacaaccaaaggggcgcccacagcacggaagacgaaaaaaccgagacgcacaacccccaaaaaaggagcggggcaaccaggagccaccacacggacacgaccccaacggacaccaagaagaagcccaagaccacgcggcgaaaaccc

SEQ ID NO: 64494 - DNA, 359 bp, Triticum aestivum
  Clone ID: PAT_TA_64494
tgcgtaccaggagcaagagacacacattggctggggtgaatacacctggcgagggcatcccacgcaccgactacgccccaggagggcagaacgcggcacacacccacccgcgagccgccgagatcatgttcgccaccgacggagcactggagggggactctaacagcaccgaccacaagctcttgactaagactgtcaccgacggagacgtgagcggtgttccgcgtggcctcgtgcacttccagcagaacagggggcgaggacctgcatccgacatcgccggctacaacagccagctgcagggcacacaagacatcaccaccacgctcttcgctggcgagccggcagtgcctagcgac

SEQ ID NO: 64495 - DNA, 267 bp, Triticum aestivum
  Clone ID: PAT_TA_64495
ccgtcgatgcccccgcacccacggcaggaggccaccagggatacttaaagacggcagaggcggcgaaccggccacaggcgagtgcaggcacaggcacaaaaccaaatgacagcccctcggaagcagagggagtcaagggaggaagccacgacaaaagaggaaccgacagcccgccaccgcacgccgcccgaacaacagaaccgtgagggcagccggacgcggacgaaagaagaaccgccgcccacggaggcagaacccaaagaggag

SEQ ID NO: 64496 - DNA, 498 bp, Triticum aestivum
  Clone ID: PAT_TA_64496
gtatagctgcgcaaggcgcacgcgctgctctcggacgcgaggttccgcgccgccgtcgccgttagcacagcgcgcaagctcgacggggggctcgtgccgctcctcgacggcatcgctgccggcgcctcggtcgtcgacctgcaggacgtgttcatgcgcctgacgttcgacctcacggcgatgttcatattcggtacggatcccggctgcctggccgctgacttcccgcgagtgccattcgccgcggccatggacgaggccgaggcggtgctgttctacaggcacgtgacgcccactgcctggcggaggctccagacctacctaaacatcggccatcacaagaagatgaccaaggctcagcaggtgctcgacgcgtctatcgccgagttcgtctcgctacggcgagagcgcgcggccagtgccgacgccaacgccgatggaagcgacgacgccgctgatcttctcacgttgtacatggcatgccaagacgagctaggc

SEQ ID NO: 64497 - DNA, 195 bp, Triticum aestivum
  Clone ID: PAT_TA_64497
ggcctggatacagctgctctagaccgaaaagaacggggggggttaaaaagacaaagccgggagtaacacacggcgccagacggagaacgaaaaggaaacaggaacagaaggcaaacggggagaggacaaggtcacgagacacggagaccatcatgcacacgaaaggacggaacactacaagccatggaaggatag

SEQ ID NO: 64498 - DNA, 320 bp, Triticum aestivum
  unsure (1)..(320): unsure at all n locations
  Clone ID: PAT_TA_64498
ttacttacccacgccaangcaacatgacgcgaggggggttgtatcaaccacacccgggcatcaacccaaacacgcaacgacaaatcgagcaccaagcgggggcaggacacgccgaggagggcgaggcgagaggggcgacgaccacaaacgaacgggcgagaaggagagcaaacaagccggccagggccagtggcaaggcggggaccggcaggggactaatctaggacgccgcatggcaggaggagagaccatgtcatggataaggaggtggaagatgatcgacaggtcattccatgaactaagacgttgcacatcatcta

SEQ ID NO: 64499 - DNA, 342 bp, Triticum aestivum
  unsure (1)..(342): unsure at all n locations
  Clone ID: PAT_TA_64499
gcgtaagttacacccggcgaggagcagccnaagagggaccgtaagaagcacagggccaccaaagaggaccgcgccaagagcaagaacaggaaatacctgaggaagccgaagaaggtgaagaagagcaacggccagatgcacgccaccaacgagatcaaggagaagaacccaaccacgaacaagaacgagggcaagaggctgcgacaccagagcaggacaggctaccacaacatgtacaaggagtaccgtgacaccacactaaatggagccgtggagcaaaggtacacagagatggccactcgccaccgtgagagaaccccctgcaagcagagcaacaagacc

SEQ ID NO: 64500 - DNA, 510 bp, Triticum aestivum
  Clone ID: PAT_TA_64500
ccctcgatcgccacgcgtccgtccttctccacctgcggccgttgccacggtcaggccggcgtggtggtgcgcctcccgcctcatcacccatctccatccaccacaacaccatcaccctgcaccaccagcgccaccagcacccccaccatcattccgcgccatccatccaccatctccagccaccgccgcatctggcgcgacccaccagacccaccagactgcccgtctggtgtccggcgcgagcacgccatccaccacttccacccctccctctctgttgttgctgctcctccctcttgcttcgtcctgctgcttctcttcttcccctcgccttcctcaactgctgctgctcccttcttaccccaaactctactgctgcatcttcctttcttctccttgtccctactactgctgctgaaccgctcctcctcttgctgtgtctctgctactcgctgctcccctactgctgatcctttcctcaactctctctgctggctctctcatgccact

SEQ ID NO: 64501 - DNA, 305 bp, Triticum aestivum
  Clone ID: PAT_TA_64501
acgttaagtataaagaggcggcagcccccccaccggggaggttaacaagaagtgagggcagggcacgaggcgcacccagaaaaccacaggagagggagcaagacagccacggcggcggccactcacgcagcacgcgagacctgggctcccagagggaaggtcacacgctaaaagacaaatacaggagtgacccagagcgagggacaaaaagaaacgaaagccagccattgcggcacgcgaacccgacaacacacggggagaatgcaaaagctcctgcaaaggacacaaggctggatgagagcacc

SEQ ID NO: 64502 - DNA, 625 bp, Triticum aestivum
  Clone ID: PAT_TA_64502
ctgccggagcctgtttggaattcccgtttcgacttcacgcgcccgcagcttattccggagccacatacgctgctacgcgctcgcgctttcctggagcatgtcgctcattctcgccgacaagtacgccgacgtgatctactctatcgtgttgcaggatgattttttgccaagaacaccaacaccattggaatatattttcggctctatattctgcttgccctgcttgttattcctattttgcttgagagatacatttaaacaagacaagaaaaagtttaaagatccaagaagattgtatgctcctggtcggatgtatcatatcgtcgagaggaaattttgcagctgtgcaagatacccacctgaggtgagaactgctattccagtggaaggacggtttgagcatattgtgttatcgtgcagtaccactgctgatcatggcattatttggattgagcgagaatcagccttggctttagagctaatgaaggaaaaagagaaggcaacaactccacctgctgaacaaaagatggagagattgcaaagtttcaaggaagacacaagaatgcgctcacagggcgaaaacctggatgttcctatgcgaagacatctctgaagagaacccatg

SEQ ID NO: 64503 - DNA, 393 bp, Triticum aestivum
  Clone ID: PAT_TA_64503
aagcagccggggcgcagggggcgggttttaatgaaaaaaagcgcgcgttcctcaccgccgaggacacgggactcggctgcaccgatgggggcgcacgagcactcttactacggagccacgtacccgcgggcggcggcaggacgatccagatcgacagccaaagctccgaggccaagcgccgcgccggcgaccgagccacatcgaccgacgaggacacgtggcgcgacgtggcgtcgctggcgtgcgacggctcgccggcgtgcgtgcgggagctcgcggacacgaggagcgtggcgatcgaggtgcggaggaggcagaagaagatcatggggcgcgccgggacgacagagctgcttggccgcgcccaaggagcatggagggacgtgggtgacc

SEQ ID NO: 64504 - DNA, 347 bp, Triticum aestivum
  unsure (1)..(347): unsure at all n locations
  Clone ID: PAT_TA_64504
cccagccgcgcaaagacggggcggggtttatttaaaantccctttgttttttcccccgcgggggcaagcgagagccattgtccccaccaagggcgaggggccggccatcggcatcgacctcgtcaccacctactcgtgcgtatgcgtttggcaccacgaccgcgtcgagatcattgccaactaccagggcatatcgtccacgccctagtacgtaaccttgactctacttggagcgaatattatgagatgcctaaaagaaccaggtcttcattatccccatcaacaccgtcttccatgcgaaccgttttatcgggctctgggtttgctgatgcccctgtccatagtga

SEQ ID NO: 64505 - DNA, 424 bp, Triticum aestivum
  unsure (1)..(424): unsure at all n locations
  Clone ID: PAT_TA_64505
gaccgaaccggaacacccgggtcgcccacgcgcgtggataccaacccccggaacggaggcgcacgggggggtatgagaaaacagacggagcgccaccgccagggngccgcccgcgcagcaaccacccccgggaccgagaccaccggcgggcggcgggcaaggaggcggcaccgatggggaagaccccggccaagaggcacaagaccgcgcccaccgggaagaagaccaccaggactggccccgccaaggccaaggacaaaacggccgggagcaacagaggagacgccgccggcgggaaggagcccgggaacacggagagcaccccagagacccccgagccggagncacgaacaccgcgcaacaatgacgccgagccggaagaggggaagggtgagaaaaccagcaccgaaggcgaaacggcggc

SEQ ID NO: 64506 - DNA, 419 bp, Triticum aestivum
  Clone ID: PAT_TA_64506
aaggtacttgcgttgacaacatgcactatttaaatgatggcctgtgtaaggtactctctgcttttccctctaccttatgaaatactccctccattcctaaaatataagccctttcagagattccaatacggactacatatggagcaaaatgagttacactctaaaatatgtctatatacatctgtatgtagtccatgttgaaatctctagaagggcttatatttagaaacggagggactagttgctgtaactgaagcgcatatcaagtggctttgccagatttgtgacaattagtaccagacggtgattgccagccctttttacccttgcaatatgttcatgattgccgcagcaagctcactccttggggagcagagacagagcagagattcagttagaagcataacacatatgctact

SEQ ID NO: 64507 - DNA, 268 bp, Triticum aestivum
  Clone ID: PAT_TA_64507
ccacgtgaacccggacgcgtgggctggtggtggcggcgctgttgcttctatctgtatctgtgttgcttaagtttgatgtgtgatgtggaaactgttatgttaattattatggctttgattgaaccggttgtaaagtttgtaagtggattttgcatttcatagtattatcatatcactgccatttatacaagtgatagcggtggactgtggcgcactctcgcgctgtacacgtaggatttattgtccgtgcggtcgtttttcttgcgtg

SEQ ID NO: 64508 - DNA, 233 bp, Triticum aestivum
  unsure (1)..(233): unsure at all n locations
  Clone ID: PAT_TA_64508
tttactatcggcatccatggcgtcacccccggggnggtttttaattaaannaggcgttcctttaatttcccccnaaaaagaaaaaaantaaaaacaccatcaccaaaaaaaacacttaaaagaaaagaacacccaaaaaagaacaacaaacccaaaacatggaccaacaaagaagaagcaaacttaaaggaaggggtacataaatggggggaaagaaattggctgaacattct

SEQ ID NO: 64509 - DNA, 211 bp, Triticum aestivum
  unsure (1)..(211): unsure at all n locations
  Clone ID: PAT_TA_64509
ccccggtggaggcagcggcccttttcaacaaacttggaaggacaagaaacattagcgcgggcggttcccccccaccggggancaggacggaccgccccgacgagggcaggggccccgggggcgcgcggaaccccgcgcgcgacagcatggccataacggcccaggggggggggcggccggcaggcgcctgcacgccggcggccaggcccgg

SEQ ID NO: 64510 - DNA, 325 bp, Triticum aestivum
  Clone ID: PAT_TA_64510
gcattcaatatttccgccactcacaccgacctccgggccggcttacatttaatcctggccaccgtcaccagctccatcgactacggctcacccacctctgctgcctccctggaagccgccgccctcctcaacctctccgtggcactcgctgacccctcgggcaacctttccgcgcactggacgccggccacgccgctctgctcgtggccgcgcctctcctgcgacgccgccggctcccgcgtcatctccctcgacctctccgccctcaacctcaccggccccatccacgccgccgccctctcctccgtcccgcacctacggaccc

SEQ ID NO: 64511 - DNA, 545 bp, Triticum aestivum
  Clone ID: PAT_TA_64511
ttcatacctaaacgaaatgaaaaaataaaggtagcgcacaatgcactcactctctctctctctctctctctctctctctctctgatatgatattacagcctactagtatacagaaatgctggagctccagcttgacaacgatcagttgtcgcagaaagcgcggagggtttcgtccagggctttcctgtcgtactcgccggtgaaaacgcagcctcccagaggtcctttcagaaggatgagcctcaacaatccgtccgcgaccttcttgtcgaccgccatgatgtttctgaacttctctaccgtcatgccctttggtggtgtcacgggaagcttggcttgatctagtatgtcaaatgtccgtttcttgatggactcgtctatccagcccaggcggtaagacatgtcagctgccataaccgttccagcagcaacagcctccccgtggagccattctccatagccaagccctgtttctatagcatgaccaaatgtatgaccccaggttagtgtgctcgaagaccactttccttctcatcctgagcaac

SEQ ID NO: 64512 - DNA, 391 bp, Triticum aestivum
  Clone ID: PAT_TA_64512
gtacacacccacgacggagaaccgaggacgattaagttccttggatcgttcatttcatggactctcatcattgatgttgttgaagaggatacaccagttgaggaaaaagtcattgagattatatgcaagaagctgccaaaactgcgggtactagccgttgctttcagcaagaaacatcatggaatcaggaaacccaataagttctcggtcccaacatctattgctcagttaaagcacctacgctatcttgctttcaagacataccactcatgctttgtaactttaccaagaacactaactaaacttcaccatatccagctgctagatttttacgagggcctaatgttggaattcccctttgctgaccgtgtcaacttgcggcacatgttct

SEQ ID NO: 64513 - DNA, 447 bp, Triticum aestivum
  Clone ID: PAT_TA_64513
ggatttggtccgctgaaactgctgcgagtagcttggttgttgtcaagtggaattaaccctgtttgcgtgcgctcttacagtttgattgagaaactcatattttcctgtagattgggaaggatgtcgagtacctcctggtggcaaagctttctgcagcagtttagtattgttcccaaattgttcagatccgaaggtgttgccatttatgttgcgcggcttgcttgcattggtttctcctcaacctgaactgaacacattttctttcttcagtgtgtaatggagaaaggaaatggttgataaaaccaagaggcacagacagagatgtgctgcatcagagtacttctctagattggtgcgctggaaatgttcaacgatctatgatcgactgcattgatcaaaaagaagagaaaaaaaaacagggactcagcagctgcttggaatctgctc

SEQ ID NO: 64514 - DNA, 332 bp, Triticum aestivum
  Clone ID: PAT_TA_64514
caagaacggtataatgggtgctgccggatcggtaggcttgtggccagggctgcgctccagagccccgatgtcgaactcgtcgacgcgaacgaccccttcatcaccaccgactacatgacctacatgttcaagtatgacactggccatggacagtggaagcaccatgaagttaaggtgaaagacttcaagacccttctcttcggccagaaagaggtagctgcgccagggtgcaggaaccctgacgagatcccatgggctgctgctggagctgagtacgatgctgagtccaccggtgctttcactggcaaggaccaggctgcagctcacattaa

SEQ ID NO: 64515 - DNA, 257 bp, Triticum aestivum
  Clone ID: PAT_TA_64515
caccgtccttcccgaggggctcatcgaattccctctgccttattctagccgaaccgggacattaatgtgttcatggcgaaccgcagccggatccgtcagaagatggtcgagttcgatgacaactacaagctgggagacctctatgacatgaggatctccaaggaggtagctgtggatcttctgggtgaggtattcaaggtgactatctacaagatcatgggcggatgtgactagcaggagttctcgcagaatcatgg

SEQ ID NO: 64516 - DNA, 266 bp, Triticum aestivum
  unsure (1)..(266): unsure at all n locations
  Clone ID: PAT_TA_64516
tttcaagttgtaccatgcgcattctttagttatgtgttccgttctctcccccnnttttttggaatcttcagtggagcatatagcttggcatatcaaaaattatagagtactaattagcacatattcttccctctttatcttttctctcttctctcttatgttttctttctctctcatctctcttttctctcttctatcttaccccctttgtaaaaaaaacattaggtcaaatttggacctaaaaacttcagaatgatgattatctg

SEQ ID NO: 64517 - DNA, 203 bp, Triticum aestivum
  Clone ID: PAT_TA_64517
aaaaaaaaaaagaaagaaaaaatacaacccccaaaaaaaaaagaactggccagtaaaccaagatcataaaaaaaaaaaaggggggggcgtttccaggataccaaattttactccgcggggtgaacaatattattccttttttaaggggcccctaaaataatacctaggggggcattttacacaccatcgcggggggaaaaacc

SEQ ID NO: 64518 - DNA, 330 bp, Triticum aestivum
  Clone ID: PAT_TA_64518
aacgggccaagccaggcggactggattctggcttgcgctttttaaacccccctggcacatcggcgtagcctatgatgatgccaaattttcgtgtaaactgtggtaactgccgtcgtcgaattacccaccgttgaccttggttgtggtggatgttgtatgtttgggatgtttggcccaactccaacctcaccctggtgggtgaggagtagatgctaactatggcaaagcaagcgtatatggaagggaacgggtgttccagatccacccagttaaacttgttgttgtgcaaggagcagtcttcatcttgggcgttgcttactcttttaattt

SEQ ID NO: 64519 - DNA, 452 bp, Triticum aestivum
  unsure (1)..(452): unsure at all n locations
  Clone ID: PAT_TA_64519
gcccgaagcagccggaggggcttaattaagtgttgcttctcttggccaccagcctncgagaagcctcggccgcgaggccgctccggccagccgtcgacatgcctagcgaggtgctcaaggaccaggtgatcgtcaacaagtacgcgccgcttctgctcgccatgctgccgaggggccccgtgacgccgtccggccccagcggcggcacgaacgaggccgggaactggttgagcaagcgcagggtttcccttaggataatagatccatcgatctaaagaaatctttaggcatgcagtggtagacggtatgctctgttttgcagtacaaaatacttgtacatacatgattgttagactgggagacttgggcatatagtgtaggatataccccaaaattataccttcattctttaatttgtcccttgaagtaattgattgaaagagttttgtctt

SEQ ID NO: 64520 - DNA, 180 bp, Triticum aestivum
  unsure (1)..(180): unsure at all n locations
  Clone ID: PAT_TA_64520
ctttcgttagaaacagnangcagacagagngccgggcagggttgcttagagnacaatatcatataccacacgaacaagtggtgtatttgttatcgaaaccttgtcttctatatggtccaaaaatatttagcaaagaagaaaccactacagacagaaaaagcataagacagaagccccacc

SEQ ID NO: 64521 - DNA, 440 bp, Triticum aestivum
  Clone ID: PAT_TA_64521
tattttcctcctttggggtgctcaatgaacttttcttctcttttgctgcacttagatacttgtgtagagatatacatcgagatggacaaccctccgagtacgcaggacatgtcctactatgatcatgttcagaagcgccatgaggagaaaggctgcttatatgcatgcctgtttacactgtgctgttgcttctgctgctacgagacctgcgagtgctgcatggagtccttgtgctgctgcggctaaatttagctgcacatttctgctgttgcatggagatctggcaggctgggctgtactgtggaaaacccatatcgttttgccttggtgagctggcgaataggcatatgtggctgcttgaataaaaactgtagttacgtctctattgtcatgtatgatgctggtcgccaaaaataagatagtatgccgccggtgtgtgt

SEQ ID NO: 64522 - DNA, 256 bp, Triticum aestivum
  unsure (1)..(256): unsure at all n locations
  Clone ID: PAT_TA_64522
aaaaaaaaaaaaaanggaaggaattagaaaaaaaaaggcggtggaaaccccaacaaaaagaaggaaacaacaaccagagccaccccaagagggcgccccagccgagaggaccacccccaaccaccccggcaagacggagaccaacgcggcggaaagggcaaaccaaaacggaccccaaggccccccaggccaaacccgcgagacagggaaaaccccgacgtggaccaccacaaaccgcgagcagaaccgacccccc

SEQ ID NO: 64523 - DNA, 180 bp, Triticum aestivum
  Clone ID: PAT_TA_64523
gaaggagcgatgagcacgccggcgtggccgccgcgctggggcgctgctggcatggcggcggcgtcagcgccgtcaactacggtctgagcgtggacagggacagggtagcaaaactgaagtcctactgcacggtgggagcacggaggccagacccagcggcgcgcgctgcaacacggagcg

SEQ ID NO: 64524 - DNA, 274 bp, Triticum aestivum
  unsure (1)..(274): unsure at all n locations
  Clone ID: PAT_TA_64524
tggttcccacaaccaaccgggngcagaaaaggaaggtttagatcaaacgaacgtgccgttacctgcccctggaggcaagatagacgtatggtcatcaaaactgatcggcttaagaactgaccaggagacagggcttccggctatagctccaaacgaacggctcgtgctgccaggcctagatgaccaatgcggaacctagacgccatacaaagtccgatgaggtacaacgcgtggagaaggccaaccacgaggaggcccaactcaaggaggtcag

SEQ ID NO: 64525 - DNA, 439 bp, Triticum aestivum
  Clone ID: PAT_TA_64525
agctcgccttggggagggtgaattagaggactctttcgcttacaccgcggcccttgcgcaggtgcatggcatccccacctctgagataagtgtcgtctcgtacaaccagtgtcccggcgcagagccgatgcctacgcttgtgctatcgctcaatggcgatgactgcgcgctcgtgacgcaggcgctcggctcgctcaacgccgtcaatcagaccgctggcggtgtggttgtgggcgccacgaacaactcagtgacgcgcgccaagccctctaagaagagtggcatgccgacttggctaatcgtggggatcgtcctcgccgtcctgctgggcatcgccgcgatcgttgtgttggtggctgtgattgtgaaggccacatctggcggatcgaagccctccggcctggcgcacaggacgcactgggcgacggaggagctttac

SEQ ID NO: 64526 - DNA, 152 bp, Triticum aestivum
  Clone ID: PAT_TA_64526
tccacgcgtccggtacaattgtactgtactgtatatgtaagagagtgatgatgttggcttattctttgtcgcgagactatcaggtataattggctatgtatgaagaccacccatgggcatatcttctaggaacaaagacggacgagttcttc

SEQ ID NO: 64527 - DNA, 394 bp, Triticum aestivum
  Clone ID: PAT_TA_64527
gtgtcccctaactaccagctctctcggacaggggggccctctagagacggcgatcattggacaaacgccgccacacaaggccaggacctcgagagaaccagcgccaccgacgagtggcaaccagccgactgaaaaggggcgggccaggagggagaggcctagggctcgccccaatggcctgacgcagcaaaggaagcaggaaaaaaaggaagctgttgatctggaagacacagataactctggaaccattgatgcaaaagagcccacggttgccatgagagcccagggatctgagatgactgaagagcatattaggcaaaagaaggctgatggggaccaacatggcagtggagcgaacgactaccaggaggttgagcccacgacgactggccaa

SEQ ID NO: 64528 - DNA, 303 bp, Triticum aestivum
  Clone ID: PAT_TA_64528
ggttttggcttctcctccccttccggctcgggttctggttcggttcgggtccgagagtagctagcctagactagggtttccgaagatcggagaggagagaaagggagagatccatggcggagacggagtaccggtgcttcgtgggcggactcgtctgggccaccgacgaccacaacctccagcaggccttcagccagtacggagagatccttgacgccaagatcaatgaacgaccgtgagaccggcaggtcccgcggcttcggttttcgcacgttcggcagcgaggagtcggatgcgccaggc

SEQ ID NO: 64529 - DNA, 322 bp, Triticum aestivum
  Clone ID: PAT_TA_64529
ttcttttgtccgctgctttcaccgaagcctacagaggagccaggagaggggcggcccgaaaggatgtcgtagaagatgtgcgccaacaagcgcgccccggacccggtcatggcccacgagttcacactcgagttcaccatgcacctccataggtgcatctttgggtgcaccttaccgaatgccgtcccggatatcatgaaggttgtccagaaggtcgtgcagaccgacattgtaaccattgatgtgcagcttgacgtgcacatctacaagcacatcttgagcagtgtcctcaggagagtcccgagtaggattcgtctcaaga

SEQ ID NO: 64530 - DNA, 376 bp, Triticum aestivum
  Clone ID: PAT_TA_64530
gtcataatgtacatctttttttcttttaccttctttgctgatagctagtataccatagagcttcatcccttttttttccctttcttctttttatattagttgatgaaatgtgtcaaccattgtgcagtttgttcgttatatgtggatatgataatggaaattgcaagatttaaaccctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaggggggggccccttttaagggtccaagtttttctccggcggttgggaaaaaaaattttttttttttgggcccc

SEQ ID NO: 64531 - DNA, 245 bp, Triticum aestivum
  Clone ID: PAT_TA_64531
gaatctattaggtgtcgtcggacgatcggccagccgccttccacatctgctctggcatcgcatcttggactagctatagcttagcctgctgctactaatcgactttctgtcacatgtttatcgttgagcaattcgaaaaccataaaaaaaaaaaaaaaaaaaaaaaaaaaaaaaaaaaaaaaaaaagaaaaacaaaacagaaaaaaaaggctgaccgctatcaaaggaaccaacgctaacatact

SEQ ID NO: 64532 - DNA, 265 bp, Triticum aestivum
  Clone ID: PAT_TA_64532
ggtgcagatcgatcaatatattgatctgcacacgactatcggaccaggatcaccgcgggcttttgattggccccttttggggtttgggtggtatggtatgagaggggagagcacgtgtgcaagagcgccgtaattgtgtaattatgcaaggcaatcgatgtaaagtattactccaaagtgtgaaggaaatccgatcatgtgtattattcaaaaattttagaaagttgggaaataagcaaaaaggcccgaaaagaaaagaactttc

SEQ ID NO: 64533 - DNA, 392 bp, Triticum aestivum
  Clone ID: PAT_TA_64533
cccacgcgtccgaccgaccacgacggcgccgtcgtgcaccacgagcgcaagaggtccaccgagctgatcactcagcagtaaccccgagtaatctacgccgtacgttcgtacacatgtcgtgtgcttgtgttgagtgtggccggtccaaccgtcctggacgtgaatctctagattctggacacgttggtcagatttccaggctttaggacgtagggaccgacacccatggctctacggggagaaagatcacatgatattccgcacgcgtgatgaatccatgtagaaagggtcggttcaccggccgcttgcgctgcttgccgtggcgcgcactgcgcagcttgtgacagatcttttcaccgaggtgacagtgatactgtacgagtgtgtatggg

SEQ ID NO: 64534 - DNA, 472 bp, Triticum aestivum
  Clone ID: PAT_TA_64534
tcccacgcgtccgcccacgcgtccgcccacgcgtccggccagagagcttgtcgagccgtgccatgtcagggaacccagtggccggcgcgccgggtgccgtcgagccgtatgtgccgcaggcgacctacaacttcagcgcccgcctcgcgctcaccgtctctttggtcctcctgatgatcaccgtcgtcgtcgtcgtcatccctctcatggtttacctgatgatcactcgctcacgcagaagcggcggccacggcctcgccggcggcatcctccggtccgttggcatgatcggcagccggcggcacgggttggacgcgtccgctctctcggcgctgccggtcacccgcgtaccggaaggagagcggcgcagccgcgagggctgagtgcgctgtgtgcctggccgagctcgccgacggagaccaggctcgggagctgcccaactgcggccacctgttccacttggagtgcgtcg

SEQ ID NO: 64535 - DNA, 445 bp, Triticum aestivum
  Clone ID: PAT_TA_64535
tcgccggagtccctcccggacgccgcgccccaaccccaccgcttcaccgtcccggtcatcgacctgtccgccgcggtcaccacgcgagccgcggcggtcgcgcaggtgaaggaggccgcggagacggcgggcttcttccaggtggtgggccacggcgtgccggaggcggccacggcggcgatgctcgcggcggtgcgcggcttcttcgagcagcccgtggaggccaaggcgccgttctacacccgcgacctcggccggcgcgtccggtaccagagcaacctcaacctgttcaagtcgcgggcggccaactggcgcgacacgctcttcatggagctgccggcgccggaggagatcccggcggcgtgcaggagcgccgcgccggagtacgcgcggctggtgcagcaggggctgggccgcacgctgctggggctgctgtcggaggcgc

SEQ ID NO: 64536 - DNA, 381 bp, Triticum aestivum
  Clone ID: PAT_TA_64536
cccacgcgtccgggccgccctttttttttttttttttttttttttttttattcgaggcacatagcaggagggctttcgatgagggaggttcttcgtatgacaacataaggctattaattcaagaaatggaaatcaagacgaatgcatgtcgttcagtggttgatacagatggtaataagctctcttttttggtgtaaacataaagtaaaagagcctatagcgtatttatcattataaaggatttcttttacaaacaaccggtagcttgtatcaggatcactgtctattctgttgcgcagatttcaaaaaaaaaaaaaaaaaaaaaaaaaaaaaaattacaaacacgtgcaagcaaaaaaaaaaaacaaatatagagtcccc

SEQ ID NO: 64537 - DNA, 314 bp, Triticum aestivum
  Clone ID: PAT_TA_64537
taaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaagggaccaaagttaacgaccgcgtgattgcaacgaaaaagtttttttttggggcacctaaaataaaattaatgggccgcgttttaaaaacgtgggaattggaaaaaccttgggtttcccaaattaaatccttttgaaaaaaatccctttttgccaagttggctaaaaaacaaaa

SEQ ID NO: 64538 - DNA, 421 bp, Triticum aestivum
  unsure (1)..(421): unsure at all n locations
  Clone ID: PAT_TA_64538
tgtagctccatgctagagcgactgacatacaagcgcggcagtctgccgaagacgcgggctcgcgggctgctcggcccaccagaatgaggcaagcccaacagcagggtccacaggccagagtgggtgtagccggggagccaccccagcgactacttagtcgtccacacacgcaagagaaggggatccagtggatcaatgaacccggcgtcggcggctccctgttctttcttatccccaattcccctttctccaattcttgtatccccggcttgtaatcgatactagcatgcccgcgcggcagcacgccgcgtcccatcgatacattatgtgtatgtatgctatttttttcgtgtgatgaatttaggcctgagagttctatgagcataaatttttagtacaaaaaggcaaattgtgcccnnna

SEQ ID NO: 64539 - DNA, 364 bp, Triticum aestivum
  Clone ID: PAT_TA_64539
cttttccctcgtaaagagcttttagctacttgagagaggtaaactttaagcagccagagatagcaggatacgggtaagttatttatgagatggcggtgccggttggagttttgcccgcacactctgtaaagaaacacagttgcatcagggccttgtacgcatgagtgctgttgtttaaaaaaaaaaaaaaaaaaaaaaaaagaaaaaaaaaaaaaaaaaaaaaaaaaaaaaaaaaaaaaaaaaaaaaaaaaaaaaaaaaaaagggcgtggagactagaggcctaaggttgaaactggccgacagtatacaaacaaacttaaattataaggggccggcgtttcaaaagttaaactttttttcccc

SEQ ID NO: 64540 - DNA, 438 bp, Triticum aestivum
  Clone ID: PAT_TA_64540
tttatcgatatgttgggtttttgtagatagcttatcaatacattggaaaatgactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccttttaaaaaaaacaaagttaactaacccgtaaatgaaaataaaaaattttttaaaagggaaaccaaaattaaattaaatggccgtgttttaaaaacgtggtaattggaaaaaccttggggtaacaaaaataaatcgctttgaaaaaaatccccttttcgaaagttggggaaaaaaaaaaaaggcccgaaccaatcgcctttccaaaaaattgccaaccctaaatggaaaaaggaaccccccttaaaacggaaaataaaacgcgggg

SEQ ID NO: 64541 - DNA, 534 bp, Triticum aestivum
  unsure (1)..(534): unsure at all n locations
  Clone ID: PAT_TA_64541
tgttgtaacatctcgcatgtcagacacagaggaggagaatcctgaggagaacgatgaaggattgacagggcttgagggggagcttaaagggtggagggtaggggagacctttgaagggttcacagggacatcctcattgtcgacaacgaatgatgatgatgcatctagcacgaatacagaggctgtgttcgtcatctcgccgaatggcaagttcaagcggaacatcaagtcatggatgcgtggtgcacttctgggaagtggctcattcgggatggtgtatgaggggatcagtgatgaaggtgcgttctttgctgttaaggaagtatctttgcttgaccaaggaagcaatgcacagcaatctattctttcacttgaacaggaaatcgctctccttagtcagtttgaacatgaaaatatagtccagtattatggaactgacaaggaagaatcaaaactctacatttttattgagctntgtacacaaggttctctttcatccctctatcagaagtatanactgcgagactcacaagt

SEQ ID NO: 64542 - DNA, 405 bp, Triticum aestivum
  unsure (1)..(405): unsure at all n locations
  Clone ID: PAT_TA_64542
tcgcatagctggagcccaagcctaaacctgaaccgaaaccgaagccgcctccgaagtgcaaaccaccaaccactcacagttgatgggatactgatatatgccagttgctggaggagaccctgtatgaagccacaatgtgttatttctagaataagtggtgttgtattccctgtattcatttatagttccatgcacgtgtgatgggtattagtactttgtaattattattttcttgttggtatatgttaatctactttgtatgtgactcgactcgttgttttaagtatctatgcatgattgcatccatttatacgaatgagctattttgtccaaaanaaaaacaaaacattaaataaattgcaaaacatacacctttcaaaaaaatagataagttccgaacaattt

SEQ ID NO: 64543 - DNA, 442 bp, Triticum aestivum
  Clone ID: PAT_TA_64543
tcgcccacgcgtccgggtcaagaagatcctgcacaggatcgaaggggtgtaccaatccagcatagacccggagcaggggaaggtgacggtgtctggcatggtggatccggacaccatcatcaagaagctgaccaaggctggcaagccagccgaactctgggggtccaaggctggcatggctaaccagttccagaagctccaacttgacggtggtggcaagggccaggccaaggacgccggtggcaagggccagtccaaggacgccggcggtgccaagggccagaaaggtggtggcggcggcggtggcgccggaggtgctagcaaggacgcaaagatgatgatgccgccgccgacggcgcagcagcttcagcagctgcaacagcagatgcagatgaagggaatgaagctgccgcagttcatggacgggaagatgccgttcgca

SEQ ID NO: 64544 - DNA, 514 bp, Triticum aestivum
  Clone ID: PAT_TA_64544
tcgctcacgcgtccgcccacgcgtccggacaaagaggactttgatgatttctgttctcgggcctcggagttggcagagcaggcgaatggagcaccgctcttcactgtcgtgcagtcagttcagccgtcgaaacagatgtacaaccaggatgacgggtccggctgttcaggctacggcgtctccgacaacatcgacacggaggacctcgatggctccggcgaaacaggagaagacgagtggcagattctctgaatgaaagggaagtttaacttcagttgttcggttaaaccttcacatgacccctgtgtgaagtaaagacttcaaaaacctcgtgtgaaatctagggtttccagttctacggaacaagcgggtgtgctgcttgttccgcgtagctgggaggctggaaaaggtaggagccgttatgctgatcatcggatcggcaccaagttggttcgatgggaaattcctctgtaccataccgtacgcgctgttgtgggtgactgcaaaatgtatc

SEQ ID NO: 64545 - DNA, 420 bp, Triticum aestivum
  Clone ID: PAT_TA_64545
cggacgtgtgggtttttttttttttttgatggagagagaaaatgggaaattctgactgcgataaaccgagttatggttcttggctagcagtccctatattatgatctcaaaacattaggcgaagtgggtgagattacatgcccggtcgaatcccaagcaaagaatgtacaggagtcacagtacaatgctctggttcctgtgacctgaccgctagtgccacagcgccgcccggccgagcccagcccagccggcacaaaccgtagggcggggagacctttgcacttgcaggcacgcccggcgagaagaacgatcgaggagaagcgcctacaaggcggcgtcggcgacgcggtcggcgaaccgctggagcgcctcgcgcatccagaggtgcgggcagcggtccatggcgtcctgcacggtgac

SEQ ID NO: 64546 - DNA, 310 bp, Triticum aestivum
  unsure (1)..(310): unsure at all n locations
  Clone ID: PAT_TA_64546
gtttctgtnctttattgggaacgatggctgacgcatctgctcctgcccctgagggccatcgcgaggagggtggtcgcggcttcggccgtggccgtggccgtggaggccgcggtggccgccgtggccgtggtggccgcggtggcgcccccggcgacaagaaggagtgggtcccgtgcaccatgctgggccgccttgtccgcgacggcaagctgacctccctcgaggagatcttgctgttctccatgccgatcaatgagcacgacatcgtcgaccgcttgctgggcgagagcctgtaggacgaggtgatgca

SEQ ID NO: 64547 - DNA, 486 bp, Triticum aestivum
  unsure (1)..(486): unsure at all n locations
  Clone ID: PAT_TA_64547
gtcttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacatcaatgttactgactgccatatcccncttactggaccaaattcaattgttggccgtgcttgtgtcgtccacggtgaccctgatgatcttggcaggggtggacatgagcttagcaagagcactgga

SEQ ID NO: 64548 - DNA, 413 bp, Triticum aestivum
  Clone ID: PAT_TA_64548
cctacgcgtccgcccacgcgtccgcgcatactggtgaaaaggccgacacgatggagacctccttcctagcaaagacgctgaagaacctatatctggtgtcctgaagtacgacagtcgcatctttcaccagtggacgtttaacactgaagctcaccctttgagaatcgttccgacacatggatgtaactgccagtcaattgaaactggaaatccagtggctcgaccaggcggtaggaatcaaggtaaacatgagtaggcctgaacaacacaacagaggatttttgcattcgccgagagattgtgacctgccttgatgagaacgctatgatacgatgggaatttcttactgcagcggctaagactgcacataacggcactaggctaattacgcaacacaattgtaggttgagcat

SEQ ID NO: 64549 - DNA, 117 bp, Triticum aestivum
  unsure (1)..(117): unsure at all n locations
  Clone ID: PAT_TA_64549
gnatactcagacaccgccacgtacgacaatgcagggagtatttagaggcattgttggtgttggcccaccctgactagcgagtgctaccacaacagggcggatcatggccccctgggg

SEQ ID NO: 64550 - DNA, 527 bp, Triticum aestivum
  unsure (1)..(527): unsure at all n locations
  Clone ID: PAT_TA_64550
gcatcggcggcagacacggccacggccacggccagggcctcggcggcggtgctcaccgcgccgctgtcgctggaagggggcctcgcggcggagctccagccggcgaacctcgtgcagcgggtgctcagcctcttcgggaacgtcaggccgggggccgatctctcgcacttccagctgcctgctacgttcaacctgccaaaatcgcagctccagttgtacggggaaatagtctactgcgacggagatgactacctgagcagatgcggcaaaggcaaggacagcctcgagcgcttcacggcgatcgtcgcatggagcatctcgacgacgaggccgcccatcttcggtttcgcgccctacaacccggtcctcggagagacgcaccatgtctccagagggtcactccatgtccttcttgagcaggtgtctcataaacccccagtctcggcgcttcacgctaccgatgacggcgganacgtcgagcttgtctggagccaacacccagtgccgaaatttaatggtgctagcat

SEQ ID NO: 64551 - DNA, 282 bp, Triticum aestivum
  unsure (1)..(282): unsure at all n locations
  Clone ID: PAT_TA_64551
gacggcttaccttgattatatgcgtgatcctatacaacatgttgatctgtcatggcgcctttacaagcctattgactgtgtagaagccgtagtccatacaccaacataataaagctgtatgggccacattncgctttgttgcatgaacaactgataccgagaagtgcccctaacgatcaccattgaaaaactggcgctccctgaatgacaaatgaaacaggcccttgatgacaccatgactcaccttggcagtggccggttactctacaacgtgaccgactg

SEQ ID NO: 64552 - DNA, 498 bp, Triticum aestivum
  Clone ID: PAT_TA_64552
ccttcgcgtccgcccacgcgtccgcccacgcgtgcgcccacgcgtccgccgacgcagcacgcatcccccatagccagtgctcctcctagcttgcttgttccccggcggcagagaaaggcagacagaggatgtcgaagtacgtggagctgctggacatgggcgtgcgcatcgcggccaggttccactcccactgcccgcagacggcgcgcatgtactacaagccgccgcagtccacctccacgtcgggcgccgccgaggacgcgccgacggatcggaggaccgccggctttgacggcggcgaggacgtggctgctggcttccggcccttcgccgcctcgggagctctcggcgccggcgtccagccccggttcggcttcgacaccgcgcaggtcctcatctacgaggtcgtatgagtcgagggcttgaaatgaacaacggcgacgagttcttccggagaaagatgagatctcctggatgagatttttttttttttttttg

SEQ ID NO: 64553 - DNA, 386 bp, Triticum aestivum
  Clone ID: PAT_TA_64553
gatcttctgaattccaaactgaagctttcctcagttatgttgtatccagaattgacagtacatgggaatatgggactgttgtatttaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaagaaaaaaaaaaaaaaaaaaatggggggggccctttaaaaaaaaaaaaatttccttccccgtgaatgcaacttaaaagttttttaaaagggaacaaaaaaaaaaattaaggggggggcgtttaaaaacgggggaatggaaaaaaccttggtgtaaccaaataaaataccttggaaaaaaaacccctttttcccagttgggg

SEQ ID NO: 64554 - DNA, 290 bp, Triticum aestivum
  Clone ID: PAT_TA_64554
gttaggtcaatggcaggggaaaggaaatacgaggatgagaaaaagatcagagagaaggccaagaagatacgatcaacaggaaagtctccccgtggatgctgcttttgagacattgccattctacaaaatttgaaacaaaatgaatggtgcgacttgaatgcgatatgagtctcacaacagctatgtattgtattataaaacgtatttggtttgatgagtgataagagtgtacagttgcatccaacatgcaattgcattgtatcaggatcagcctcgaaggacaaaactag

SEQ ID NO: 64555 - DNA, 512 bp, Triticum aestivum
  Clone ID: PAT_TA_64555
gttcatcgtcttccagccgcttccttccccatgcgtccccggcgtcactcaccgtgcacacacacagaaagtagtgagctcgtcgatccgggagagatcaggatgagcgaccccaagtacgcctacccctaccccgcgcaaggttactaccagggagggccataccaggggccgccggtgatggcgccgccgcagtacgccgcgccgccgccgcgcccccagcccagcttcctcgaaggctgtttggccgcgctttgctgctgctgcctgatcgacgagtgctgctgcgacccctccatcatcttcgtcggctagatcacccaaggccaagccagggcatccggcctggcatgctgtcaactgtacaaagagatgccctcatcaaggatatttaccacgttgttgccacgctatataatatatcatgatctctctcctccatatatatgaacgtattcccttattattgttatctcactagtcactacggtgttgcctgcctttgtaactcg

SEQ ID NO: 64556 - DNA, 168 bp, Triticum aestivum
  Clone ID: PAT_TA_64556
tttgtatgttgtaaatacagagccatatgagcattagctaacttttgctgtgccgtgcgtattgtagttgtaaatcttaggaagggtgtctcaacttgtaacacttacactgtatcggtgcagacgtttgattttacgtatgatgtgtactcaaaacaacaatgacgt

SEQ ID NO: 64557 - DNA, 488 bp, Triticum aestivum
  Clone ID: PAT_TA_64557
ttgctcacgcgtgcgcccacgcgtacgcgggaggtggtcgcgggcgtcaagctgcggaggacgaagagcctggtcacgttgacgggcggcctccagggcagcatgcgccgcgccctccggataggccgcggcggcagcgacgggagcagtcgccacggcaggagcgtgccgttgggccagtccgggcggtggccatcgttcctgtcgcggaccttctcggcggcgtgggggtcgaggtcgacacggaaggccgagtaggacaggtcgagcaagggcgggaagccggacggcgccggcggtaagtcagtggattgcaaacaccaagtagtgcgccgctgggcaacgtgaatagtttgacccgggccgtggtcaaaccgggcatggttacgaaacggttgctgggaatgggaagaaaacgggcgatggttttcgtggtggcgaggaacttcttgttggcggggtgttttttttaggggacaaattttttt

SEQ ID NO: 64558 - DNA, 225 bp, Triticum aestivum
  Clone ID: PAT_TA_64558
ttgtaagacggccggggcgagctctccagcggttgctatggtggatacgagggtatgtgaggtcatatacaaggttgaagctattgtatagtgtgacctaggtccgctcaagtagtcggaggtcaacaagctagtgactgccacaaccgaggggttgcccatctaagagagctaggactagaagaatatttaggcagatcttatggagaagatagggccctaccg

SEQ ID NO: 64559 - DNA, 390 bp, Triticum aestivum
  Clone ID: PAT_TA_64559
tttttcaaaggccgctgcggagaagtcaatggcgatgggttgtttgctgtgcgaatacacggccgagacgctggtgtggatcaagggtgacacaagcgaacttcgcctcgccaaggaagcgctcgagacgatgtgctttgtgctgccgccccttgcgcgctgtgacgtgctctcgtccaagtttgacaaccttgaggaactcgtgagccaaggcaagagcccgagccaggcatgccacgcgatcagcctgtgtgacgcggcgtttgtggagaaacccgccccttcgaaccgcattgatgatctcgtcgaggagcagtaaacttcagatcgacgtgtcgctccatggatgaagtggtggcggccttcctagcttgcttttttccacgttaa

SEQ ID NO: 64560 - DNA, 350 bp, Triticum aestivum
  Clone ID: PAT_TA_64560
ctcggttgtggcgactggaatagaaactgaaattggaaatgtgggtggatggcggcgtcattggcgctcattagggtggtcactatcatcatcgcggagtcaatcttcaaattggaaatgttttccttcgtttcgttcttttttttatagagggaagatctggctttaaagaagaagaattcctgcacctgtccatgcaatacaaaaagggcgtcccgtggtagtgttgttgaaccgctaatagcaaaattcactccgttactgtaattagaacccaatgccttcagataagggctcagatagcttatgtttaagctttcacctggatatattttggtcattcatggacc

SEQ ID NO: 64561 - DNA, 409 bp, Triticum aestivum
  Clone ID: PAT_TA_64561
tttcctacgcgtccgcaaagacaagtcaacctcaccgaggagatggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgaaagaccgttaccgtacatggacgtcgtgtactcgctcaagcgctaatggcgcaccctttacggatggccaggctaggccgccaccagattagctagcctgtgtctagggt

SEQ ID NO: 64562 - DNA, 427 bp, Triticum aestivum
  Clone ID: PAT_TA_64562
ttgggtcaaactgcaggggagcgccgttgagggggagtgtgccgctgctgcgggacgacgaggggaggatgaagcgggagctggtcgcctgggccaaggccgtggcatccatggccatcagggaatcgatgcggtgctaaggagtacacgcgcagcgcgaggcgatggaggagtcatgggtcgatgcatttcttgtttgcttcgtgcacgcagctacacacccgcggcaccgagcgtggccggtggccgctggcctgcatttcgtttcctctgaatccctttttcacggagcgatcggtcatagtacatcgatcattcgggatgtaaatgtttctggaaaggatggaggactaatccataatacctaaatagttgaacccattacttttaaaaaaaaaaaagaacaaaacgatcgtccttaccaaca

SEQ ID NO: 64563 - DNA, 301 bp, Triticum aestivum
  Clone ID: PAT_TA_64563
tcgcctacgcgtccgggagggttgtgtatatatcttgtctgttctttgatatgtatggcagaccattatatatgtaacagattattctggagttatttatttcatattatatttaaaaaaaaaaaaaaaaaaaaaaaaaaaaaaaaaaaaaaaaaaaaaaaaaaaaaaaaaaaaaaaaaaaaaaaaaaggaactaacttaacaaggaaacaaaaatacacacgaaagaaagacaaactagtactctttgtggggggcccccttaagggaactaactggcacctcctttaaaatcgccactt

SEQ ID NO: 64564 - DNA, 219 bp, Triticum aestivum
  Clone ID: PAT_TA_64564
ctcggtttaatgcaattgcaaatcgtctacttagcaaggtctactttacatacaaaaaatgtatatgaaggagcaatatatgtgcaaaaggatagcagcagagcacttctttggctgttggaaaaatgggcaccaagcttaaggatttacacaattttctcaaacaagtaatcaatctatctatgtatctatcacaaaaaaaaaaaaaacaagagactg

SEQ ID NO: 64565 - DNA, 366 bp, Triticum aestivum
  Clone ID: PAT_TA_64565
gctacgcgtgcgcccacgcatgcatccacgcgctcggaatttgcgacctcgagtcctgtatgagcagcatggatgtatgcgaccgtggctcgttgttgtgcctgatagaagaaccggcccgactgaggttgtgtgcactgctaaaccaagagacccgagggaggatatgtgagctgccttgacgcttggcatacaagaggagaaaatgcaaggcctgcggaatggcatctcatggaaaaaaaaaaaaaaaaaaaaaaaaaaaaaaaaaacaaaaaacaaaaataaacacccactctaccaacggggggggcccttctaaaggacccaactcaccttccggggggggccactcccaaggttccaatt

SEQ ID NO: 64566 - DNA, 334 bp, Triticum aestivum
  Clone ID: PAT_TA_64566
tcgtctagatcgcgagcagccgcgcccaggtctagggttccccctttcttcttctccacgcgaatcagctagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacaacgacttcttactgcagccgtggaaagaagctggtgggcggtttcccccaaccgagctgcccctcttccccc

SEQ ID NO: 64567 - DNA, 489 bp, Triticum aestivum
  Clone ID: PAT_TA_64567
gtttcgcgtccgttcctcctgcccttcttccaggggtctccgaatatgaagttgaggatcgctctattcattctggcttcgttcaccgctcacggccacccaagcgccgaaccgggcactgccgcgtttggttcttacttcaccactgtcattcgtgttccccacggctgcactggctcatctaccacaaaggttgacgttaagataagcgaggacatatctcatgtcaaagcacacagagtacccggttggaagctggatgtcgtctatcgagacaacgacaacgccaccgctctaaagttgggcgaaaacagaaccgttgataccctgacctggacagcactaactgaagccgactatctccccgataacatgttcgaggacttcggcgtcaatatgaagcttccacagccttctgcaatgaaaatcgtttaccttccgaccactcaaacgtgtggaaacggaacgagcgcttgggtaggaattcct

SEQ ID NO: 64568 - DNA, 210 bp, Triticum aestivum
  Clone ID: PAT_TA_64568
gggccggtccggaatccccttttcgaccaacccactagacttcgtttcatcaagagaacccacgcctgagggcaggggtgatttgaaagcatagctggtgtaccacaccaaccaaagtgagttcacgggccgacaattgacaacgacatgaccgggaaaacccatcggctaccaaagtaaaaggccttgacgaaaagacaactgtttgcc

SEQ ID NO: 64569 - DNA, 268 bp, Triticum aestivum
  Clone ID: PAT_TA_64569
ttgttcacccccctcaccctctctaatatgcttccacacaaatttacaaagcatggcccttcgtacacattttatatctattacggactccatcaacaattataaaccgatttcccccactcccgtctgtactagtacatctttaccctatatctcaggctaacttctcaccaaacaatacctgtcactccctgcgacatatcctatagactaattctctatctctaggcctaaccacgttactgtacgcgttttatcaacattccta

SEQ ID NO: 64570 - DNA, 216 bp, Triticum aestivum
  Clone ID: PAT_TA_64570
tttcgatcggtctagatatgcatcaacattaatacggctaaataagtggaggagcacttgaaaggtcttattgttgttgtatgatttgaacgtgtgtctatctcattaatctatcgttgaacgatagtatgtatgtatactggacgtgtaaggagggcaaaagtgccttaagcgtcccatgatttaatattttaagttgtgagtttgttattgccc

SEQ ID NO: 64571 - DNA, 483 bp, Triticum aestivum
  Clone ID: PAT_TA_64571
ggctaagagcctcctcgcccgtagcatcaggcaaaaacgctcccctcgatctaggtcacgtcggcgccgccgccgccaatccgctcgtatgccgccgccgccatcccccatcgccactggtcggacgtggagttcgtgtgccatgacctccatggcacccatggccgacaagacgggaccctcggcctcggccatggccgcctgctcgggagatggggtcgccatgtttgacgccgccagcgcctcatggacctcagctccaggtccaccgccatcgaactcaggtggataagtggatggcacatgtgtatgttgctgttgagggattatattcgacattttatttttatcccaacactagattgaagtggtggttcacaaaggattcttagtggggcacaagtgtagattgatacaaaagcatgctgaatattttggtccttcaggttcattttcacgatcatttttttagtgcaaaatttt

SEQ ID NO: 64572 - DNA, 425 bp, Triticum aestivum
  Clone ID: PAT_TA_64572
tttatcatatttcatgatccggagaaatagtaatttcagttcttgaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaagggggcccccctcctaaagaacccaaactaaactccctttccaccccactccaaaaccttttaaaaggggccccaaaattaaattccccgcccctctttcaacccaaccagaacgggaaaaccccgggcttaccccacataaaaccccttaatcacaaccccccctctcacagttgcaaaaatattaaaaaggcccccacctcccccctttccaaacatatttaccccctaaaagccaaaagaaccccccccttcaaa

SEQ ID NO: 64573 - DNA, 387 bp, Triticum aestivum
  Clone ID: PAT_TA_64573
ttctccccacgtgccgcatacgccggcgccggcctggggcctggaggagtttccggccgctatggtggcccctgcagcggcggcgaaggccaagcaggggcacgtgcgggagtggtaccacagcgacagcgacagcgacgtgttcgccgtgccggagatcacgtcgccgccggccaagcgggcgcggccgtcgtcgttctggtgcctgtgagccagctagcgcggcggcaaaccacccacgccgtcgcagcaaccgggcgagctacgtacctgtggctcgatcgatccatcactagtgtaatctttgctcgttccccgcaaaaaaaataaataaataaaaaaatgctcgttgtagcttggtgtgaaaaaaaaaaaaatttaaatttc

SEQ ID NO: 64574 - DNA, 341 bp, Triticum aestivum
  Clone ID: PAT_TA_64574
ttcacgcgtccgcggatccgtaacttcgggaaaaggactggctcgtgttcgacgacatgggcgcctacaccaccgcctccggctccaacttcaacggcttctccacctcggacatcaagacctacttggcctactccagctgatatggaactagtcatgtggccacgtactacgtagcacacgccattcgatttgttttcgcagtacacaaaatgaagagctgtaattaagctcgtacaaaaaaaaaaaaaaaaaaaaaaaaaaaaaaaaaaaaaaaaaaaaaaaataaaaaaaaaaaaaaaaaaaaaataaaaaaaaaaaatcttttataaaacataaat

SEQ ID NO: 64575 - DNA, 274 bp, Triticum aestivum
  Clone ID: PAT_TA_64575
ttcacgcgtccgggcattcttggtcaggaagtgattaagtcaatatcttgtaaaggcgatccgatcaagaatttcttttacttcgacgacgctgatggtaaaggggccatggaggacatccccccaactcctgaagactgaatcacgtgatacgtactcccttcgttccaaaatagatgacctaactttattttagatcggtgggagtaactcttcattcgacatggctcgctgataacttgtcccaatcatttgaactgatcactgttagaac

SEQ ID NO: 64576 - DNA, 413 bp, Triticum aestivum
  Clone ID: PAT_TA_64576
tgttgaacggaggcaacctgcactgcttcacggcgctgaccccttgcgctgttctcgacgtcatgggacccccttacagcagcgctgctggcagggactgcgcgtactacagcgagacccccttctcaaacacagctggtgtggctgacgtgcggtactcctggctcaaggagattcccaataccttccggatgaagggcgtaacgatgccgcgggacttcgtcgtctaggaacctgcatgctgaagggcgctcccgccgtctagcttctttgtgtagataacagctgtaacctgcgaaaggcaggtagtcagtcagttgtcagtcggtccaacctagctctcaggctagcaaactcttttttttttacccttacccgttcgtcggggttgaaactatctcatgtcgcctgtc

SEQ ID NO: 64577 - DNA, 462 bp, Triticum aestivum
  Clone ID: PAT_TA_64577
ccctcgcgtccggcagcatacacttgatctctcttcctatatccaattaatcttagtcaagctaactgctagcttcgaagaaataggaatggcggctattgctgcaaagctgcaggtttttgtggcttgtgccttgctgctcctcgctgcggggtgccaggccagccctttctggccactggagatcggctactaccacgacaagtgcccccaagcggaggccgtcgtcaagggcgtcatggagaaggccatctcccagaaccccggcaatggcgctgccatgatccgcatgctcttccatgactgtttcgtcgagggctgtgatgcttccgtcctcctggacccgactccgttcagcccgacgccggagaaactcagcccgccgaacgacccttccctgcgcggcttcgagctgattgacgccatcaaggacgccctcgaggcgggctgcccggccgtcgt

SEQ ID NO: 64578 - DNA, 508 bp, Triticum aestivum
  Clone ID: PAT_TA_64578
gttgtggtgacccttccggctttgcccaccccggcagtcacggtggacggggacgtgctccggctcccctcccaccgccgcccctgccacctccaccgtcacctctggtgggcgcgccaccacggcctctcacaccaccgcggcgcgttctccggtccgggcgaggcgcgtgtccatcccgccgtcgacgtcgtactcaccgagcttgcccgcggagaagagcaagagcccagggaagctgagctggaggcggtcgcggagcctgaccccgactcacgcccggacaccgacgccgcagagaagctgtttcatggcgaggaggaggaagaggcggcgaatgcgtggaaggtgaagatgctaggaggttccgccacggcatccgattgcaccaccgccaccatcttcgccaccaccaggagcaggacggggaggaacacgactaccgccagcaggacaaggttgattgcgcgagcatgagcctgttcggacgctttcaccaccgccacca

SEQ ID NO: 64579 - DNA, 173 bp, Triticum aestivum
  Clone ID: PAT_TA_64579
gatctgcgcagcaggggaactcagggttaaggatcaattacttagataaagtagtagctcacatctctaactacttttcagtgaatattggcgacctggtatttaccggtacgacaaaaagagaacaagaaaacacggtaaaaaaagaaaagtgacaatatattacacacacc

SEQ ID NO: 64580 - DNA, 283 bp, Triticum aestivum
  Clone ID: PAT_TA_64580
tacacctaaagaatccgtagctagcttgtctataggccttaagcgtgctggttcacgttgcggccaagtgaagtccttttctttttcttgtgttgtgttatgagtcatgtgggaggttattgtcgcgtagttgaataaaaagaaagagtcggaaaagagatacatatagggttaatacgtcgcaaaccattatctcttcggtgaattgagcatagcacagttttttaaaaaaaaaaaaaaataaataataaactaaaaatataaaaaaatattaaacaataag

SEQ ID NO: 64581 - DNA, 361 bp, Triticum aestivum
  Clone ID: PAT_TA_64581
tccacgcgtgcgcaaagacaagtcaacctgaccgtttttaaggaaggagaagggataagatgccgcgcccctgcaagggaggcacgggactcggtaagggcggcaccaagctccaccggaaggtgctccgtgacaacatccagggcatcaccaagccggctatccgtcgtctggcgctgcgtggcggaccgaatcgcatctggggtctcatctacgaggagacccgcagagctctcactatctttctcaagaacgacatacgagactgcgtaacctacacctagcacgcgcgccgcaagaccgttcacaacatggacgtttggtacgccctcaagcgccagggactcaccctctacggatt

SEQ ID NO: 64582 - DNA, 266 bp, Triticum aestivum
  Clone ID: PAT_TA_64582
aggcaccaacatcccctggccgacccacccaaacggatcgtccacccctaccccgcccgaagggggatttttaaacctatcggcccaaaccaactcaccgcagatatctgcccgctccccctccggaacaccagcccctctgcacaggacctgacatccatgaggactcagccggaggtgaaacggacaacgagaacagggaactgaggcagacccaagccaagggcaaggacctcaccgagccctaggatgctggtacggagaag

SEQ ID NO: 64583 - DNA, 311 bp, Triticum aestivum
  Clone ID: PAT_TA_64583
taataccaaaaaaaacaaaaaaagagaaaagggggattattaaaagaaacgctggggtacaaacaaaaaacaaaaaaaaagaaaaaaagcgggcagccggctataatggccctcctgtgcgcccgggtccctgctgacggcgtgcctgtcgtctgaggccccttgtttgcccgcccgcgctctgtgtgtacacctgtgtgccggggaaaccccttgcctggcccaagaaaagctggttccctacttgtcgcctttctgcaggtggctcttgggcacgcgggccctacggttgccctttcccacctgttgcc

SEQ ID NO: 64584 - DNA, 312 bp, Triticum aestivum
  Clone ID: PAT_TA_64584
gatactcggcctctgtcgcacggcttagctgctcgttttcgtcctggagatcgtcggtccctttttgtacagctagagaagcaaaacaacccagccagccatagctcgtagtggtggtgtgttgtggggagagcgactcgcctgacctgacctgttgcgcctggtggtgtgctctgaagttgtaacgacaccaccgcccgaaatcatatggcaaagttgttgccttgctagttggcattcatcccccagattaccggccctttatgccctgcaaaatggttctccttagttttttcctgggttgtatcttgt

SEQ ID NO: 64585 - DNA, 498 bp, Triticum aestivum
  Clone ID: PAT_TA_64585
tggacgcgtgggtttctttcttgcttctgcctttccccctcctcctcattgactccgccgccgtctcactcgcaagtcacagcatcccccgtctgctatctcttgggagagttgggagcggaggagcgacgcaggccgacgcagcggcgcaggcgagcaaaggccgcgaggcagcaaggcgccctccggctgaagagcagcgattcagacagcgacatcgtgcctcttgtcgactatctcaacacccagtactatggggtcatcggcctcggcacgccgccgcagaatttcacggtgatattcgacaccgggagctccaacctgtgggttccctcgtcgaaatgctatttctcgatagcatgctacctccaccccaaatacaagtcgagcaagtcaagcacttacaaagcagatggtgagatttgcaaaatcacatatggctctggcgcaatctctggatttttcagcaatgataatgtgttggctggggaccttgtt

SEQ ID NO: 64586 - DNA, 434 bp, Triticum aestivum
  Clone ID: PAT_TA_64586
tttgtttgtaacctttctcccttggttttggaggtgcacgcaccaactcgatgcagggggacgccatggagcaagtcgagttcgtggaacaagtcatggacgatgccatggaagatcatgattcagagagtactacgacgacatcccgcaatctaggattcgaagatagcagtcgtgcgagataggagttatcctggtcagctgttcttgtgggaatggagtcccatcaacgttggagatccacgagtcactttcatcatccaccactagagatacttgttatattcatttgacctttgtggtcttgtactcaatttcttgtaatttgacccataggccgtgcgcccgtggctgacacttgagttgtcccattcgcaagtgtgcgatggaagactccgctagcttataaaggaagccttgcccaacttagcaaa

SEQ ID NO: 64587 - DNA, 250 bp, Triticum aestivum
  Clone ID: PAT_TA_64587
gtttttcatggagcccaacaaggtgtacaagggggactactacaagcactctggcctgtactacaagatgactgacacgaagcatgcagctgctcagacagatactactaaggagatgactacagccatgtcaacaacgaagaacaagactgatagcatgacccacaagactaccatgagcactgagatgcgcaagatggccaaggcgatcaccaacgatgtcaagaacaactactgcaggacctactag

SEQ ID NO: 64588 - DNA, 489 bp, Triticum aestivum
  Clone ID: PAT_TA_64588
tgtggatgggaattgccagcttcgagctggggcagatttgatattccgcagggctgattaccacagacatgtgaggaaggcagtagcgaagcagctaaaggaattcaggaaacactatgaaggctatgtaccattggactacaaggtttacttgaagaaaatgaaaagatctggggaatggggagatcatgtgaccttacaagcggctgcagaccggtttggtgccaaaatctgcttgctgacatcgtttagagacacatgcctgatcgagatagtccccagggatgccgctcctacaagagctaaatacttggtgctcatcgaaccccgtcaccttctgcagagctttggctaagtttctggtgtgaagtacactacaattccttgtatgccaatgaagatcttccgactcgcaagaccaaaaagaagcactggctgttctaggtagggttcgccggtcgttggattcaccactcccccctgattctt

SEQ ID NO: 64589 - DNA, 378 bp, Triticum aestivum
  Clone ID: PAT_TA_64589
ataaattataaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaggggggggccgttttaggggacccaagtttactacccggggcaggcaacgaaaaagcttttttttggggcccccaaaatcaaattaacgggccgggttttaaaaacgtgggaccgggaaaacccctggggtacccaaactaaatcgcttggaaaaaaacccccttttcgccggtgggggaaaaacaaaaagggccccaaccaatcgcctttccaaaaagttgccaaccttaaagggcaaagggaaccccccttgtagggggacataaaccgcggg

SEQ ID NO: 64590 - DNA, 331 bp, Triticum aestivum
  Clone ID: PAT_TA_64590
cccggcccgtaccggtactgcctgtccggcccacccgacccgttcctttggtcacgcttaccatcgctacttatgttggaccgggcttgtaacttgcttgagagtagtattttctggtctactgggcaacctactgtcaattacccttgctatgtttcgttctcaggatgcacacgttgtcactggttaacatgatgccactctcaaggactgggacctcggagctgggaaaactatgggtactgttacacaccataagagagatgatcgggcgcatggaactgtatccaatacagaagaggtttgaataagcatctgctgacaacataaa

SEQ ID NO: 64591 - DNA, 463 bp, Triticum aestivum
  Clone ID: PAT_TA_64591
tgttcgttcgcacgtcctacacaaccagtgcagccgtatataaaaggccgcagggacttcgacctctatccaagcccagctgtgtgacccgaacctcggatacttggtaagaacttgtgaagcagacacaatgtacagctagaacaagagcgagtacaacccgagggcatcgtgagtgacggaagcacattgtgacagtcacactagcgtgtatcagatcctgcaataagcgaacaccaggaacgattacatgtatggataagctggagagttccaccacactaaaacattgaaaaccccatgggcctggcggccctgagcttaacgtgctgacgttctttcagagcttgcgacctgattgttgaactaaggcatgtaagccaatgaaagaccctaagttatagataagaaggacgggcagatcgcgagcttttaaaaaaaaaaaaaacgggcggcccattct

SEQ ID NO: 64592 - DNA, 361 bp, Triticum aestivum
  Clone ID: PAT_TA_64592
tttattttccacccgtctccacccagataaccacgtgagatattttgtccgccccgactaccgacgaacggtagagaaaaggtaagcatgaacgtcgggaattggccgagatgcacagatctgtggtggccatggcgtggttacagtaccgatcgatatgatgatcggaagctgattggtttgctcctgcgtgtagtgaggtgatcatgagcaccatggctatgtcggtgctgaacccggacgcgcccatgttcatcccggcggttttcaaaaaggaggaggactacttgcctttgtggtgtgagttggtcaagaccactctattgggtaccgtgtccactggtttttgacagaaccagct

SEQ ID NO: 64593 - DNA, 114 bp, Triticum aestivum
  Clone ID: PAT_TA_64593
gacgcgccttgtaacgggggattaagcgcgggggctgtgggggttacgcgaaccgtgaccgcgacactagccagtggctaaacacccgatcctttcggtataataccttccttt

SEQ ID NO: 64594 - DNA, 227 bp, Triticum aestivum
  Clone ID: PAT_TA_64594
gggccgaacgtcttgtcgacccacgcaaacggtttttttaacggggagcgcccgttcgagtgcatcatcattgacgccgaacccatgtagctcgtgcgtgagagtgagaacatacatgcataccaacgggcatgatcatgggcttcgtggccagagttttatgcggaggcagacgttgacgaaagaagaacaagtaagcccacactttccttctactatgtagaaca

SEQ ID NO: 64595 - DNA, 464 bp, Triticum aestivum
  Clone ID: PAT_TA_64595
gtttgttattgcgtgcccacgtgaagcactggggaggattttttaagagctcaaccgagttatgatacgcctaaatacatgctgactcaccatcgtgcacactatagtctgttgaaagcaccactctttataatttcctgaggtaaactatcactaataagttcatcgatgtgtttgaaatactgtaaagagatttcttcccgctgtcaccagaaaatattggcttttaatgtccatcgatttacataaacctggaaaaggagaaacagaccaaaagagtaaatttgggaatggtttaccgcgcacactataatctgactaaagcaacacaaatttttccgagaaaccttttctaatcaattcatcaacatcaatgcggttgaaataccatgaaatcttcccttttactggaattcaggtaacattgaatctgaatatacaatctatatacataattttgaaaa

SEQ ID NO: 64596 - DNA, 427 bp, Triticum aestivum
  unsure (1)..(427): unsure at all n locations
  Clone ID: PAT_TA_64596
cggcccggaacggcccgggccgacccacgcgacccgttcacttcgntcggctagcattcgagatctctcctctctagtcataccccgctctgtctctgtctctaggtatcgctgtctggacggccgcgcggcgctgcgaaaggagacaacgatggaagaggacgagtggtctggccgagcctgcgccaagcaagcgcgcgctccaggcgggacagtggtgggcagtagagccggatgggcgggccgaaccggcaggctctacccagggcccaactgcgcgctgaccgagaaccgacagagggagtgggaacgaaaagacaggaggaccgtggacatggaagtcgaaacccgcgaaggagtgtgccacaacatagctgcccgatcaactagccccgaaaacggacggcgctgatgcgcgcgacccaca

SEQ ID NO: 64597 - DNA, 195 bp, Triticum aestivum
  Clone ID: PAT_TA_64597
tcgcttacgggtgcgatcacgcgtcagcgcgagggggtcattatacaaccagccgttcaaggggctagaccacgagaagttgaaggagatggaacatgactattaggtgatgtgtgaccatgataggcgtgagacctataatcagtgtatggaagaagctctgaaggagggaatggttggaggaggaggtggatg

SEQ ID NO: 64598 - DNA, 203 bp, Triticum aestivum
  Clone ID: PAT_TA_64598
aggagagaggcatacccccttgttcagtcggaaggcgtcatgagccgattggggcagccgccggattttgaggagtacatggtcacgaagcttcaaattatgttgcatgcgaaccgtgttgacattgacacgctccgtggatttgatccagccatgaacctggcggtggataacactgtggaggtcaatggagactaaaagac

SEQ ID NO: 64599 - DNA, 498 bp, Triticum aestivum
  Clone ID: PAT_TA_64599
ttttgaaattgcccgagcagccgccatggccatcgccgtcgacgcggacactggcctccccgcggatggagctcatgtccaggaggacctccggcgtcgtctccttcgccacgtgcaccggttcgatctaggaccgctcaaagcctcgccatcgagctcttctccgccgcggacgtcacaaccttgccgtcgtctgctgctcctggccctcaccgagcctttcttgagctccccgatgccaccgccgacggatgctactacgtggataccgctgacgacgaggagtagttaggaggtcccaggcaggaggtcttgcctcttcaatcgttgttgcttttgtgtttgccttctaaaagcagtcttgtttaagttatgtctgtgctcagatattgttgcttccgctgatgcttgtgtatcgagcttgtattcgagccctagaggcctctggcttgtgatataaagcttggattattttgaaaaaaaaaaaaaaagggcggc

SEQ ID NO: 64600 - DNA, 491 bp, Triticum aestivum
  Clone ID: PAT_TA_64600
tcggtgcggcccagcaggacggaggaggaggatgaacggcggcagtggcaagaagaagttctgcggcgggcggctgccgacggggaccccctacctggcgtggacgcagggggcggtggtcgcctccctcctcgccggcgcctccatcgaccacaacatatacaagcccgacatgaccctcccgccggtggaggccgcccacggcaacggagccggagccacagacggaggcacgcgcacggagagctgagctaaatgtgacggctggcgggcgcccgagctctgctcgatgcccatgaggatggatttactacagtgtcattagtccttactttctttttacctctcaaggcagcatgcaagcgcggcgccattctacgtgctagctcggtcccaacatatgcggagatcttcgtccgttctgctgggtgttcaaacctggacaaagacaacagctggagccgtatcttcagtactactctgcctaaact

SEQ ID NO: 64601 - DNA, 397 bp, Triticum aestivum
  Clone ID: PAT_TA_64601
ttttttcacgtttacgcgcgcgcccacgcgtccggccacgcgtacgcttaagcgctcgtgacactgaacaaggcacgagcaacgacgactcggtgggctctaagcggtggcgatccgatgggctcccaacgcttaatgggcggctgatcaaccagggggcacgcggcgagatcgtcatcatagcctgcggcgcggtggtcctcagcaccaggtgaaggaaggaagaagaggacttgattcattaagttgtcgtcgatgagattttcctcttgtttgctagtaatgcacggaaaagcttttctttgtttgagcaatgaaaacatagattaaggagtgaaaggtatgcaaagacaaacatgattctattgttactctgtcacacacccccaagtgtctt

SEQ ID NO: 64602 - DNA, 330 bp, Triticum aestivum
  Clone ID: PAT_TA_64602
tttacgcgttcgcacacttccactctcgcagcagctagcctcgccctcgcaagatgtggagcggtgtgggctcgcgccttctgccacaggcggtggccatcgccatcgccgtggccgtcgcctgctgcatggccgcctcgccgtcgtcggcgcaggggacgacgacgcccgcggatgccaccggcgcgcttccgtcttgctcttctaagctcgtgacgtgcgcggtctacctgaacaccaccgacacgccgccggagttgtgctgctacccgctcaaggactcctcttccacccacgctggcgttgcttgcccgccatcctcatgaacaa

SEQ ID NO: 64603 - DNA, 193 bp, Triticum aestivum
  Clone ID: PAT_TA_64603
ctgacgcgtgggcggacgcgtgggggaaaggcgaacacaactacctgcctccttcgggcaacaccgttggtccctgccacctccgtcgtctgctccggcgactagcgggtggggaccctgggggttcggctccgactgttgatagagctacaacttaatgttctccatacaatttgctatgtgcactctatga

SEQ ID NO: 64604 - DNA, 446 bp, Triticum aestivum
  Clone ID: PAT_TA_64604
tttgctccggtcaaaaaaaaaaagagagaaatacaagtaaaaaaacgcaaaaacgaaaaaaaaaacaaaaactccaaaagcacaaaaacgcaccaactggcacaactcaaggccacacaaaaaccaaagaaaggggggggggggcttaaggggccccaggtttactgcccgggcccggcagcgccatggtttttctttggggcccccgaagtccaaccgacgggcccgccttttccaccggcgggccgggaaaaacccgggggtccccccctttaaggccctgggggcaaatccccctttcgcgggtgggggtacaaccaaaagggcccgcactgctggccctttccaaaagggggccacccggaagggaaacggggccccccccttggccgggcccatcacgcggggggggggggggggtctcccgaagggggcccggtcctttt

SEQ ID NO: 64605 - DNA, 204 bp, Triticum aestivum
  Clone ID: PAT_TA_64605
tttgcctatcccgtcgccatgccctactgttatcgtatggtctgaggcgacgtttcatggttttgtctttgttgagcaaaattaggaggctaggatgaccttgtaaagtaaaccctgtatatatggcatcccatggcttattacaggttggctcaaaaaaaaaaaaaaaaaaaaaaaaaaataaaaaaacataaaaaataacaa

SEQ ID NO: 64606 - DNA, 184 bp, Triticum aestivum
  Clone ID: PAT_TA_64606
ttttacctttttcttttactatgccagccgattgtggcttttgggccttgttttattttgcttgctctgtgtgagccagtatcctttgttgcagtactttgcaagacattgttgaactagtttatttatttataaatgtggccatatgcatcttgtctgatgcagaggccggggaagtctccct

SEQ ID NO: 64607 - DNA, 173 bp, Triticum aestivum
  Clone ID: PAT_TA_64607
tttgcccgtttctccaccgccggcgtccggcgactgccgctagccggcctaccggtgatgggtcgcgcatccacttgatggatccgtcggcggcagagcctgcgccaccacgggccgccccgggcaggggggcggacccagcggagcggcgcaggcggcggagcgggaccaca

SEQ ID NO: 64608 - DNA, 311 bp, Triticum aestivum
  Clone ID: PAT_TA_64608
tttttccgtttacaccctatctcgcagcggagaaaattatatcgaagaaggcctaggcagcaacacgcggtctgaaggattggattatgcatggcgactggtcggagagatccatcaggtgtgattctgtgtgcatgtaattacgggtgttgtggcatcgtgttgccgaggtgcgcagtgatactctttccagttttgtcgtgttcaataagtgaaatctttcggattgctggctagtttcagtattcccaggatattgaaggatgtgcagtcgtaagaggccaaggcctaaaatagaaactggacgaaga

SEQ ID NO: 64609 - DNA, 200 bp, Triticum aestivum
  Clone ID: PAT_TA_64609
tcccgatgtccactgctaccaagacctccggggcgaggttaaattttaaatacggttgcgaccgccgacacccgcgctgcatatcccgcaacgagagagagggctcaagtctggaccggcaggggctatggccacgttaacaccacatcacgagaccatcttactgaacagccccgcaagctgagcgggcgacgaccacc

SEQ ID NO: 64610 - DNA, 502 bp, Triticum aestivum
  Clone ID: PAT_TA_64610
atctttttgatttttctcggccttgtgctggataccgcgcgcctcagcaaattcccgctgccgctgtcggccaccgcgcaccagatgttcatgagcgcgtcgagcgccggccacggcggcgaggacgattccgccgtcatcaagactttccccggcatcacgctgccgtccgcccgctgattcgaacgacgtacctgccatgaccgcttccgcttcccgtcccctgctcggctgcatcggcgacgatttcaccggcgcgaccgatctcgcgaacatgctcgtcaagagcggcatgcgcaccgtgcagacgatcggcgtgcccgccggcgacgccgcagtcgataccctgatcgacgccgacgcgatcgttgccgcgctgaagtcgtgcacgatccccgaggacgacgccgtcgagcaatcgtttgccgcatacgaatgggctgcacgcgcaagggttgccggaggtcttcttcaaggactgctcgacattggactccaccga

SEQ ID NO: 64611 - DNA, 470 bp, Triticum aestivum
  Clone ID: PAT_TA_64611
cttacgcttttgcccacgcgtccggccagctctaagaccagtagggagagcatgcctaagtaagcgccgagcaaaagttttgacccttggagccatgaatttgtgcttccagacctgctgcataatacctttggttgattgatttacctgcctcggttgatttgcctgcacagcatgaatttgttctgaacacaacttgcaagtgctctttgaattgcatttaccaggagtgagcttccagcaaaggatatccctgcaatcatcaagtactacaggagtagcaataatagccgaagcggtaggttcctgaaaaaggttagtggcagaattataagtatgtatccagtttactggcaattacctacagaaaacctttcatctcaaaactactagatgtactactatgataagcaaagtgcagcagcgagcaggattcacaataaaaaaaaaagaaacataataatgaattt

SEQ ID NO: 64612 - DNA, 452 bp, Triticum aestivum
  Clone ID: PAT_TA_64612
cttacgctttcgctctctccctctacttctcgtgccagcttcagaaaatagatacgccgacgaggaggagagagcgaaagaaactgtagtttgtttgcacttgagcagcggcgccggcgatcgacatggcggctcacaagcggctccacgacggcttcgagcaggaccccgaccagcccgagaagaagcggatggagcgctcggtctccttctccacgtgagcttccttccagcccgccgcctcttggttcgtcgtgtgtcctgttcatccatggaggtctttgctgattccatggcgtgcgtgcgtttggggttccagggtgatccgggaggccatggtgatgaagcaggtgcagagtgtgttcctggtgctggagcctctcctgcgccgagtggtgcaggaggagatccaggcggagctggtgcgcatcccgcggtacatcgagaggtcc

SEQ ID NO: 64613 - DNA, 497 bp, Triticum aestivum
  Clone ID: PAT_TA_64613
tttaaattctccgatgcggccctgtttcgatgtttcagagcctctgccacaggtggtgtgggcgactatccccctcagaagtggccgataaagtgaagcacttcttcaagtactatgccataaaccggcacaagatgacggtcttgacaccatcctatcacgctgagagctattcaccagaggataacaggttcgatctccggcagttcctatacaactcgacatggccgtaccagtttcgcaagattgatcaacttgtacaagatatcgacaaagatggcaaatgggtggaagatcgtcgcgcagactcgcagctgagacaacgcggagccgctaggcctgcccagggaggtggaatgggagtcgcggccgcgggatctgccaatcccggtgctgggctgtaagaaatagggcatgccgacggctggatgaagtaggtcacgcatggactttagtggcgcatgctggatacattgggaaaccagcctagtacatag

SEQ ID NO: 64614 - DNA, 103 bp, Triticum aestivum
  Clone ID: PAT_TA_64614
gcctttgcccgataccctgaattctggctgccacccggagcggagccagagtgatgagaattaccagtgccgctgatggctgaccctgaccaggacgagttcg

SEQ ID NO: 64615 - DNA, 388 bp, Triticum aestivum
  Clone ID: PAT_TA_64615
taaagcccagacccacgggggcccgaattccgaattcgaccgacgccccaggcttccggttccaaaaaggagaccaccctgagggaccctgaaaaattgacaagggaatgagtgaacaggacaaatgaagactacaaagaggaagatgcatcctgagtacctaagggcagatctcgaccagacaatacaaaactacacataaggctttgacatgaatcagatgaggaaaagagaaaccccagaagagaaaaccaccaatgcgttcctgggatataggcctgaagatactaattctgcactagacctgacttacaattatggcgttgacaagtatgacattggagcgggcttcggacattttgccatcgcaaatgatgatgtggacaaa

SEQ ID NO: 64616 - DNA, 226 bp, Triticum aestivum
  Clone ID: PAT_TA_64616
gtggtgctgtgaccgctgacgagttggggtccgatcaactggagctaccatggccctgtcaggtccatcggctagcgcccaggagcgcatctcacacgaggcgccgaaggtcctctcgcgagtgaggggaccacactcctactacagcctgcggtgcgaaagaggagctggcgctccatgcggctacactggaagaggacgttggtgactcaaggcctaagcttgg

SEQ ID NO: 64617 - DNA, 433 bp, Triticum aestivum
  Clone ID: PAT_TA_64617
tcccggtcgcagtgaaataatttctttaaactacactgttatgttaaaaaaaaaaaaaagatagataaacaaaaaaaaaaaagagaaaaagtacaatcatatggcattctcctgggccgttcatgtaatttgttaataaaaaaaaaaaaacaagggggggggccgttttgggggtcccaggtttccgtccgggggctggcgaggtcttggtttttttttgggggcccctaatttcatttcctgggccgcgtttttccaccgttgggccggggaaaccctgggggttccccacttttttggcttgggggcccttccccttttggccggttgggttatttgcgaaggggcccgcccggttggcctttcccaccagttgcccaccctgatggggaatggggcccccccttgttggggccctttagggggggggggg

SEQ ID NO: 64618 - DNA, 357 bp, Triticum aestivum
  Clone ID: PAT_TA_64618
acccagggcgtgagactcaccaggatgaagcaaagtaccagtgcttgtgctcactaacccctatgagaccggggccgctcaacgggtgctatcatggatggtcagggcgctggcctctttgatgctgagcgcctgaccaacgacaactgcttggcgcctgtcaatggctgagtgaggcacccggtcccctatgggaggctgaagctgcgaaagaagacctggcactaccagagcaccaagggaagcaggagggcgctgacacggagggctaagctacagactggccaagggaaaacaacagtcgccagtgaacaaaaccgtcgcggttcgcacctgaatttgatgggatcaaatgct

SEQ ID NO: 64619 - DNA, 351 bp, Triticum aestivum
  Clone ID: PAT_TA_64619
ccacgcgtgcggacaaaatgggaagatgctgctttgaacaggaccagggcaggagacaattaccagatggaaaatgactgggcctgtctgactatcaagcaatgatgtacaggtctataccctaaagtccttttatgatttatgtatgcagcgaatcttcacgtgatgagctactatattggatgtggggagacgattttggaacctgaagtgataataggctcatagaccagacaagagggtcagcgttgagtaattataccatgagactggattatgcgaggatacctagggtgagacatcttctggggccagaccgcgaggctgtgggacttggatgatgcatgtttc

SEQ ID NO: 64620 - DNA, 452 bp, Triticum aestivum
  Clone ID: PAT_TA_64620
tttccgctttcgcgtccgcttttttggatgaggaacgctcactcactcgctcaaagcagaaatcaggcagcctgtatacactgaaatttgaaatgcttgtgtttggtgttttttcaaaaaagtgacgtaattgtttgcttacaaccatgcgtatcatcatcactgtcaatcaataccaacaaaatgtgagcgacgggcgtaggtcaagcgttcgtttccatgtatgccgccttattcttattcggtttgacaaagaagacggagcagaaaaagcttcttcgccaggcgtggaaatggtcctcacgcctcggcctccatcttctcgcactcttctctgatggactggaacagcaccgacgacaggtacctttcgccgaagctcgggaacaccaccactatcagctttcccgcgttctcgggtctctgggcgacctttatggcagcggccgctc

SEQ ID NO: 64621 - DNA, 383 bp, Triticum aestivum
  Clone ID: PAT_TA_64621
ccctacctctcgactatcacctcacgatcatgggcagttcacgggtggaaggcctcatccccttcatctacaaggccatcaaggagcaccgccggagcagcagccgggccgcctaccggggcgcggaggcggaggacgacgtggacctcggcgacacggaccagaggcggcgctggctggagcaggagctgcggtcaccgctcaacgccgccgccgccccggcgtcgacacaggcgcacgggcggaaccggtcgctggaggagctggccggccaggtggggctctcgccgggccggcggctgccgctgcccaaggccaggagcgttcgcgccttcgcctgcatcggcgccggcgccgcgtgaccgccgaacacgtacgtgctt

SEQ ID NO: 64622 - DNA, 466 bp, Triticum aestivum
  unsure (1)..(466): unsure at all n locations
  Clone ID: PAT_TA_64622
acttagagctcaaccaagatagcgagccaagatctgcagagccacaggcgaccacacaccggcgaccatggccgtggacctcatgggctgctacacccctcgccgtgccgacgaccagctcgccatccaggaggccgccaccgccggcctccgcagcctggagctcctggtctcctccctctccggcgcggcgccgtccaaggcgccccagcagcacccgcagcagccgttcggcgagatcgccgaccaggccgtctccaagttccgcaaggtgatctccatcctcgaccgcaccggtcacgcccgcttccgccgcggccccgtccagtcggcgccgtcgccgccgacttctccagcaccggtcgctccacctnctcccccacctttgaccgttgtgggccggtggtggtggccgacccgctcccgcagccgcagagcctgacgctggacttcaccaagccgaacc

SEQ ID NO: 64623 - DNA, 191 bp, Triticum aestivum
  Clone ID: PAT_TA_64623
ttcccggtcgaccgactcacccggttttgggactttagcctgctgagcctgcttcggcgacgaccagtgaatctgacaagtcaccgtgctcagcggatccgacggccgctacgttcttcgacctccacaccgccgactggctcatgggcctaggagcgcacctcgacagatggacctacatctccggtgat

SEQ ID NO: 64624 - DNA, 487 bp, Triticum aestivum
  Clone ID: PAT_TA_64624
ttatagtatcatcattgaaggtcattgtgttggtgatcatgtcaatgcttcttaccaattcatgccaatgtgtcagttcaaggagcatcaaagggaatgcaatgcaagtgaagaccatgcacaaactgacttctagttctgttgatggaaggagtagccctgctggtgaggaaattcatcatgcgtgtccactagggaactacccctgccaagggatgttccacagttccatggagagcacagaagaagaaggtggaggaaactaactcccgttattatcattgaaatagctgaagataagtcatagtgcgagatcatgcatgtgcttgctatgtaacttttatcttgttttgaagacttaatgttcaagtacgtgtatattgtacttctaaaattattatatttataaataagagtcttaaaaactctattgtaaggctacttttcttgtggtgaagtgatgttaaaaacttttggatgctaggac

SEQ ID NO: 64625 - DNA, 146 bp, Triticum aestivum
  Clone ID: PAT_TA_64625
acgctctgtgatagtacaacctggttggtaaacctttgttatgcatgcagctactgctaccgttcaattcgaatatatatactcgatgaactgtatcggttatcaaatgggtgcatctggagaatatagtgactgaatatcaggtg

SEQ ID NO: 64626 - DNA, 414 bp, Triticum aestivum
  unsure (1)..(414): unsure at all n locations
  Clone ID: PAT_TA_64626
accgttctagacggtaagccgcccgtcaagagcatccaagctcactgaccctcgcctacaacctcatgcctntcaagtagccccacgagagccgactccagaggttcctcgaggaggagaaccacgtggaggacaacaggaacgactccaggtacctgcccttcggcgtcagccgccggagctgccccggcatcatcctcgtgctcctcatcatcggcatcaccatccaccgcttcgtacagaacttggtgctctggccggcgaccggtcaggacaagcttgacacgactgagaagggcggacagatcagcctgcacatcatcatgcactccaccatcatggccaagcccagcgtgttctagagcagcgccctgcctgacgaacgtgctcttgaattatgacttccagcatttt

SEQ ID NO: 64627 - DNA, 418 bp, Triticum aestivum
  Clone ID: PAT_TA_64627
ttttatcgacttctgtgcccccaacttcggcctcgccgactactacggcggctggtgcaacttccccaaggagcacctggagatgaccgaggccgcattcctccgggtcgccaaggccaaggctgacattgtccaggtgcagttccgaagggtgagctgtgacagggccggcggcattcggttcaccatcaccggcggccccaacttcctccaggtgctgatcaccaacgtggcagcagacggcgaggtcgacgccgtgaaggtgaaggggtcgaagacggggtggataccgatggggaggaactgggggcagaactggcagtgcgacgccgaccttcgagggcaggcttttgtgttcgaggtcaccggaggaaaaggcaggacgatcacaatgtataacgtcgcgccttggactgga

SEQ ID NO: 64628 - DNA, 422 bp, Triticum aestivum
  unsure (1)..(422): unsure at all n locations
  Clone ID: PAT_TA_64628
agttaataatgctaattgacaaatcatttcttacttttttgggagaaaaaacatttcctacttgtgtaaactggaaacagagcaagactccgtgtggagcttcaccctatgccgtcactggatcaatggacttgccatccttcaccattgcaacgctcggcttaggagcaggagcgcttgctgccgagacctcgatgacccttcccttgtcccggctgctgctcgtgtacgtgccggtgccgctcgacaacgcccagtccgtggagctgccgccgttcgacacgtagtggaancggttaaccggtggcgcgaggggcanttgatcctgcagtattcgaaccacgctgcttatttttgtgcgttcccacggcttgtattgtacgcaccatagcgccaccttacacatgggtttcgcctttttc

SEQ ID NO: 64629 - DNA, 368 bp, Triticum aestivum
  Clone ID: PAT_TA_64629
ttctcacgcgtccggcaagaagcaaaaccccatagctatagctcaagtgaagtgagctgagggattgaaatttagaggagaagcctaggcatgcaattcagctagcaatggcggacatggtgacggcgctcgtctttttcagggcaccgtggtgatcttcagggtgagcagctgctgcatgttaaacacaatgaaggcgctcttcgcgcacctgggtgtgagctcgacgatggtgcacgagctggacaaggccccccaaggcgaggaggtcgagagggcgctggccggtatggtcagccaaagcccagtggtgccggcagtattcatcgtaagcgagcttgtgggccgcaccgacacgatcatgtcgc

SEQ ID NO: 64630 - DNA, 308 bp, Triticum aestivum
  Clone ID: PAT_TA_64630
tgttcaggaaaaaaagggcgtgagtattactctgaaataggactgtcaatcatacaaagccggggcacatcgcccagtcctggtcaccgacacaccaccgtgcgctcttcctgtctaccaagattatgcaagaacaagattgatcaatcataagcctgctgggagatatattatagcatggattttaaactcagtgtacttgaaaccattaccaataatttttcagaagaccgaaaagttggcagtggtgggtatggagatgtttacagggggatgtataatggggatgagatttgcgtgaagaagct

SEQ ID NO: 64631 - DNA, 387 bp, Triticum aestivum
  Clone ID: PAT_TA_64631
ttctacgcgtccgcagcgggtccatccggttgactccctttgccaactacggagtccgacccgttctttggggtaaagttcccggcggccggagccgggcgttcgccaagcaagtccgacagcgcctcgtgtgcccggtcctcccccgcgggcgggaccgtcaccccgaagacccgtgggacatgcatgtgctctccgacgaaccacccgggctcgctccgctggagcctgcacaaggaacgcaagcagaaggccccggccgaaggcagatgcatgaaggcatcctacccgtcttcggcgccggcgaagggcacggccagcccgttcgcgcaactgggtcccatcggcagcagctgcgccaagggcacgggccgtacgcttccacag

SEQ ID NO: 64632 - DNA, 180 bp, Triticum aestivum
  Clone ID: PAT_TA_64632
gttgttcacccgtccgcccacgccgtcggctaactaacttaacagtaaaccgagagctcgctctgcgtgaccatgatcaggacgaggaggacaagaagaagtgtggagcacgctgctgctacctggtcacgctctcagcagtgcgaatccccagaagcatgcttggcgcgccttctttcg

SEQ ID NO: 64633 - DNA, 408 bp, Triticum aestivum
  Clone ID: PAT_TA_64633
tgtacacacagatccggaccttgcggatgaggcttgtcattcgttcacctgagattaataaactccgttagtcaatcatggaacaacaacaagtcaagccatctctccccccgtctgatactcctatggataaccaggattcatctccacttcctgccgttactactgctgatcctgttccacgtgctctttcaaatgattccgcgacacaggctgccagtccaaatcctgttgccccttcatctccttctgctccaacctctgccaccacacaagatgctgcaggacgcgaggcaccatcatccatgttttctacatcaggcttatcttcctgggcgaaaaatctgaaaatccctcagccttcttcaggtcaagaatcaccaacaggtaaaaataccgtttcccgtc

SEQ ID NO: 64634 - DNA, 315 bp, Triticum aestivum
  Clone ID: PAT_TA_64634
tcagcgccccggctgggccacccgttcgtcggcggctgcctcaggcactgggggcggaactcggtgctcgcagccgtgtgcgctggagggcccttgattgggtggcatgaggtgtgggatcagctggtgaatgcccgcatgggcgacaccgaatggaagaccgggatcaacctgaggcaggataggggaaaggatgggatcgtgagcagggacgccgtctgtgatgccgcgaggaagctcatggattcggacaacgacactggccaagagattaggaaaatggctgcgcatctccgcgaggcttcccttggaggg

SEQ ID NO: 64635 - DNA, 229 bp, Triticum aestivum
  Clone ID: PAT_TA_64635
cggaccggccggaatctggttgcccacgcgttttaccccctgtagaccacatcagcgatttcatcctcccgtgagccggccggggtacacagctcgccgactggcggcgggagtcctgcgcatagcaaccatcgaggaagggccgcagtggctgagtctatacgatccctgagcctacaaggatggaaggaagcggcaggggcaccttgacaccgagcaatgcagatgc

SEQ ID NO: 64636 - DNA, 371 bp, Triticum aestivum
  unsure (1)..(371): unsure at all n locations
  Clone ID: PAT_TA_64636
gggcaatgcattgcttcgcttgcaatcattgccgatgagatttgctgtttgctgctcagcaaagcaggatacagtggagaaggtttgtgaaattgttaagaagcagcttgctgttcctgaaggcactgaagtttgcggtaccaccaagttttctgaccttggagctgattcactggacacggtcgagattgtgatgggccttgaggaggagttccagatcagcgtggaggagacgagcgcgcaggcaattgcgacagttgaagatgctgccacgctcattgacaagctngtctctgcgaagtcatcttgaagggaggtcgtaaatcgtaatgattggagcttcgaagctagtattcttaccttgngctgat

SEQ ID NO: 64637 - DNA, 339 bp, Triticum aestivum
  Clone ID: PAT_TA_64637
tgagcccgatggaaggactggccgcctgcaggccccgccccagtatcccggtggtcccaccacgcgcgtttttcgcgcgcgccactggctgataagcgggaaggtttggccaccatgtgggcagcgccatggggtccgctcaggctaactaaaatgtggctgcaatgtgggcaccatgcgtgtgtgggcgtcataattaaataagggtccacagcctgaaggagtgaataatcgcgagaccattaattgttggggctgcgcacgatctgagtgggcctggtgaatggatatggatcaaagcagagatgcggcatactagaggtgggggcagaatcccta

SEQ ID NO: 64638 - DNA, 396 bp, Triticum aestivum
  Clone ID: PAT_TA_64638
tttttcacgcgtccgaaaagatcatttactcgttacttgtttcttttgcagaaaagtgcgatgaggcactataatcgtcaagagtccatccatgtggctattgagaagagagaagggcgggaaagaagtgaagaaagggacatgagcatcaaggaaagaagaaaccgggggccaaaacttaagatggaggggatctacttgggaagaaagaaggaaaggagaagggccaaatcagaaaagcggcagactagaggaggggtcaaaatccctagcagcagccccgatcccctttgggcctagcatcttcatctctctgccccgactgcttctccacctctggccgccgccgcggccaggccggcatgtgggcgcgcgaccgcgccaacagggccaccc

SEQ ID NO: 64639 - DNA, 478 bp, Triticum aestivum
  Clone ID: PAT_TA_64639
tttcccacgcgtccgcctcgggctagtaagaacgtgtggaaggaaaaaatcctggggtatgacgaagccagcaatgtgatcattctgtatgttgatgacagtgcctacatgcttgatcttaagtcgatggaatccacaaaacttgatggaagccgtttgatgaattcctgtcacccattcaccagtttctatccgccagacatggccatctaagaagcattgatatgtgcacacggacacaggggtacggatacacggaatacggcattttccagaaacaaccatacataaataaataaagtacagcatgtaatgttgtgaggacaaaagtatatttgtaagatgtgcgatcggttgttttctgccttcatttccacgtttgtatatgggtgagcttaatgcagctgacgctgcatgtttatgtaagtagatatttcaggaaaaaaagataatacaatgcagcatgtaatatggacat

SEQ ID NO: 64640 - DNA, 389 bp, Triticum aestivum
  Clone ID: PAT_TA_64640
atcagatttactgtgcatcgcgaaaaatgcagggagctttctgtgcggtgatcatcctcggggagaacgccgactaacagcgacgacagcgacggcctcccccgggtgtggtcgacggtgcgagccaacaaggccaagcgttgggcgggccgtgtgtgcagatgccgaccatcatcatcaaggtggacctggattgcgcccgctgccaccgcaagatcgagagggtgctcgacaggatcagagagaaaggcgagttcgtgatcgacgacatcgagtacgatgagaagaacaacaaggtgatcgtgaagggccccttcgacgcggacaagctctccgacaagctctgctgcaaggcctgcaagatcatcaaggagatcgagatcgtggag

SEQ ID NO: 64641 - DNA, 334 bp, Triticum aestivum
  unsure (1)..(334): unsure at all n locations
  Clone ID: PAT_TA_64641
tttaagaggctgttggagggaggtcaagtatgttgggttatagaggcgagccctgacaccatcaggcattcttacattgtgcacctgatctctaccatgtagatggaatggtctatgtgggcttgcccgagattgcccctctctgcaggtgaattgggactttacaaactcgacttttgtgcttccataatcaatagtcctgattgaatgagttgtatcggttatgtaaactcgcttcatgcgtgacttactgtgcacatataagctatgctatattgttnaaaaaaaaaaaaaaaaaaaaaaaaaaaaaaanncaaaaacaaaaaaacacaaa

SEQ ID NO: 64642 - DNA, 295 bp, Triticum aestivum
  Clone ID: PAT_TA_64642
ttcttggatgcacgcaccatgtgtttgtgtgtgagtgtgctgtgctgtctagtcaataagacgagtgtgctgcttagttcgtatgcttcctatagcatagggtcgaccgagcttccttttgcacgccggtgtaagatttctttctttttttttgcgggaaaccggtgtaagatttcagtagcatcgtaatgtcgtcttttagatttccaaaatcgtaatgtctcactaagctgcatgaccatccaagagaaaaaactgaaagaggagcttgatgacacgagagactaaacttgaa

SEQ ID NO: 64643 - DNA, 448 bp, Triticum aestivum
  Clone ID: PAT_TA_64643
tataaaaaaaaaaaaaaaaaaaaaaaaaaaagaaaaattttaaaaaaaaaacgaaaatacctacagatgataaaggaagagatcttgtacggtctccggtcgctttcttggtccttcgaggctctttttttgggggggggcctttttgggggtcccattttccgttcgggggcttgcgccgtttttgtttttttttgggggccccttatttcttttcccgggccgggtttttcccccgtgggggcggggaaacccctgggggtcccccctttttttggtttggaggaattttccctttttgccggttggggttttttgccaaggggccccacccttggccttttcccccctttggcccccttttttgggggtcctggggcccccccctttgtttggcgtttttttgcggggggggggggggggggtttcccccccctggtgccccttt

SEQ ID NO: 64644 - DNA, 297 bp, Triticum aestivum
  Clone ID: PAT_TA_64644
ccaccggcgaaccggcgcgtgagggggggcatttttaagacagcaccgcggatgcccctggcagacccagaagagtccgtgtccgcaacaaatggcagtaaacatggccctcgggggccagtgtatctatgtggaggagcacatgacaaaagatgaactgagtgcccgtctacgctcgctgggtgcaaaacagaaccgtgatgtcaagtcaaagggggacaaaagaagaactggccctccgtgtggaagatttaaaagaggatctaggtaacgcgaggcctaagcgtggcactggcc

SEQ ID NO: 64645 - DNA, 474 bp, Triticum aestivum
  Clone ID: PAT_TA_64645
ttctctcgcatcttaatagatatggtttttggagcatgtggttaatgatctaaaagcaagaaagagaatgggcttttacttaatttcataagagaatatgccgtggtcttatgccatatcgatgggtatgttgatattggtttttcaaattgtacgagatgctgcctccttggtcgcctctcttaaaccttatgtctcaaagcattaatgtaatgtgaatgctaaaccgtaagttgaatggaacctatctttccacaacctattacctaaagagaagccattttatggttcctaatatgacattgagtgctgtcatgcatgatttggtataatgtttgccgttgatttggtatactatttgcagttgtcacccagcacaatttcttgatgaatggttagatttgtattgccctttccttggtttgccagtcactgtcagttattaatactgaaacttctgtattgcaaaacctt

SEQ ID NO: 64646 - DNA, 384 bp, Triticum aestivum
  Clone ID: PAT_TA_64646
tctgcgagggaagggatgtccgaacggtgtgaagagcaagcatctcctcttgattctctgggtctttggtatgctgctgctttggttctgcagagtaaccgtggcggagtttgtttctgcacctctcgttgcctggagcctgggaacgatatccacggagccacgctgctgtgctacatgacaagaccaagttgccccttgcgtgctgcgtgttcactcaggtccatttcaacccatgccactttcccggggaatggggccctgcctcgtttcggttcctatccattgagccaagtagtgctctgtgtgtagccaccgtgaaatcaatcaatcaatcaatggatccccactagctgccgtgcaatcatgaactgggctgaaata

SEQ ID NO: 64647 - DNA, 253 bp, Triticum aestivum
  Clone ID: PAT_TA_64647
taataaaaaacaaaaaaaaaaaaaagagagaaaaaaaaaaaacaaaaaaaaccaaaaatgcagcagaaaaacccaggggggccgcgtgtacgagccccagggccccaaccgggccctgcgggggcttgggccctctgagggggtcaccatgacgaaagataccgggcgcggtcttacagcgtgcggggggggaccaccaggaccgtgccgcgctcccagcggggagcgacagagcctctgggtccccgggggg

SEQ ID NO: 64648 - DNA, 466 bp, Triticum aestivum
  Clone ID: PAT_TA_64648
ctgtactggcgcgcgcggcttcggatcgcgcggggcgcggggcgcggggtgctgcacatccacgaggtgtgcacgccgcagatcgtgcaccgggacatcaagtcgagcaacatcctgctggacgagtccggcgaggcgcgggtggcggacttcgggctggcgcggctgatcctgccggaccggacgcacgtgacgacggagctggtgggcacgctggggtacatcccgccggagtacgggcaggggtgggtggcgacgctgcggggcgacgtgtacagcttcgtggtgctgctggagctgctcaccgggaggcggcccgtggagatgatggcggcggcggggcagccgagggacctcgtcgggtgggtgacgcagatgcggtcggcggggaggcacgcggaggcgctggacccgcggctgaggcaggggagctcgcctggcgacgaggcgcagatgctgtacgtgc

SEQ ID NO: 64649 - DNA, 242 bp, Triticum aestivum
  Clone ID: PAT_TA_64649
tcgaaaattctctggttgttccagtggtttttttattttcattgcgatctatttgtggcaagaaataagaaagacaaactcttgtgttgacaatccggaattggctgaattgtgtctaccctgttttcacatcaatgatatatgtgagccgattgaaaaaaaaaaaaaaataaacaatatacaagagtaaaacaaaagaaccaaaaaataaaacaaaaaaaaaaaaaaataaaaaaaaccag

SEQ ID NO: 64650 - DNA, 431 bp, Triticum aestivum
  Clone ID: PAT_TA_64650
tatcacatgtgatctgaatgataacatcgctgccccatggtcgccttctttgcaagcatcggcttcgacatgcaataaatcagctgctcctggtccaacaatcccagagaggcctgcagcaacatcggcgcagaacggtgtcaaccacaacagactggagcttagcctagccgtctgctttggcgcccttgtggccactattttactgcaagtctagttcaccttagtttgtcaaattatccagggtttgaggagagctgattggaacagtgaaccgcggagtttttgtgcgtgcttggtcatcgcatcagagcattgtaactggtagctattagtgtaatttgctgtaagccacagaatgatagtgaatgcaacactgactctaatttattactattatgccttttgtatagcgagtagtgaaggttcat

SEQ ID NO: 64651 - DNA, 235 bp, Triticum aestivum
  Clone ID: PAT_TA_64651
atgttggctggccacgaccacatggagatcggccccatgctccggcagtgcagagagctgctcgagggccttgagactatcactgactgccgaggtagcgatgggacgacggctaggaccatcgttgaggtctacccgcacatcacgcgcactgttgtggaccttccaaggctcatggacagagttcttcgtgcccctgaagaaagagcgcgtgaagtatcgatcttggtgacct

SEQ ID NO: 64652 - DNA, 368 bp, Triticum aestivum
  unsure (1)..(368): unsure at all n locations
  Clone ID: PAT_TA_64652
ttttgctttcttttagtgaattattttgaattaatcctgtaattcgtagtggttttgtcactgtaatttctatatcttatcagtgtaattataattttgcaaatgctagtgggatttgtagcacgccatcactgtaaatcctagcggttctttatcagtgttatattccttgtaatcctagtggttattttactgtgatgtatttgcaactgattgttgatgttatttcatttttaaaaaacnnnnnnnnnnnnnnnnnnnnnnnnnnnnnnnnnacnnnnnnnnaaaaaaaaaaaaaaaaaaaaataaaaaaaaaaaaaactaaaaaaaaccctnaaaaaaaccaaaaaaaaaaaaggggcggccct

SEQ ID NO: 64653 - DNA, 266 bp, Triticum aestivum
  Clone ID: PAT_TA_64653
agacgtggaggcccccggggaaacggggggggaggggggcaatttacagcggggccccgggaggtcccccagtgacccgcgagagcggggccgcacacacagagggacaactaggtcgaccagagccagtggttgcgtccaaaacatccccgacctgacaagaactgcgtgccactcgccagagttgcggagagcaccggaggatccatggcacgttgctgatggcaataaaggagcaacagctgcgcggggcggaagaacaaaaa

SEQ ID NO: 64654 - DNA, 331 bp, Triticum aestivum
  Clone ID: PAT_TA_64654
cccacgcgtccgcccacgcgtccgatggaacatatctcatgccgagtggctcggggttccgctgaaggtgtacgcggaccggttgtcgtagatcgtcgcgcgccatcatcattttgtgcaaggtcaaccggttcgacttccaggagctcaccgtggatcttgtcaagggacaacaccgcgcaccagagttcaccaaaatcaaccccatggcgcaggtcccaacaatcgacgatggaagattcaaactctttgaaagtcatgccattcttaggaatctcgcccccgtcttgcccggggtttcacattactggtattcagccgacttatttac

SEQ ID NO: 64655 - DNA, 253 bp, Triticum aestivum
  Clone ID: PAT_TA_64655
tcttagagagatagcctggagggcactgagtgtcatggatgaaaccggggcactggtcggggtggtgctgcgagcaaagctcgcgagtgggaccggagagtgcgagaggagctcacacgaccgcattgctctacgcatggccccgcgcatttgggcaggcgacgaggcacactatgctccctcaagcatctgctgttttgtggagcacacagataggtaagagtcccagctgcctgctcgctcagcatgctgt

SEQ ID NO: 64656 - DNA, 387 bp, Triticum aestivum
  unsure (1)..(387): unsure at all n locations
  Clone ID: PAT_TA_64656
tctaaaccattcagttcaaccaatttgagcagaattattacactaatgaagataagtgtgatcatggttgttgggctgatttttatcaacctatgcacctgcatgccaagaaatgtggcgaaccatgaatctcacgatacagtggtgccacagaaggaaatgcgcagtctgatgtctggcactgctggaaggaaccggcctccgagcaatgatcaccagtgcccacttggaacctaccctaattgccaagggatgtcccagaatactcaagaagcagctcaagatgttggaggaaactaaggcaaactaagggattatgagacggaatgaatcccccagtttatattgcttttacttncacgacggagtcatttggcatgaaatatg

SEQ ID NO: 64657 - DNA, 426 bp, Triticum aestivum
  Clone ID: PAT_TA_64657
tcttgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctcgtcaagaagctgcgcaaggcgaaaaaggacgctcctgctggtgagaagcctgagccagtgaggacacatcttcgtaacatgatcattgtccctgagatgattggcagccttattcggtgtctacaatggcaagaccttcaccaggttgagataagcctgagatgattg

SEQ ID NO: 64658 - DNA, 395 bp, Triticum aestivum
  Clone ID: PAT_TA_64658
tctctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcatcttgtgtctgaagtatctatacttggccaggaaactagagtcaatgatgttttagcccttatttagctgag

SEQ ID NO: 64659 - DNA, 462 bp, Triticum aestivum
  Clone ID: PAT_TA_64659
tctcacgcgtccgggccgtgttcctgctcgtgcaggggctggtgtacctcatcctcaccaactcctccgacgtcttctccaagagcaagaggctccggtccctcagcttccggcccatgcggtccatgagcgtgcgccgcgtcctggcgccgctctccgacgtccccgtcggcaccgacgacgactctcctttgccttcgtcggcttcttcgtggtcgtcgcgccgctggggtagccgcaaagaggattgagcagcttggagtcagcggctggttagttctgacaccaaatgggtagatactagcgagcttgataattctgttctgaactgtcctgggtttgttatcggggtttgaccgtttgagatttaagaatggtatttgttaaaaaaactcaacatgtaaatcaggttgggtggggccttgtacatatgttcattgatttgatcgggatgatgaatta

SEQ ID NO: 64660 - DNA, 321 bp, Triticum aestivum
  Clone ID: PAT_TA_64660
tttctcccccgtcaaggactattcggactgggcccatactgtggacatcaacgcgggcgtctgctccaccgacgacttgacgatgtacagcttcagggtgaacccatgctggcgcgcatacacgcacgactggaccgagagccccttcgcccacccgggcgagaacgagcgccagttcgatccgcgccgagtgacatactcctgcgtgccatgcccggactttcgccaaaaccaataggcatgccgcaagggcgacttctgcaagtacgcgcacagcgtattagagtcatggctacaccccgtgcaataccgtaccaagct

SEQ ID NO: 64661 - DNA, 154 bp, Triticum aestivum
  Clone ID: PAT_TA_64661
tgtttgagaggcctttggacgtgcccctctcactgcgcctgtgactttctacactcgtgcggccagccttacatcaagtcgtgaacggtcactgagcaaatttgtctccttgttttggccacttttttctttccgtaaatttggaattattttc

SEQ ID NO: 64662 - DNA, 385 bp, Triticum aestivum
  unsure (1)..(385): unsure at all n locations
  Clone ID: PAT_TA_64662
tttagactagaggccaagatcgccgattttggcttgacgaaagcctttgactaccacaacaacacccatcttttcacgaacacgctcgcttttacccccgggtacgttgatccacagtaccaggccacgatgcagccaacgaccaagagtgacgtgtacagctttggagtggtgctgctggagctagtcaccgggaaaccagccattctttcggacccagagcccacaagcatcgtccaatgggcaaggcagcggctggcgcgcggcaacatggagggcagtggtggacgcgcgaatgcagggtggttatgatatcaaggncgtgtggaaggtggcggatattgcactcaaatgcaccgcaaggggtcaacacatcggcccacca

SEQ ID NO: 64663 - DNA, 179 bp, Triticum aestivum
  Clone ID: PAT_TA_64663
tggcttgcgaagggcaagaagaaagaaactgaggcggagcaagggcagccaaagcagcagcgagccacaccgaacaagcggacgccacaaaacccggacacgcgactgggagacgggcaagaggagaacatcgaccaagggacaagcccaaccggggagacaccacagaaagaccaaca

SEQ ID NO: 64664 - DNA, 122 bp, Triticum aestivum
  Clone ID: PAT_TA_64664
agctcctgcccatggtcccctgactcgccgagggatcacggagccgctgtgatgcagggggatgcactggcgcctaccgcgcccttgcacctggcacatccattgcccctccctgctcattc

SEQ ID NO: 64665 - DNA, 146 bp, Triticum aestivum
  Clone ID: PAT_TA_64665
ttccttctcgcccggaagaaaaaaaatcgcgttcgtggagtttactcagacgcgtcgctaatatgacgtgggaaacatgtgataggttcggtgccataccgagctacttggaaatgctgcctggactcttacattagacttgaaca

SEQ ID NO: 64666 - DNA, 365 bp, Triticum aestivum
  Clone ID: PAT_TA_64666
tttctgtccacgcatccggactcatcgctgccacactgaaacgttgtctgagtccaattggcgcctgctggatgcacccttgtgaatggggggcgatatgatcaccgatattgccgtggccagcatgtgtggcaccgagttggcagtaacctactgcgtaaacacacagagcagaacacccctatgctccttaagcactaggtgcaggtggcctacgaaaaacagcgttatatatgagaggccgttcaagctcctatcaaccgtcccagaattgctgccttgataaactgacgcctcacactccagcaggatttacctgtgccgtacgaactctaagtgtagcacaaccgtcgtccttcccaggg

SEQ ID NO: 64667 - DNA, 117 bp, Triticum aestivum
  Clone ID: PAT_TA_64667
tttttctgccgacgcgtgggcacacgcgtcgggaggcgcctatgacaaagacaacaccgatactgccacaggaagaccacgaggaggaggcagccgatcagccaggcgaggcacacc

SEQ ID NO: 64668 - DNA, 408 bp, Triticum aestivum
  Clone ID: PAT_TA_64668
tggttctctgccgccgccgctcccagatcgcggggtcccgccccagtcgccgtagccgctcccatatcggggcgagcgaggaggatgatgggctggtccgccccggtcgacggcgccgctgccaaatcggggcgagcgaggatcgtcggcgtcgccgccagacctctgcggaggcgcctgtccctctgccgggcgacggggatacgccgcggcacggccgtcggccccccgccccgcgcgagtcgctgccgtaggatatgcttggggagatccttctccttctggcaccgcagccgtcgtccggcctgctggcgcccttggtctccaggcgctggcgaggcctttccaccgaccccaacttcatacgtcagtttcaagcccgccgcaggagctggaagccgcccctgc

SEQ ID NO: 64669 - DNA, 174 bp, Triticum aestivum
  Clone ID: PAT_TA_64669
tttctttctggtaggagggatcacacttgcggtcctgcctgctttatttcatggcgttgacccaagatcatcattacatattggagaaggtctgctgctttagttggtggatgagaagaaccaaaaccggtatttttcgttgagggctccaaaaaagaaagaataacaagtagg

SEQ ID NO: 64670 - DNA, 480 bp, Triticum aestivum
  Clone ID: PAT_TA_64670
ttggaggatatgtacctgaagccgctcaaccttggtctcattgctgcgtactactacatcagctacactaccattgaacggttcagttcaatgctaactcagaagaccaagatgaaaggtctcctcgaaattctagcttcagcatcagaatgcagagcttccaagtcgcccaggcgaagaggaatacattgagaggctagtccgtcaccagaggttttctattgacaaacccaagtatggtgatccacatgtcaaggcgaacgccctgctgcaatcccactttgcaaggcacacggtggtagggaacctggcagccgaccagcgcgagatcctcctttctgcccataggctgctcctggcaatggttgatgtcatatctagcagtggatggctcactctggctctgaatgcaatggagctgagccagatggtgactcaaggcatgtgggatcgtgattctgtgctgctccaacttccaca

SEQ ID NO: 64671 - DNA, 394 bp, Triticum aestivum
  Clone ID: PAT_TA_64671
tttctgttcacgcgttcgttcacgcgttcgttcacgcgttcgaaaaaaaaaacaaaaaaaaaaaaaaaaaaaaaaaaaaaaaaaaaaaaaaaaaaaaaaaaaaaaaaaaaaaaaaaaaaaaaaaaaaaaaagaaaaattaaaaaaagtaaaaaaaaaaaaagaaaaaataattggggggggcggttttataggttcaaagtttacttcggggtgtttggaaggtattaacttttttttggggggacctaaattaatttaatggggggtggttttaaaagggggagacgggaaaaacctgggggttaccaaatttaatgggtttgaaagaattcccctttttgcaagttggggaaataaataaaggggccgaacgtttggccttttcaaaaattt

SEQ ID NO: 64672 - DNA, 268 bp, Triticum aestivum
  Clone ID: PAT_TA_64672
tgttttctagcatcgactacccaagatcggagaggcgtttctgggagaatccgccgccacgtctgccagccaggtcatcggcaccctggccgccctgatacctcacgataacagtatccccatcacttctgagaagaaagggccgctgtcaaagctgtccgaatctatggcgaggcctacagccccgggctcttcaccaagcttctggaaaagaagagcgacaactacctaatcccctccgtgggatctggtggaatgaggtgatcca

SEQ ID NO: 64673 - DNA, 206 bp, Triticum aestivum
  Clone ID: PAT_TA_64673
tctttctggcacagcctcattgaggagtacaagctgtagggccttatacgctggatctctggtcaaatgaaccgggtgcgcaaaggagagccgccccgctccatgtgtaagaccaagggagcatcagggcaggcagcatgctatgacgctattggccgtactgccatggaagccatgacatggggtgtggcgacaattgcgacatg

SEQ ID NO: 64674 - DNA, 344 bp, Triticum aestivum
  Clone ID: PAT_TA_64674
tttgttttcgatggtgtctcatgccccgttggaaactgttcatcttgtagcggcactttgctcgttgtccccttccttttggatcgatccggccttcggcggccatcaattgcgccggggtcgccgatgggttgcctgcaggcgagcctgataccggtgtcgtcgaccaggcacggaggaggaggcttgcctggagcgtaacttagctataatgctcggtcgatcctgctgcttcttggggggcaaggaaaaagattacaccgaggcttactctctacgaccgcaccaggctgagccagattatttccggtgacgcacaccatggatccccagacatttgtgag

SEQ ID NO: 64675 - DNA, 112 bp, Triticum aestivum
  Clone ID: PAT_TA_64675
gccggcaggcaccggacctggaaattcttgggttgacccactttgcttccaacgcgacacgagaaaaccaggggggggcccaatctctgactccgccgcacgccgcacgcac

SEQ ID NO: 64676 - DNA, 344 bp, Triticum aestivum
  Clone ID: PAT_TA_64676
tcttttgatcacacacacacactcacacacacacacacacacacacacacacacacatgtggcgttcgtttctgtagctattccggcacattggtgcctctgatctatcaactaatctgaaaaggttcggtttatcactctaaaacaaatagcactgacacaaaggatgccaaggacaaccttaaacctgatggtggattctctttctttgccactgctggaactgatggcaactactatgaatcgaaactggattatgattgacaacattaaatggtgtggcaagcatagccatttgctggtgttaggtccatattctagaatttggaaaaagcctacgtcca

SEQ ID NO: 64677 - DNA, 294 bp, Triticum aestivum
  Clone ID: PAT_TA_64677
tttccctgaaacaaaaaaaaaaaaaaaaaagggagagaaaaaaaaaaaaaaaaacaccaaaaatgcaaaaaaaaaaaaaaaaaaaagaacgcgaccaaacaacagaaacaaggggcgcccgccgcagaggacccaagctcgcggccgggggccagcaccaaagaagaaccgaaagggggcccccgaaagccaagcaaacggccgcaacttaaaaaccccgcgaacggggaaaacccggggggcccccacccaaaccgccagaggaaaaaaccccccttggccacagggggaaaa

SEQ ID NO: 64678 - DNA, 464 bp, Triticum aestivum
  Clone ID: PAT_TA_64678
ttgtttctcgtccgcccacgcgtccgcccacgcgtccgccctctcgtccgcccacgcgtccgtgctcacttactcacacgcaggtttcggcgggaggaggatcgatggcgttcatgcggtaccgtgcgctgccgcagggggaggtgaaggcggaggagttctgggcgtggctggggcagttcgacgcggaccacgacggccggatcagccgggaggagctgcagcgcgcgctgcggagcctcaacctgtggttcgcgtcgtggaaggcacggggaggggtgcaagccgcggacgccaaccgtgacggcgccgtcggcagggaggaggccggcctgctcttcgcctacgcacagaggcagctcggcggcaagatcacccagctcggctcctactgataagctgggcatgtattaacctgctgctgtaccaccatcgtgtgtggagcacgagattttttttttccc

SEQ ID NO: 64679 - DNA, 289 bp, Triticum aestivum
  Clone ID: PAT_TA_64679
tgtttctgaggcgcacggccacgcacggaaggcctaccgggacaagagcgggcaccacggccacaagacagcacaccacaccgggcacgggagcgggcaccaccacgggcagcagcaccacgggggccagatcagcggcggcgcgcacgggccccagcgggacaagggaaatggcgcgcgcaggaactcagccgagcaagtgcacgcccatgacatgccagaggcgaacactaacgatgctctccgactgctaccagaagaagaacgatctatgcacggtgagagatac

SEQ ID NO: 64680 - DNA, 210 bp, Triticum aestivum
  Clone ID: PAT_TA_64680
cggacgcgtgggacaaaaaccgacgaacgaactaaagtagttaaggagagaaaagaggtgccaataaagctggctaggatagataagatatatattgcagttacaagaaacgacagcttatctaacgacagtggctgttgttgtgagaaggaagccccagtacgtgtactaatgcgacagaaatgggggggggcgccttgtgggttgcct

SEQ ID NO: 64681 - DNA, 453 bp, Triticum aestivum
  Clone ID: PAT_TA_64681
tttcttcagaacgtatgcacacgaaccgacgaacgtactacgtgtttggcgagctatgtggtgccgattaagctggctaggttagtttgtttatatattgcagttcaagaaacgacagctaagctaacgacgtggcagtgtgtgagtaggaagcataagtacgtgtactaagcgacagcgattgacagtagtgactagtgaatgagtggatctgtgaatcatttttgtagatgtagagtcctggaatcaggattatgcaactatgattgggtgattggtacactgattgccagcaaaaaaaatgtgatgaaaacttttggccggtggtcttaacaagtagaagtagtatagtatatttttgacagttggtggtctaactagtaaatttaccagttgccccacagctgtcggattatgagtcggccggcggcggagccgtccatccgggtaaaa

SEQ ID NO: 64682 - DNA, 347 bp, Triticum aestivum
  Clone ID: PAT_TA_64682
tgccgtctccgacactcctccgttgccggcgccatgatgggtcgtgtgatccgcgctcagcgcaagggtgcggactccgccttgaagttccacacccaccaccgcaagggccccgcccgcttcatgtcgctcgacttcggccagcgcaactggtacctcaagggcgtgacctccgatgtaatacacgacccgctgcgtactacgccggtcgccaatgtgaccttccgccaccctttcacgtactagcaccagacggagctcttcgttgccgcctagggtatttacacctgacagttcgtctactgcggacgccgatccaccctctccgttagtcacatgctcccgct

SEQ ID NO: 64683 - DNA, 265 bp, Triticum aestivum
  Clone ID: PAT_TA_64683
ttcgttcacatatgtgtatggggccgcaagctatggaatgatatgctgccgagctcctgacggagaaagtaggccaaagatcgcgcatatccgctagaaggaatatagagtgcgatctagacaccccacctacaaataaacggaaaggccctccagcaagctgttacgaggtggagtgcttcagcctggctcatactgcagcccaaactgtcttcgactgcacgggccggggatgatctcctcagactcttttctgctttgctga

SEQ ID NO: 64684 - DNA, 390 bp, Triticum aestivum
  Clone ID: PAT_TA_64684
tttgtttcacatatgtgtacggggtggaacgctatcgatggagagcttacgcgcacctgctggaaaaagatgaccaaagatgtctcatatgcaccggaaggaatgtcatgtgacgatctatattgcccacctacaaatagactgtaaggcactacacctagctgctacgaggaggagctgcttcagcctggctcatactgcatcccagactgactatcacttgacctgccggtgttgatctcactcagtgtatttgctgctctgctgattgctacacacattggcctctatctcgagtctaccacctgctggcctatagtgatgcttttgtcgtcctggcgatgggtatcatatatccttatccatgctattctcatccattgactgaac

SEQ ID NO: 64685 - DNA, 414 bp, Triticum aestivum
  Clone ID: PAT_TA_64685
ttggtatatgtagcgcttgtggttttcaccgggagacatggctaagccagctttctccttggtgaagtgtgtgtgcgtgtgagtttccatggtgtgtgttcttgtcttcttaagagaagaagagagaaaccacaggagagttgtgcgaggcagctcgaggaagaagaaggttggcgctgcaagaggagcggcgccaacaattggtattcagagccttgtcggtccggagcggtggcggcgcggcaaactccatgcgagatggaggccggcggcgcaaggaggaggtcggtggctgctgctacggtgcgaggccgttatgaggaggagatggtgcgcggtgatcgtcgtcgtgaagtcgtcgtccgcgttaagagaaggccgcttcatacggcatgacaccgaggtgatcggcgt

SEQ ID NO: 64686 - DNA, 396 bp, Triticum aestivum
  Clone ID: PAT_TA_64686
tttgttgacgcaggtgcagccggacgtaggcatcttctacaaggccatgtccatcatgaactattgcatcaacggcatcttcgagaagctcgccggcgagtacgacaagctgggccgttacaacaagaagcccaccatcacttgccgtgagatccagacctccgaacgcctcgtcctccccggggagctcgtcaagcacgccgtcttcgtgggcaccaaggtcgttaccaagttgacctcatcctgcacaggttaggcttgaggctcgtcgcttcatgccttctgtgtgtacctagtccgcagtgtgatgttacaatcttcgtaaggatctctgctgctggcttgctggctcgacagaaatagtgatgctggtgcctgatcaaggtgggtgatccc

SEQ ID NO: 64687 - DNA, 430 bp, Triticum aestivum
  Clone ID: PAT_TA_64687
tttgcggcttgggccggcggctggtgctctgcttccggcagtgatggccgctggtggtggtggtcttggcccgtgcttgccagatttgcagtgagcagggtgaggatggtggtggcgatcctgtggtggctcgtcatcgtgggcgtggtcctgtaggaggcgcatggggcgggatgtgaactcggcagcgtgtcgtagccgctccaaggcggctcggggctgtccctcgaggtcccggcgtggatgtgggctgccacggcgtggtggtggctcatggcggtggtctgggttgtgtcacggcggcggcaggacttcttcggtgtccgccggtcggtgagcgccttgttgacctttgattcctcccccttgtcgtttgggcactatcttcattgaagggttggccattctccagttgtggttcctcgtccgt

SEQ ID NO: 64688 - DNA, 413 bp, Triticum aestivum
  Clone ID: PAT_TA_64688
gctacatccacccacggcggtgttggacggcggcgacggcttttctttgctgcaactgtctcggatttttgctactaccggagacgccatttgctactaccagagtcttgttggaagcatcagaagttttcgctaccaccccaagttttttttgacttttgctgaaccagcctaaaaattgctaccaccgtcttttgattttgctggaaccggcattttttttgcttcaccggcggcggtgaaggtgggtcgtgttttgcttcgccggcggcaagcaggggtagcggccggcgacgtgaggctccgcgagccgcggggggcctcgccggagatgcgccgcaggggcgttgctggagctgggcctcgcgcgaagatgcgccgcgggggccttgctggagcttggaccctcgccg

SEQ ID NO: 64689 - DNA, 348 bp, Triticum aestivum
  Clone ID: PAT_TA_64689
ttttatttccactcctctctcccctacccctcgccccatcgccccgccggcgccgcacgcgccaccggcgacggcgaccccgatgggcgccttcgcctccgttctatttctttccgtggccgacttcttccctggcgcggtcaccgctttcgcgggcgccgccggctgcttcgcgcttggctactttcttgcccttgtccggcttcccattcacgccggcggcgtccccgacttcggtgacgacgatttcgaggacgacttggacgaagatgatgactaaaatttcggccgcgcccggccggcgaatcgagcctcccggcggaagcggaccgggctcaagctgctgtt

SEQ ID NO: 64690 - DNA, 295 bp, Triticum aestivum
  Clone ID: PAT_TA_64690
tttcttaaacatagtaaaatgtataaaattacgcagctttccccccaccactggtggggggtttgggtgctggccccaaacgaacacactcctgcgtgcgacgctagataccttatgtgacggaaccgaaaaaggggtcactgcatgtctgaagacaacaaactgactgggaaaactctgccttcgctcagaagacaacccaacctgatcagctctcgttcatcagatggcatatgagcgatgaggtcttgcccgatcgctcaagaggacacttgatcacactagacctgggctg

SEQ ID NO: 64691 - DNA, 355 bp, Triticum aestivum
  Clone ID: PAT_TA_64691
tttgatcagtgtcttttgcaaaaaaattacgctagatatggtgtcttctgcaacaaataaaaaaaaaaaaaaaaaaaaaaaaaaaaaaaaaaaaaaaaaaataaaaaaataataaaaaaatataaaaaaaaaaaataaaaaaaaaaaaaaaaaaaaaaaaaatattggccgtcccttttaaagtaccaaactatactttcccgtgcatccaacattataatttttttatatggccacctaattaaaattctatgcccgcaatttaacaacctctcaacgggaaaaaccctcgattccccaaacttaataatattgtaaaaaatctctcttttttccaatttgttttaattaaaaa

SEQ ID NO: 64692 - DNA, 232 bp, Triticum aestivum
  Clone ID: PAT_TA_64692
tgttgtacgcgtgggtttgtttttgcggggggtggaaatagtgttatgttgaatgtatttaagcaaagacatgctgtggctttgtctagcattgatgtgtgcatatactgttgttgtgctgggacaatgggcttcaccactgcggtgacctcgtgtataccactagtaagagacatgttgtgttgtgagaacaaataaacctaagtgttaaaaataaaaataacaaatgtaa

SEQ ID NO: 64693 - DNA, 437 bp, Triticum aestivum
  Clone ID: PAT_TA_64693
tttgttacccgtgcggtctccgaaaccgcaccccaattcgtagacggagaacatggatcgccgccggcggcgacccttctggtcatggccggcggaggagcatacgctggagagactacgacctactgcgggagatcctggtgcgcctaccctcgcagaccgacctacctgctgcgcgcctctccttgggtcaagagctggagacacatggccatctgccccaagctactgcggcgctggcgcgtccaccaccggaagcctacactgctcggggactacacgagtgagaacgggggactttcgcgcagatccaccctggacctgccgtaccgaatccgtcccggccacattttcctacaactacaagtacacggtcgtgatccatggaggttggtcgactgacgccacggacgcgtgctccttctaacaaggagagg

SEQ ID NO: 64694 - DNA, 335 bp, Triticum aestivum
  Clone ID: PAT_TA_64694
tttttgcccacgcgtccgttaagtttgaatgtcttgggacaaaatctggtagtcttttgatccaaataaggtctggatctggatatcttgcttatgatttgtcagattaagcttttctggtggtgttgaatttgcatgctagttgcgttaataaaaaaaagaaaaaaatttattcaaatactaaaataaataaaaaaaaaaataaaacaagattatagatctaatttgaacaaaagaaaaactagttcttattggggcggcccttttaggggtcccaagtttacctccgcgggcatgcaagctcttggcttttttttagggtcacctaatttaaa

SEQ ID NO: 64695 - DNA, 206 bp, Triticum aestivum
  Clone ID: PAT_TA_64695
gacgtcatacatctggtatagtgatagctaaattcaagtccatctggctcgtctggtggtacgaacgtcagtgactaggggaaacacctggtggtacccaacttaatggtgtgggagcacatgcacctttaggcaggtggggcaatagcgaagagggcagtaccgatcgccctggccaacaggtgcgcagactgaatggacactgg

SEQ ID NO: 64696 - DNA, 325 bp, Triticum aestivum
  Clone ID: PAT_TA_64696
ggtggaacctgataagtctgtgatcgtgcaacctggattcaaatgagctgtcggggctatagaacgtctggagtggaaaaaccgtggaaagaccaaactgaagcccgttgcacgcacatctgggtgaacaacaggatggcgtgatggcagaactggccgcgaccaaagaggaactgcaactgctggtggaacagattggcgagggggacgagcacatgagggctacactaggcactggccgtggggtgacaacgcgcagactggcaaaatcactgggcagcgcaactaaagcccgcttgctgcacattcttcctttgcctgctgg

SEQ ID NO: 64697 - DNA, 392 bp, Triticum aestivum
  Clone ID: PAT_TA_64697
tggtcgccactgggggctctcaggcggactgtaaagcgattgacgtaggtggggggatgtgggctgatacccaaggagcgtcatgattccttcaattgcgaagaagaggtgacaagacagacggagaaagtaaatggagtgctccaggactatagcaacatgcaccagaagctaaaccaagacatggatgcaactgttgagtctgtaaggcctgatcgcaaacaatagtaaaggtgacaccatatgggggatatatgagagaggacaatgcaggctctaggcttaggcatgccactggttgtattgacaaatggtataaagtgtgagaacgatatcttcgcgtatcttcatttgagcgcttggaggtcgaaggacttatggatgtgatgatg

SEQ ID NO: 64698 - DNA, 423 bp, Triticum aestivum
  Clone ID: PAT_TA_64698
tttttggggcactgccgatgctcgaggatctgggcctagtctactctgtgtcaatggcgaatgccaatggattctgcctgggttttcagcacctcccaagactgagaaatgcacgagtccgtctctacaaagagggcgcaacatcttctgctatcacttctgcagaagttgctataaagaatgaagcagatgcccatcccaaccatcccacagtaactctgatagaacatgtcaagagagtggattattgctctgaggaatgtcctaagagaaccgtacagagctactctgaagacccagaactagttgacaatacaactaagcaaaaggaaacttaaatttgtggactggtgacaagtgagagatggcgtgctgctgcttgtgtggctggaacgacgtggtactgtcatagaagctcgaacg

SEQ ID NO: 64699 - DNA, 310 bp, Triticum aestivum
  Clone ID: PAT_TA_64699
tcgtccacgcgtccgcccacgcgtccgcccacgcgtccgcccacgcgtccgcccacgcgtccgcccacgcgttcgcggacgcgtgggcgcggtgacgggggcggacgcgtgggcggtcgcttgtgagaagtcgattgaacattatgatttagagaaagaagaaatcgttgtttgcctggatgaatcccacataccagagacaattcagcgatttttgagtgaatagaatgctgaaataaacttgtactagcatcgaaaatttcggttcattatttgcaggaagttgtgctgatctattatttacagaaac

SEQ ID NO: 64700 - DNA, 243 bp, Triticum aestivum
  Clone ID: PAT_TA_64700
ttgttgacgcgtacggccacgcctgcgcgcagcgcgtacgatcacgcattcggccacgcgtacgcccacgcgttcggtgaatgtaaaggttactagtacagcctagtgaaaaaataaaaaaaaaaaaaaaataaataaaaaaaaaaaaaaaaaaaaaaaaaaaaaaaaaaaaaaaaaaaaaaaaaaaaaaaaaaagaaaaaaaaaaaaaaaaaaaaaaaaaaaaaaaagggggggggcggttt

SEQ ID NO: 64701 - DNA, 327 bp, Triticum aestivum
  Clone ID: PAT_TA_64701
tcgattcgaaaaggccaagatcgtgcaggagaattggtagcaaataaatgaaacaaagataagattcaaccaaccatgtgctcccaggagaatgctcttctctcttatgatggatcctccatgcatttctttgtacatagcagcattcccttttcttgtttgtaaaactactactgccagtctgttggtgttatttccatgccatttgtaatttgttctttgaaatggtttgtgatttgttttgtggggagacagaattatcctcatttgtgtgggagccattttctcattggtcataaataaaatggatggtttaccaaaatagaa

SEQ ID NO: 64702 - DNA, 208 bp, Triticum aestivum
  Clone ID: PAT_TA_64702
ttgtccacgcgtccgctcccgaaaactttatggggcgattttaagccacatggacgccttgctccagagtgctacaactatgttgctgataaaacttacgtgtcgcgcaattgtagaaaccattgtcatcattacagataggaataataatgggacctaagttaaccgttattactgcacaattaactggatatttgataagctttcc

SEQ ID NO: 64703 - DNA, 383 bp, Triticum aestivum
  Clone ID: PAT_TA_64703
tttggtataatggggctgaccatctcgtgcgtgtgcacgagctgggtgggcgtgacgatgctgacaggaggcgggcggggagcatggccatggccacgctgaccgtgctgacgctgatgaacttcaagatacaacgcagagacatccgggaccacatgacattggctagcaaaggccttcatggcacaagcacgggtgaacaggcccgcagatggtcggagtactgtcagacttgcaaacatatatgctaccagattgatcgccgtatatttaggccggggctgaagatctctactatgccgctcctcagggtggaacgggtcacggaccacttccggatgttcgtggaccgggagctcactctggcgcactgctacacactg

SEQ ID NO: 64704 - DNA, 384 bp, Triticum aestivum
  Clone ID: PAT_TA_64704
tcggtggaatgaggcctatgagtttacttggctggaatgccacggtgatgcatgtttggcaaattgctcttgtcctgaccacatggcaccatggagcatggctgacaaattactgtaaaccccctgctgattaagcggcggacatgattttaatgctaaaatattaagtgctgcatccaatagccgcaattgtattacagtgtactgtttggtaaatctcatgcgccagttttttgtccaagagttcacatgcatgctgaacaatagcatttgtggaagggtagaatgcagtatggttagcattgagatggtgtgagcactgagcacaaatgttgatgtagtcttcctcatgcggatttgctgcctgaatccaggtgaactctt

SEQ ID NO: 64705 - DNA, 501 bp, Triticum aestivum
  unsure (1)..(501): unsure at all n locations
  Clone ID: PAT_TA_64705
ttgatcgcgagcgggcagctcaatgtgggtgtgggtggtttctggtggccggcttggagctgcaactggaggagcccatctctgcggtcaccctccccaacgcccacgccactccgtccagtccgcccatccacaaggaggaagaccgccgcttgccaggtgagtccgcaattttcttctccatccccggccgtatccgtatggctggctgctctcaagtctcaacacaccaacgacctcgagcagcgaccgtctgcctggtcccagcatcaagttctcgatgactccggccatggccggctcgccgtacatgcacttcttctccgctgctgagaggacaggcggaaggctccgtcatgttcgttccctgttacgacaaccccgtcatgtacgacatcgacatggagtccgtcgccggcgtgcccctgcccagctttcccaagcagagcgactccatcttcctgtccatggccgactccgtcgaggtgtngaactacagga

SEQ ID NO: 64706 - DNA, 508 bp, Triticum aestivum
  Clone ID: PAT_TA_64706
tttttgcggacgcgtgggcaagcagctggtggggggcgacgtgttcgtgttcccacaggggctcatccacttccaggtgaacaacggcaaggtgcccgccgtggccatcgcggcgctcagcagccaggacgccggcgtgatcaccatcgccaacgccgtcttcgggtcaacgccgcccatcagtgacctcatcctcgccaaggccttcatgaccgagaaggacaccgtcgactggatccaggccaagttcgcgccggccatgagcggcaacagcagcatgggaggaggcggctacgacatgccgcccggcggcggcgagggcgaaggcggcaacagcaccggcggcggtggcgggtactaccctggcatgcgcaagcggaagccctaagcacggacaggacggccggccatccacgcgcttatactaataattaatgaataatttaagtacaagtaaacaaagaaaacatgcatcaaaccagtacttagtacttactactggcttaat

SEQ ID NO: 64707 - DNA, 154 bp, Triticum aestivum
  Clone ID: PAT_TA_64707
tgctgagtttgttcagttgataagttgctggggtggttttataaacattttgggtaaaccacccccaaaaaaaaagggaacactgtcttataaggtcgggccgttctttcgggtccccgctacctttctcggcgtcggtggggtcgcctccttt

SEQ ID NO: 64708 - DNA, 400 bp, Triticum aestivum
  Clone ID: PAT_TA_64708
tttgttattatcactggctgtaggtatcactattgctgttggtgtagtcggttacatacaggagaaccttggctggggaattgggtttggcatgctctgcgccatcatgctcggtgccttagttgtcttcttccttggcacccctacataccgcctctatgcacccactcccggtgctgagaacccctttgccctccttgctcgtagccttgccgcgctagcccaacatgacaatgccacttcgagctcattgcttggttacaaaaaagaataccaggtagaacaaaaagaggatgcggtaaaaaaggaggaggcgcgtggcgtggtacggttgctgtcaatctgggcggcgtgcctggcatatggtgtggtgtttgcgcagtttatgacactcttttac

SEQ ID NO: 64709 - DNA, 494 bp, Triticum aestivum
  Clone ID: PAT_TA_64709
tttcattaacgcagcacactcgcataccaggaaaccgaaacgcatcaaggctaggcgccgctgaccatggacaggatcttggctttctcgatcctcagctcctcgcccgcggacatcccgggtgccggctacagcacgcccacgcgcctttcctggaggggtggcagcggggagcagccggagaaagcggcggacaagcatcggcaggaggagaaggtcaaccagggctctcggccggagaagaagccggaggtgcggttcgccccggagttcgacggcatcaactgcttcgagtccatcatctccttttgagcggctgatccgctgttgtctcgggatagttatcgagcttcatatctatttttgctggttgcttaattagtgatgatgagacatgtatttctcaaaaagaaaatgtaaatatttgggcccgggcgacggccgaagctttcggccggtcttatgcgcgacgcccgatttagtgggatcgtgcg

SEQ ID NO: 64710 - DNA, 448 bp, Triticum aestivum
  Clone ID: PAT_TA_64710
ttgttttttttttttgtgtcatatattatgcctcagccaacgaacagcaaaataaattaaatgtcactgacgaaaagaaaagaaaaaagaaaactatatatgatttcttctaagccaggcaggccattctctctgaatctgcttttgcggtgcagaagctccgtgttcagggagatgaagaaataccagatgggtttttctagctggtgcggtgagtgccagcgtgaaaagagagaaaggcagattcagtgcgtcaaagcgaccaagcatttcttaggggtgctggaggggcaatgatttaagtcatatttactgcatgtattttatgcaatcctgtattatattaaacatcctttgatcatttggaaacgtctagtataactgttgtccaatttccagctcgtattttgtcagtgtcattgcatcttatgtaaatctgaacttttct

SEQ ID NO: 64711 - DNA, 236 bp, Triticum aestivum
  Clone ID: PAT_TA_64711
tttgtttctcaacaggcaaaaggacatcaagactggaaagtactcccaactgctctccaacggtcttgacaacatgctacgtgaagatcttgaacgcctgaagaagattcgtgcccaccgtggtcttcgtcactactggggtctccgtgtgcgtggtcaacacaccaagacaaccggccgcaagggtcgtaccgtcggtgtatcgaagaagaaataagggcttgggcaacgacaat

SEQ ID NO: 64712 - DNA, 253 bp, Triticum aestivum
  Clone ID: PAT_TA_64712
atttggtttcctccgtgcagccgactcaaaagtaagctaggatacgggctctaacgcactggctggaagagaacccttatgagtgcatcaatgcacggcaggaggcagcatgatgatgaggagccattgttactttacggaggactccatcacaaaagatcaactgagatgcacgcgtgcgggcgatgagagaacaacggaaccgcgaaagcagcctgacgtggagaagaaaagcaacggccctatgcgtggc

SEQ ID NO: 64713 - DNA, 354 bp, Triticum aestivum
  Clone ID: PAT_TA_64713
cttggttaccaccggagaaccacctccgatgctcacaacgagggaggcaggagccccgacgccgccggacagagaccgacaagatctccgcccaacagccggacgcagcaaggcgccacggcgccacgggagacagggaggagaacccaagacagaacgacaccggagaggaggacgaagcgcacgaggagaacaaagaagacgaggaggaagacgaactgccaccaaagaaaaaccggcgcaccgcgtgggccaacagaagaggaggccgatgacacgaagccgaagctagggaccggccggcgctacacaaaggactaactgggaaaaccccgcagcatccaaacggaaata

SEQ ID NO: 64714 - DNA, 202 bp, Triticum aestivum
  Clone ID: PAT_TA_64714
tttcttcccacgcgtccgcaagtgcaggtggcacgcatagctattgactcggagctaggtacataaccatggccatgggttctgtctgctcgagttcacaggtagtgatcgtggctctcgccacggaagtatacatgcacgctgtagctactgatgacgacacggatggccccatggactctgactccaaaaagagcagtgt

SEQ ID NO: 64715 - DNA, 440 bp, Triticum aestivum
  Clone ID: PAT_TA_64715
ttgtttttgtacacctccatttcattatccggggagctcattatctaattcacggcaacattcgcatgtttaccactactagtcatattcttgtgtggaccaacacgtagtctgctacgatacgttggctcttggctgtcaccatgatatggacatgatatgcagagcgacattgtgcatggccattttcaactgctacttcctccgttgttttagtctgcatataaaatctggtcaaagtcaaacttagtaaagtttgatcaactttgtagaaaaaaaaattaatatctataatacatcatatagtatgaaaattaatttcatgatgcatctaatattattgatttcatattgtgaatcttgatatttattttctataaatttagtcaaagttaacaaagtttaattttgacccaattttatatgcagactaaaaagaa

SEQ ID NO: 64716 - DNA, 470 bp, Triticum aestivum
  Clone ID: PAT_TA_64716
attttagtctgactactgacacatacacacacacacaagtgctagctagctaatcgatcaggcagccatgtcggaggagaagcaccaccacctgttacaccacatggagggcgaggacttccagcccgccgctgactgcggcgtctacacgtacgggtactcgaccgttacggtggtgaccgtcaccggcaaccacagcgagtacgagcggatcaccaaggaggagaagcaccacacgcacactgagcacctcagcgagatgggcgcagcctggggcggagccttctacctctacgagaagcacgaggcgaacaaggacccggagcacgcgcacaagcacaagatcgaggaggaggtggttgccgacatagccgtcggcgccggcggcttcgtcttccacgagcaccacgagatgaagcatgaccacatggaggccaaggaggccagcggcgagaagaagcaccaccact

SEQ ID NO: 64717 - DNA, 464 bp, Triticum aestivum
  Clone ID: PAT_TA_64717
ttttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaggggccccagttttcctccccggggacgcccccaaaattctttttttttggggcccccaaattaaaactatgggcccccttttttccaccttggggttgggaaaacccgggggttcccccacttaaatggcttggggacccccccccttttcccggggggggatatatcaaaaggggcccccccaattcccctttccaaaatttgtcccccctcttatgggttatggggcccccccttttatggggccttttagccggggggggggggtggttccccccagtggtcccctt

SEQ ID NO: 64718 - DNA, 298 bp, Triticum aestivum
  Clone ID: PAT_TA_64718
actttgtttacaccgcagatatgccacccgtgttcaccctgattaccacgagagatattttgttcgtcccgtccacctactaacggcatataaaagcagaggggatcatgaacaccattgcgatgtcattgcttatctctgacggaccccttttcatacgatgagctgtctggacggctgcggtctactggtgcacatgttggcagctgtttaagaccaccggctgcgaacgagaaactggttctccgcgtagcagatctacaagaagctcttgctcacacctaggcctaaactatgg

SEQ ID NO: 64719 - DNA, 524 bp, Triticum aestivum
  Clone ID: PAT_TA_64719
tcttttttccacgcgtccgcccacgcgtccgatggacatggggaggaacactgtgacgacagggatccgtgggacaatgggccacatagctcccgagtactttaagaccgggaggccatcagtgaagacggacatatttggatatggtgttatgttattagagattgtgacaggcgagcgtgcaattttccccgatttcctcgaaggagctggcgaggtcatgctcatcgatcaagtgaaactgttgatgcaagaagggcgattggaagaaatcgtagaccgcaatataggctgtggatatgactttcaagaactagtaaaaattatccaagtagcactcctctgcaccaatattgacccttgtcaacgccctgctatgtcggaagttgtgcatatgctggaagaaaaaattgtgccagaagatcagtgggaggagtggcagcaagctgagcttacccgtcgacagcagtacgaatataagcagcaccacatattattcaccttcagtgaggagtcactgaaca

SEQ ID NO: 64720 - DNA, 255 bp, Triticum aestivum
  Clone ID: PAT_TA_64720
tctaaaactaaaatgcgtctagatacatccatttcctcgacaagtatttccggacggagggagtactatatagacgttgtaaagtaccgaagtctttttgtacataaaatttggcaaaagaacatcctcagaattgacgaaaaaataaacaaaaaaaaaataaaatattaaaataaaaaaaaaaaaaaaaataatataaaaaaaaaaatatacataatataaaataataaataatcatatggggggcccctttta

SEQ ID NO: 64721 - DNA, 489 bp, Triticum aestivum
  Clone ID: PAT_TA_64721
tttacttaacctgggcagctctctcctcgttgctccgattgccgccgggaagccaaaggccgccgtccgccgtcatggacccaagctccgagatcgtgtacgacatgcccggcttcatacgcatccacaagagtggccgcgtggagcgcttgcaaggcaccgagaccgtcccgccctccccctccggtgaccccgccaacggcgtcgcctccaaggacgtcgtccttgacccggcggccaacgtctccgcccgtctctacctccccgccgccgccgcggcggagcctggaaagaagttccccgttgtcgtctacttccacggcggcgcgttcgttgtccacacatcggcctcaccgatctaccacaagtacgccgtcttcctcgccgtcgtcgcgcccgccgtcgtcgtctccgtcgactaccgtctcgctccggagcaccccctcccggccgcctatgacgacgccttcgcggtcctccaggcgatcg

SEQ ID NO: 64722 - DNA, 473 bp, Triticum aestivum
  Clone ID: PAT_TA_64722
ttctgtagctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatcttccgt

SEQ ID NO: 64723 - DNA, 123 bp, Triticum aestivum
  Clone ID: PAT_TA_64723
tgtctttctgcggacgtagaaggaatcatttcttgttgataatttcatcaagaccgagcaacggccattcctgacagagccggacagcccctatacctgatgaccgtggtaagaacgaacctc

SEQ ID NO: 64724 - DNA, 214 bp, Triticum aestivum
  Clone ID: PAT_TA_64724
tttccttcgcgtccggacgttgtgtaagactattgctgtttaatgtatggaacttctgtatcgaccgcgcttcctagctttgaatgatcctggggctagtgagccgactagataggaaagcgaggctggattaacaatttgaagccgataatgttgaaacagtgtatgactagctaactatgtacttatatatatatatacaaacaaggatgtt

SEQ ID NO: 64725 - DNA, 229 bp, Triticum aestivum
  Clone ID: PAT_TA_64725
tttctttctcgtgcggacgcttctgctgaaggtaggggtataagagtagaacgaaggatagatactgaacacactaactgaaaattaaacctaggtaaattaaatgagatagtcttaaagatccaaaagatataaaaatatgaaaccgagtaaaaagaaaatctggaagacctgattcatattgaataaaaataaaacctaacagagatgaaattctaatccaaacaaa

SEQ ID NO: 64726 - DNA, 500 bp, Triticum aestivum
  Clone ID: PAT_TA_64726
tcacaaagcgcttgaggatgtgaggttttctgtttgtgtctttttttcttcttcttagattcgtttgtttcaaaatgatttatcactcgtaccgcgtgtccaaatgatgaaccgctttcacctttgtgtttctcgcgcctaggttttcaaaactcggtccactttggtaggttttgatgaacagttttctgcaaaatctatgctccaagctgtactaatccatgcttcaaaactgactaaaatgtgcttcaaactatactaaggtgtgcttcactttttttgggacgcacagtcgctttttcacatgagtagcacatgtgtgcttcacacgaaaaaccataataaaagaaccgaagatagaaaaaactgcaaattgaaaattcatttacaattaacatagatcaaaaaaatggaaattaaaaaaccaggtaccataaaaaaatctgaaattcaaagtggagaccaaaaaagctgtaataccagcttttaccctgacactt

SEQ ID NO: 64727 - DNA, 428 bp, Triticum aestivum
  Clone ID: PAT_TA_64727
ttctgttcgcggacgcgtgggcggacgcgtgggcggacgcgtgggcggacgcgtgggcggacgcgtgggcggacgcgtgggccgcggccccaagggcaccggcgagtacgagtgcatcgacctctacgccgtcggcgggggccgcaaggccagcgacatgtacaactcgacggccgaggacgtgctgtacgtgctcaaggagagcagcgacgacgaccggcacgactggtactcgctgggccggtttgacgccgccgtcaacaagtggacgccgatcgacgaggagctggagctcggcgtctggctgcggtacgactggggcaagtactacgcgttcaagtccttctacgaccccgtgaagaagcggcgcgtcgtgtgggcgtacgttggcgagaccgactcggggcgcgccgacattactcaggggt

SEQ ID NO: 64728 - DNA, 407 bp, Triticum aestivum
  Clone ID: PAT_TA_64728
tttcttccacgcgtacgcagggactcgcagcctaacaggcaatcaattgggcagggaaacggaagcttgcatcaaggagcttgtcaagggattaggcatgaaaagtggatttgtatttttatttacttgtttggtttatgatgaaaaaaaaaaaaaaaaatagaaaaaaaaaaaaaaaaaaaaaaacataatgaacaaaaaaaacatataaataaatttaaaaaaaacaaaaaaagaaatagggggcgcccctttttagaggacccaaactaacttcccctcgcatgcaccaacttagtttttttatagggcccccaaaacaaaatgaacgggccggcttttaacatccccaggtctggaaaaaccctggtgatacccaattaatacgcttggaaaataactccctt

SEQ ID NO: 64729 - DNA, 497 bp, Triticum aestivum
  Clone ID: PAT_TA_64729
ttcgttcggcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatccgatcgatctactactaccataccatgtaaccgcaacctgatcgagggcctttatgtacgcacctgacctgcatcagcagtcaggtgccatgccatgattgtaaacaggcccccctaaaataaacctcccttgataact

SEQ ID NO: 64730 - DNA, 274 bp, Triticum aestivum
  Clone ID: PAT_TA_64730
tttcttttgacgcctgggcggacgcgtggggtgtgagccctttgtcagttcacacctttcgacctgttgaggagacttgttagcattgcgatggggcgcgtgaaacaaagattgactggtaaggagcacgaaagattcacccagcgcggcggacgaagagctagatgatctggacaccatcgacacgtggaggcacgacaggctgcgacttgcatatggaccaggactctcatatgcctggtattggctgaggaccattcatcaacatgagtta

SEQ ID NO: 64731 - DNA, 217 bp, Triticum aestivum
  Clone ID: PAT_TA_64731
ttcgttcgcgagcttgtgcatgtcagacagctcaagagagaatccctgataggaaatgtcttgttgcttgtgaaattgtaagatctgcactactgctcattgtggatcatgaacgatgtggcttcacaacagctcctgcgtcagtttcgcacttttttttcgcgaataaatgagattttattgcttaaaaaaaaaaaaaaattaaaataaataaaaa

SEQ ID NO: 64732 - DNA, 134 bp, Triticum aestivum
  Clone ID: PAT_TA_64732
tgatggctaatcaccgataggccctgcccgtcgcgatgacaacaggtgcccaccctggatggcgattgggacgcgccctgatgacgcgcattctgcgcttgggtcggggcggttctcacaacgtgaccctgcac

SEQ ID NO: 64733 - DNA, 375 bp, Triticum aestivum
  Clone ID: PAT_TA_64733
ggctcgatgggtggatcaaaacaagcgtggaccattacgcagtcgtgagccatgcccttggtcaggatatttgctaacactgccagttaacaagtgctacagtcacggtcgtcgatgaactatgacagtacgtggtagcttccaggatttactagacacagaaaagcacatgaatgctctgtaagcgtcaacaagaccctgctgtcggatttgaggctgcgatggattaacgtgtgctttttgacacactcgtattggaggctctatgaggcacttggccatatttacatatgagtactgatgtattgagaacatgcaaactatgaggaatttctgcatgctgtattacagttagcagcatggtctgattcgctg

SEQ ID NO: 64734 - DNA, 256 bp, Triticum aestivum
  Clone ID: PAT_TA_64734
aggactcgtggggccgagaccaggtgtagggttccccaactcttgttttccacgcaagccagcgagagcctaccaccagtacagatggaggctgcagtgccagcggacgcgaaggcagcggctgccacgagggaccttctctcggacgacaaccagttcgtggagttcgagctcggcgagtaatgcgatcacacggaagatcgcgacgaagctggccagcaaggggaggatgactgggattatgacaacgtcaacg

SEQ ID NO: 64735 - DNA, 392 bp, Triticum aestivum
  Clone ID: PAT_TA_64735
ttgttgaatacgagcccagaccaaaaccaagaagacacactgtaggatgcatcagtctgtcctctaactgattcgaccaaccaagactatgatgagctacggagaagatgagcaagctgtggaccatgctgagccacctgcacaccctcgaagggcctggcgtgatgctgctgttcccgctgtatgcgtgggtgcttgcgatggcgagcccgtcgaagctggacgactagcagaggctggcctactggatcctctactcctgtgtcaggcttgtgctgatggtcctcgagtacttcatctactggataccgacctggtacgcgctgaagatactgatcgtggcgtggctggcgactgtcaacttaagggagcggtcttatatacgacaggtt

SEQ ID NO: 64736 - DNA, 239 bp, Triticum aestivum
  unsure (1)..(239): unsure at all n locations
  Clone ID: PAT_TA_64736
ttggcgcggtgctgggggccagctaccacgtggtggtgatcagggtcatcgcttttaagagccgtgactggtccttccaggagctgcgaatggaatctgatcgctgttcatcgtcggtcgatcgattatgtggtggtggaggtggctgctgctgcgcgcgtacgtggatcatctgtctgtcgcgcacgctgtaatatttctncatccgccgtgcatgatctatgatacgtgtgtgtgcc

SEQ ID NO: 64737 - DNA, 301 bp, Triticum aestivum
  Clone ID: PAT_TA_64737
tcgttcacgcgtccgaaaaaaaaaaaaaagagagagaaaatatataagagaaaaaatactagaaataaaggtgaaagaagcacaaaacagcatacatcttgcacatgggatggaacgttcggtctcagctgaagcgtgcactgagaaaatataagcaggccatcaaaaaaggggggggcgcctttcagggttccagggttcaccatgtcgctcggtaagggaattcattttttttagggtggccctgtttatattcacgggggcgtgtttcaaacagctgggtaccggaaaaccatcgctg

SEQ ID NO: 64738 - DNA, 284 bp, Triticum aestivum
  Clone ID: PAT_TA_64738
tgcggtccaggtcgctggtgcgctcttcccgatcacccgcaccgtgctcaagtcggagtcggccgtgatcacggacgagatgaaggaggagagcgtcttcgccaagctccgtgttgcccgtgccgatgcccgcatcgtcggcaagcagaagaagcgccttgccgacaaggccgccgccgtcgaataagcgaccgttgcgctgagccgaagcgagtgtcactaggaacttctaacacaccaagctcaatgtggaacaactgttgggtttaaaaaacaacgggtct

SEQ ID NO: 64739 - DNA, 334 bp, Triticum aestivum
  Clone ID: PAT_TA_64739
gaaactttgggcgaccacgggctatccgccgcgtgagatgactaggattgacgcagtactgctgatgctggtggctgacgctgacgagctcgtgctcgcacatgggccgtaactatggacctagagcaccatggccaaggctgtggaggacttcatgacgaaagagcaactaatggccctacaccgtttgctggctcaacaactcaacctggaaggccggcacgccgggacaaatgacgatggtggctctcacggtggccaacctcaacgaggtgcttgatcgacacacaggcctaagcttggcagtgctcatgtggtgacaacactcctactg

SEQ ID NO: 64740 - DNA, 396 bp, Triticum aestivum
  Clone ID: PAT_TA_64740
atgctgctcctgctggtactgccgctgaagtattggcgggtcccacgcgtcttttgggcaccactggttatcctgttcgtgtggaccccatggaggagccagaaccaaacaccctgtgagcaaccccacgattggatagactagagcaggttgtacatgccgggactgccaggccacaatctcatgatggaggagctgactgccttggataaactgagtaaacgtctgtccgtggggggtgcgcaacatgacgcgtcattagaatagccccgtagggaatcgaatttgtcgggcttctaggcgataagcctttggaggggttttcttataggcgacaggggctaggcactggccgtgtaaccaatggcgcggtctgagggaacattggcgcctccc

SEQ ID NO: 64741 - DNA, 362 bp, Triticum aestivum
  Clone ID: PAT_TA_64741
tcggccacccctatggtgcaaattatggtctgggaggtgatcgtggtctaaatcatgcgcgagatcggcgccgaggaagtcgatgctcttgtaccttgacaagatatggccggggttgttgttggtcaccatgaaggacaggtgggactcgcacacgtacaagcagatgacggacttgggctgcgacgggctggggatcaactacttcaagggcaagatccgcggggagatcgtcgaggccctgctggtggtgaccgtgcacaagatgaacggctacccggagaactgagcagtgagggccacatgctatgcgcgagcatggtcatgatgacggtgtttgacaccaaatgtccatcgctaaa

SEQ ID NO: 64742 - DNA, 180 bp, Triticum aestivum
  Clone ID: PAT_TA_64742
tccgctcatacgggggatcataggtaggcctgcttggttgacagattggttggcacactgctcggatcattacgcgggttatcataatgattcagccacagaacgaaatcatgaaccgaattatagccagagacgaagacctagacggaatcctagcttgaaacaaaaggacggaccatc

SEQ ID NO: 64743 - DNA, 341 bp, Triticum aestivum
  unsure (1)..(341): unsure at all n locations
  Clone ID: PAT_TA_64743
tcgggccgcccttttttttttttttttgtgaacccaagttaggagcgagatccaaacacctaattagcaactccacgactggaagtactagatcatatatatacatgccaaacacgccacggctcgatctaattattcagcaactgacacgattgagaaaactatggatcggacggacggcaaggcgaccggcggatgaggcatcatcaccctagccccctaggacttgctcttgccggaggcggaggcggtaggcntccggccccggctcccttgctggcgacgaggtcgtggtcttggttcgtgtagccgtcggcgccctcccaggtgaacttgccgtc

SEQ ID NO: 64744 - DNA, 389 bp, Triticum aestivum
  Clone ID: PAT_TA_64744
tcgggcacgccttcgaacaattatactgcgaaccgacacgaggagtgagttccaaaaacaaaattagtaacgccacgaaaaggatgtgctacatcatgctatatacatgtccggcacaccagggggtaggctaactattgaggacccgagaccattggcaaaactctaaggcccacggccaccgagtcaacccggagctgaggcatgagaaggatagccaggtactacttgatattaccggcagcaaaggcggacgcgccacacagggggccctcgacggcaagaagaacaacgtccttggccagagatagccaatgggatccgttatgtgaacctgatgatgtggacagtatatatgatgcaagattactgtgccatgcgtgcgagct

SEQ ID NO: 64745 - DNA, 436 bp, Triticum aestivum
  Clone ID: PAT_TA_64745
tcgctcacgtctgcagctttgttgttgaggcatacaacaatgtactgttcacccactatcttgttgagcacactgagctagatggactgcttgaaactgaggccatgtatgacaaatgacgccgttgtcttgacattgggggcccaacatacaccagacctaatgggttcgctcctcaggtcatttgatgcactactggttccctgtggtccgatggcgctctcaatgtaaaatagagcgagttgtataccaacctggtacgctacccttggatacactatatgctatactagtatctgccagtgatctcatctgacaaggcttacgatgagcagatatgtgtcgatgtgatcaccaacaacgacttcagcccttgctccatgatggtcaagagtgacacttgccaccgcatgcacatggcctgctgcctcatgta

SEQ ID NO: 64746 - DNA, 395 bp, Triticum aestivum
  Clone ID: PAT_TA_64746
tgggggatgctgccccgcctggaggtactgttgacgaatttcctgggtcgccccacgttttttgatgaatagcggcgacagtcgtcacgtggccagtattcatcaatagccagcaatcatgctgatggataggagggatgaggtttgctccccacaagagtcgttatcatcgtactttgggaagatgcctattttgccgaggatgtcatgaagcacgatgaacttgatgttcttcatcgttctcttgggcaacatctccgccatgatggcggcccgggggccagaaacgaacaaccggtgcatgctgggtcgcaccgtcaggagcatcttgatggacagactgatctagatcgttaattgccgtttacacacaatgggctgattgagaaaaccgt

SEQ ID NO: 64747 - DNA, 235 bp, Triticum aestivum
  Clone ID: PAT_TA_64747
tcgataacaaaaaaaaaaaaaaaaaggagagcacataataaaagcaataaagacacagaatgcagagagacaagaacagatgaggttactagcgaacaagaggcgtcatcatgcgggctccggggtgactacttttttgctgaggagcccacgccgtacgctgacctgattgccctgcggcgctttcttggttaacaagtcggctatgtatgccatgccgtccgggacgatcgaa

SEQ ID NO: 64748 - DNA, 358 bp, Triticum aestivum
  Clone ID: PAT_TA_64748
tgttcgggcgctcgggctggcgcagatggtgggggggctggccggcggcctccactactacgccgcggtgttgcaccgtgccggcgccggcgaggacccgtgcgcgaactggcgcgtctacgccgtgtacgccgcgtgctgagtcatcatctgcgcgtgcgcgcgagctgagaagaggaagaaggtctacctcgccggctgccgaggagtggaagaagagctgagggatgaaagctttttttaggggcttatgtgcaaacattaaatatagtgaaagccaaagggcttggctataagatgggaggagggggtaattagaagatcatggagtacaagaagagaaaggaaaactattctt

SEQ ID NO: 64749 - DNA, 369 bp, Triticum aestivum
  Clone ID: PAT_TA_64749
ttgtttatacgtccgggtgaccggaggcggggtgggtgcggttacttcgactcgcccacaagatcgggcccatcggcctttcctccaagaagatcagggaggacatcgtcaaggagacggacaaggactggaagggcctccgcgtcaccgcacaagctgaccgtacagaaccgtgaggccaaggtgtccgtcgtcccttcagtcgcggtgctcgtcatcagagtgcctcaaggagcccgctagggacaggaagaaggtgaagaacatcaagcacaacggcaacatcagcctggacgacactcatcgagatcagcaagatcatgaagtccaggtccatgggcaacgagatggccgggactgtcaaggaga

SEQ ID NO: 64750 - DNA, 291 bp, Triticum aestivum
  Clone ID: PAT_TA_64750
tcgttaagatcgacaggtgatccggtagggggctggatgctctatccaagttcacgtacaacggtgacggtcgtctcggctagatgatagcgaccacgaccatggttgtggtgaccttcggcacccaccgtcctgttgggcaataccctgtgcgtgacaagagacaaacggttgctgttcgtgccattaagggcctgtagaagaatgaccacaccggcgccaaggataccaaggctgatctgatgaacaaattggctggctattgagccgcatgttgcagtggaccatcat

SEQ ID NO: 64751 - DNA, 370 bp, Triticum aestivum
  Clone ID: PAT_TA_64751
gtgctttgcctacatcgtgacgctgggcatggggggggcatacatggtcgggctcaacaggtggcggacggccatgaccaccgacatcgcgctcgtcgatggttactgtggccacgccgagccatgcttcgttagggcgttctactgggtgctagattagacatacggcatgtgcatgacggagagtgggttcaacaagacggggctgccgggcgccatctggtactaaaggtcgccctactacaaggtgggcagcgtactgagcataatggtgctctccgccatcatcgctcttgtcgccaacctctccttcaacgtgccagcagtgctactgatggggaacgaggtggggaccgctgtggctctgatc

SEQ ID NO: 64752 - DNA, 294 bp, Triticum aestivum
  Clone ID: PAT_TA_64752
ttgtttgtgactactggcgaaccgtcacaggagaacattattggccaagcaggacggcgtgggtcgagaggaagcgctgatggatgaggctgcgatcaacgtaggtaatcatcgtggtgaaagctcatccttgttttactgcgccagtctggagggatgacgaggtgtttgggctcctgatatgtctgggttgaactgatgctttggggatgcccaccctcgtaacatgaagaacattatctgcttttcttgaaggttggatattcggtttatgaagacatatcgtctattctt

SEQ ID NO: 64753 - DNA, 167 bp, Triticum aestivum
  Clone ID: PAT_TA_64753
ttggtggacacccagagtcggatgtgtgggtggaagaggctggactcgcctcctaatatagtttgaaccgaccctatatagatatatctgtgtcaggtaagaaagatcatggaaagatagggtcatcacggttgtggggtggatccgatgacgaaagaagagctgat

SEQ ID NO: 64754 - DNA, 391 bp, Triticum aestivum
  Clone ID: PAT_TA_64754
tcggtaacaactagaaacccacacgcgcgagaggaccataaaacaaacataaccagaagtcacatggccacgtccatgatgaccgacagaacgcacaacttaccgggtcggcggctctcagggttcctagattccttgcgctggagtgcatggctaatagctgaactatagggccacctctaacaaatgcacggacagcggtacccagcaatacggctgggaaagccatggggtgaccaaacttaaatggtttgccatctatccgaggatctccatttcgcgagaactcatataggccatacacgatcgtcttaaccaacattggcacggcaaaaccggggattggaacaccccttgtcgagggacatataccccgtccgtcaggtgggtt

SEQ ID NO: 64755 - DNA, 197 bp, Triticum aestivum
  Clone ID: PAT_TA_64755
ttggtgagcgagagagagcaagtgtgcgcgttggcgaaggcgaaggcgaatgctaatatggtgttgaccgcaactggggaggtctttttagagcatccaaagtgacggacgcacgcttgggacgtcatccatctgctatagggtactctaagtcaaatgaactgcttggctgtctcaactatctagacttggcaaaa

SEQ ID NO: 64756 - DNA, 485 bp, Triticum aestivum
  Clone ID: PAT_TA_64756
ttgtggacgcgtgggcacgaaccaacccaggcgctcatacatagtcagtcagcctttgcaaccatgaggccacacgtgctgctcgccgcgctggccgacgtggtcatactaacagcagctgttgccctcgcccacgggcaaggggcgaccccaagcgcctcgccgtgctgcaacaactgtggcacctgcaccaggaacatcccggccaggtgcacgtgcatggacccgtagacaagcggctgctacccggcctgcaagacctgcgacaagttcaccgtcgccggccaagacagctttcagtgcaaggaccgtgtagccaacttctggcagcacagctgcactaacgccgcgtgactcgacctgttgataccagaataatgccagttagcttgagcttttactgtgcttctcgcagtatttgagagaaccctctgcatctcgctatggtagctagatgcagagacgatatggagttggatgcatgc

SEQ ID NO: 64757 - DNA, 389 bp, Triticum aestivum
  Clone ID: PAT_TA_64757
gacgaacccgacaggtatgttattctgggcaaccatcatgatgcgtggacatttgtggcagctgacccaaacaggggaacggccgccttgcttgagctagcatagaggttgtctgagctacaaaacatgggttggagaccttgtcgaaccatgattttgtgtaattgggatgctgaatagtacggcttgataggttccacataatgggttgaagagaacagggcaatgctaactctcagaactgatgcttacctgaatgtagatgttggcgcgggtgcttctggagttgacgcatcaggcactcatcaacttgatgagttgctcaagcaggcgagtaaaaaggatcaaaatccggataatggaacagttagtctgtatgactcgtggat

SEQ ID NO: 64758 - DNA, 236 bp, Triticum aestivum
  Clone ID: PAT_TA_64758
tctcttatgccaccactccatatcgctgcgagtgggagccatgagacaaacagccacgtgctggctggtgggggaccctgatgagcatatgcacatacaagtggcgcatgatggatcactgggggcgttgataaatactctacgtcctcttccaaatgaatgacatgactggcggctagtcttcatattatggcaacttaaccgaaaattactgctgaccgggtcagaaagaagaa

SEQ ID NO: 64759 - DNA, 365 bp, Triticum aestivum
  Clone ID: PAT_TA_64759
ttgctcacccagtcgacacagagcgagtcctcaaccatggcaagcacgccagacgagctgctggagggtcggcgtgagatcgccatgtgattccatggggcctgattatggatggtggccgatgttgccgtggttgagcccagtcactgactaatgaatatctttcagcgctctcttgggcgccatcacaacaatgtcatcgtgacgggggcctgaaccggacgaacgaagcaagctcgctcgcacggcctctacctgtaggactggatagactgcactcggtcttcaacttgcccttccactcactgggacactacagcgtctggtgctctgcagcggcgtcgcaacatattcaccacatgcaa

SEQ ID NO: 64760 - DNA, 272 bp, Triticum aestivum
  Clone ID: PAT_TA_64760
ttcttaaaaacaaaaaaaaaaaaaaagtgagaaaaaaatgattaaaacaacaccgataattctgaatgaatgaacctgatgagtttgtgttcgttacaactggcgtaagtatggtctttaggggccattgatactttgagggggggggcctgttttagggataccatgtttgccccccttcgcttgctgggtgaacatctttttttggggtgcccaacttaaaatgacgggggcggtttttgtcatccttgtggtggggaaaacccgggggg

SEQ ID NO: 64761 - DNA, 388 bp, Triticum aestivum
  Clone ID: PAT_TA_64761
tgttgacgccgccttacaagatgttcaaccagacgctgctggatctgggactgcaggtcactcctgtcaacgactatctgtacgagacggtgcatagcctgcacgaaaaggggcacctgccggtgcaccggaaagatgtcctcccagaggcactggacagccaacagcgcgaaggtgctggagcaacaacgcgggtcacgttaagctgtatcgctgcgggacatcgaacgtggtccgtctggggatacattctatctaatatagtgttgtttaagtgaactacacaaattggttatgtgtcggcttagatggacggcacttaaaagtgagctctcgcaaactattcattggctttgttgccaggacttcttttttattgatgcagtgt

SEQ ID NO: 64762 - DNA, 381 bp, Triticum aestivum
  Clone ID: PAT_TA_64762
tcggcggcccaggcatagccggctcgtgcgttcatacctatgcataatccacctctgtggctactgaatcgcctgttctatacgaacaatcctcgagatgcttaggcatgacctgctcctgatattgcaaaattgcaactgagaatatatcgatcaactgacagcttgggcgcatcatcttgtttgcatagctgcgcaactgatgacttacatctgtcgttacgaatagaagattccacgatgggatggctacaaacttaaggtccacttgactataagagacacaacatagacattgtacaatgtataacattgcccagattgcccaacaccactggtggggggacttggagctgaccccttacgaaaacatttcttcga

SEQ ID NO: 64763 - DNA, 325 bp, Triticum aestivum
  Clone ID: PAT_TA_64763
tcgcccacgcgtccgttcgacttccgccggccgcagcaaccgaagccaagtttcgaagtcgccgccgaggaggagcaggcgaccagacgccatggcccgtaccaagcagaccgcccgcaggtccaccggcggcatggcgccccgtacgcagctcgccaccaaggcggacaggaagttggcgcctaccaccggcggcgtgaagaagccccaccgctgcaggcccgggaccgtcgtcctgcgggagatccgcaagtaccagaagagcacggagctgctgatccgcacgctgccctttcagcgcctggtgagggagatcgcccaagac

SEQ ID NO: 64764 - DNA, 126 bp, Triticum aestivum
  Clone ID: PAT_TA_64764
atgccacgcactccaatcgctctgagggggggtgttgggacaaaaatccatgtgctgcatcgtgtggtgctctgacgagcacattcatacacatgttgtgcctgtatttataactggatgcgttga

SEQ ID NO: 64765 - DNA, 328 bp, Triticum aestivum
  Clone ID: PAT_TA_64765
tcggtgaccaccgggtggcctcaacgtgagcgtaccatgtttcaggcggtagcgatgctgctgctgactgacccagataagttgctgttcgtacaactggcgggactacggcccttgggggccatggtttatttgcgccggagtacatgatcaaagatgaactgatggaccccctaatcaagctgattgaacagctgaacccagatgtgagactggcggagactgactgaagaactagcatcttcctgtggcagaacaatcataggatgctagatgacgcgatgactaaaataggcactaaccttcggtttacaacatagtgactgat

SEQ ID NO: 64766 - DNA, 477 bp, Triticum aestivum
  Clone ID: PAT_TA_64766
ttttatccccaaatcgcaagatcaaaccctagactcgccccacagtttcttctaggtcgtcccaaatcggagaagatagaagcctaggtatcgaagatggcagatccagtagcggatccagctgctctgccaatcgtgccttgtccggattgcggcaggaacgtggtgacctacgttgctaggcgtgggcagaacgccggtcagcgtttctacaagtgccggaatcacaacccttcagcgggcggatgcgatttctacaggtggcagcaaggctatgtggcgcatctcgccaatcttgaaggaggagaagctgctgtgggtcaaatcggtccgggtcagacgcagggtgggcaagcggtccaagctcaagttgtgcaggcgctacacggccagcccgtgcagcaaaatgggccgccggaggcgtcgcaggctgcatcgtttgcaagtgctgtcgcaggatatatgctcgcggctgct

SEQ ID NO: 64767 - DNA, 381 bp, Triticum aestivum
  Clone ID: PAT_TA_64767
tttctctccatctcactcactctctgcctccgccgctggtgcagcgtcctccccgcgactccgatggccagcaagtgggtcaggcccgaggtgtacccgctgttggtggcgacgggcagtggccatcggcatctgcgcctttagcctctcttggcaacatcaccggcgacccagaagtcatgatcaacaagatggggagggcagcgggagtgcttgagaaccatgaggagggcaggcgctacgcctagcacggactaagagcctatgtgcaggacaagacctgcgagatcatgccaggaatcaacatgttctctaccaggccagagtgaagcactttagtggtgctgtgactgctaattagtaactggtgtgggcaagtgc

SEQ ID NO: 64768 - DNA, 440 bp, Triticum aestivum
  Clone ID: PAT_TA_64768
ttgcccacgcgtacgtgttaatctcatttttgttggaatgctagtaaccggaatgtacagtttgaagtacataaatgttgccatggtgacgatattgaagaacatgacaaacattttaacggctgtaggggagatatatgttttcaggaagtgtcagaacaaacaggtttgggctgccttatgcatgatgattatattagctggcagcggtggtatgacagatctttctttccatttaatcggttacgcgtggcagattttgaattgctttctgacagcagactattacgttacactgagacgcctgatggacacagtcaaacaatcaactgaattgggttttgtcaatgaagtttctatggtgttacttaacaatggggtctacatccctttcgaggacattttgattattgtcttgaaccagtgggaatacgtgtacc

SEQ ID NO: 64769 - DNA, 353 bp, Triticum aestivum
  Clone ID: PAT_TA_64769
gggaaacacgaatttttgggcgaccacaggcaagacggacagagagagcactaagaagcaggcagcaccgcagaagcggccggacgacacggaggagtaaagcggccgaacaaccggagaaaagagggcacccccgaggccaatggaaaacagaggaggagagcgggacaaaagaagcacagagcgcccgcctccagaagaagggggaacaacagaaccgagaagacacgactgacggcgacgaaagaagaacgggagcgccgagaggcagacccgaaagaggagcacgaagacacgaggacaaagcaaggcacgggccggaagcagacaacgacacgagagagaaaacccag

SEQ ID NO: 64770 - DNA, 285 bp, Triticum aestivum
  Clone ID: PAT_TA_64770
ttcatatcaaaatacgcgcggtctggactacagccgttgctccaaggcgcatgtaaatgaatattcacgtacacgatctgccgggagtcggccttgagcggctaacggacgatcagtggccggatacgcacactggggacgaagaacggagcacaatactacatgcgagtgggatggcgcacacgtagtcggcagctgataccgtctggacgtggaacagccgatacggaccgaccgattcaactgagcgatcactgacatggagcttatctgtatctatttgga

SEQ ID NO: 64771 - DNA, 300 bp, Triticum aestivum
  Clone ID: PAT_TA_64771
ttgtttacgagcagtgcgcctcgctctgctgcggagactgttcatcaagctgtggcgtttctgctgccagacaggcttgagaagtagcgttagaacctccggccatatggtggctgcttcgatggcgatcaataggagcaaggacgagaagacgaacgagtacgaccagaggctctctcagcttgttgggggaaacaccaaggcgcgtattaccgacgacgacgacgaaagaacaaatgatcctcaggggagccgcaagggacgaggaggctgatgcaacgagctcatgggcaagaacat

SEQ ID NO: 64772 - DNA, 429 bp, Triticum aestivum
  Clone ID: PAT_TA_64772
ttggtctcctccgaacgtcacgctccgtccgtgcgcgttcaaggccatcaacgccatccgcgcgctcctgcagagggcgtgcggtgggcccgtggtctactgcgccgacatcggcgcgctcgccgtccgcgactcctgccacctggccggtgggccaaggtacgccgtaccgctcggtcgccgcgacgggctaacccccgcgtccctggacaccatcttgggcgcgctaacgccgacgacctccaaggtccacgtgctcctcagcttcctggccaagatcggactcgacgcctacgacctggtggcgctgtccggtgcgcacacgctggggatcgcgcactgcggctccttcgaggagcggctgtctcccaaggaggaccccaccatgaacaagtgggtgcgacggccacctcaagctcacctgcccgc

SEQ ID NO: 64773 - DNA, 249 bp, Triticum aestivum
  Clone ID: PAT_TA_64773
ttgttttcctccgaacgtcacgctccgcccgtgcgcgttcaaggccatcaacgccctctgcccgctcctgcagagggcgtgcggtgggcctgcggtctgctgggcccacatcggcgctctggtggtctgccactcctgccacgtgggccatgggccaagatccgctggaccgatgggtctccgcgaggggctaacacccgcatccctggacaccatttgtgggcgcgctaacgccgacgacctccaagg

SEQ ID NO: 64774 - DNA, 267 bp, Triticum aestivum
  Clone ID: PAT_TA_64774
tgttctaaaccgcgaacagagagctcgctcgacgtgaatgatgtcgaggcagaggcggacgatgaagaagagaggggcacgctgctgctacctggtcacgctctcagcagcgtgaattaccagatgccatgcttgccgggcctttttccgggtgcaccgcacgctgccatgagagcagggttgctctagagacgcacaaaaaaaaaggcaagtatgatacacaagggaaggctactgctttattccaagtgtaaatggatgcatata

SEQ ID NO: 64775 - DNA, 467 bp, Triticum aestivum
  Clone ID: PAT_TA_64775
tctttccttactttttttttttggaaagaaaccaagcaacaaagcatttctcattgccaacacacgcacacgcatacactctcgaccgatcgatccagctctccaacaaattttacagggtcgtgatttaactagcggatgctctccttttcggagtacgtacgtagtaagactagtagtagcagagtgatcctgattatacttgagctagctgccgcatggcatttctcatcacggtgcgcgccaaaaagaagaagaagcagctggaacgaatgagcatcacacatctgagcgccatgcgtcgcggccgatcgaaatttcgcgggaacgtgggcgtgggggcgagcagaacagagcgggaacagaggagccaccgacgggctggctcacatgaatctcgggccggccgatgtggtggccgccgcggtggtcgacaccatcatcatgcgcgcgaagtcctggaagcc

SEQ ID NO: 64776 - DNA, 434 bp, Triticum aestivum
  Clone ID: PAT_TA_64776
tcgttcacgcgtccgcatacacggtgtactattgccacaccgtcaaccctacctccgcgtacacggtcacccttgagagcgtggatggcgcaatggcgccagaggtgatggaggctctagccgtgtgccaccttgacacgctgcggaggagcccgaagaacccgatctttgagctgcacaccctgaagccgggggatgtcgacgtgagccattagcttactaagctcaacatcatctgggtgcgtgcaggtgagcagggtgacacacatgcgggaggccattagaagaggatacacgtgcacctgtgtgggctgattgtgtgagccgtgacacatacatcggaccatgatatgggtgaatctatgctaactgcgtgatgatgttatgaaataagtggtgtgtgtgagttgtcgtatgaactacataatatgtga

SEQ ID NO: 64777 - DNA, 160 bp, Triticum aestivum
  Clone ID: PAT_TA_64777
ccctctttttctatatatgtacacaaacatatccacggggtggtttgactacagtctgcttgcagtgcatgcactcctgtgtgctggtactggactacttcttctgtgcagccgttgatggcgcatgagtatagttgtaacttgtgaatgcgcgaacttc

SEQ ID NO: 64778 - DNA, 418 bp, Triticum aestivum
  Clone ID: PAT_TA_64778
ttgctgacgcgtgggcagacgcgtgggcggacgcctgggccgcaatctacgtttgatactacgtccaccccaagtgccccaggggctgtgtcggcgtgccgagtggtgtctacgagccccggaatgtggcgctgcgcggatatgaaattcaccgtcgacggcacctgcggtgggccctgcatgaagtactgacaggctcatgccagcatgatatgtaccgcctaaaatgaaataaaagctcacacgagaagagcagcgtcatggtgcctatgcgtgtgtgagtggtcaacaaatatgtataccagtatgccgtgtctttgtagatgtgtcatctatctcgagaaaaagttggtgttgcttgctgttcacatatccggaatatacttcgtgaataagttatgattgtacgtgggcggcc

SEQ ID NO: 64779 - DNA, 227 bp, Triticum aestivum
  Clone ID: PAT_TA_64779
ttttgaccacggctgggaccaacagtcaggactggttttctgggaactttgggtttgggtcccccgggatgccagcaaatgggtccacacccggacgtgctaacaagagcgcatgcacccttacctcttttaccatggcctcttaatcaagcaaagagtacgaatttgcctcattaacgcaaggaatgtagtcgaagcgatgaatggctttgaatacttggagatgg

SEQ ID NO: 64780 - DNA, 258 bp, Triticum aestivum
  Clone ID: PAT_TA_64780
ttttgtttccaccggccctcgatggcgttggatcgctgggtctcaacagtacttgccgctgcactcaggaggaacctgctgagataccagacagccatcatgaccactgagggggcgttgatggacatcgattttctaagacgtactcgctgaagatcgatcgcatgaccaggggtggacacttgattatcaaacaacttccctgtaatgttgtagtggaatcaacgaacaaaaatgtgaagcttctgctcgcattgt

SEQ ID NO: 64781 - DNA, 338 bp, Triticum aestivum
  Clone ID: PAT_TA_64781
aaagctggtgcgcctgctggtgccgctccgccataactgccgggtcccacgcctccttttacgcactcgaatacgcgtaacactgcaaccaaaccctgagtgtgaaagctgtctaatcccaacacgtgcttgtccagatcgaacagacctgcaggtgattccacgcggtagcgcctgcgaccccaaatcaactaacctctgggacccctttttctgctaccacttgggctcctgcggcggcaccggcctctttccctaaatacagtgcatcacgcttccggaccgaaagaaaaaaccaacgcgcggaccgactggaaggaaacacctaacgttcacgt

SEQ ID NO: 64782 - DNA, 386 bp, Triticum aestivum
  Clone ID: PAT_TA_64782
tgggtgaccaccgctcttccggcgcggcaggcgactatgttctactcatcaccggtggtgctggtggctggccctgtggagccaacatctggccaacgggaggcatcatggtcctacatgccaacctcaagggtgcggacgtggtcatggcgaacgataaagtgctcgcccttctgctgtcggttggtgaacagctgaacacgcatgactggcacacgcaggacgaaggaacaactgttctctcacatggctagagactgggcgaggacacttgatgacacgaggactaagcttggactgctcgccataaacatccatctggctgggaaaacccagtcgggactccaacagaaacgtcttgcactacatgcagagcatgacagatg

SEQ ID NO: 64783 - DNA, 386 bp, Triticum aestivum
  Clone ID: PAT_TA_64783
tttttcacaccgggacttcgacagcggacctggccttgctctaggactcacactccgatctgcgggcatggccgcggagcgccctggtttcgctgcagccagacggctggcactgtccaggcttctactactgggcgacgggctactcgcggcctgatcgtcggttagcgcccttcggttcgatctggggtccggccacacgaagtgcatctccgacgagatcaagggtggctctatggaccacgggaagtacagttgagggcgaacgcgaccccccctaccccgtcgcacagctacccgaggcgcaccgtgtattcctcaagggggcgttctcttacgggaacagaatgcactactgcgagaacgtgcattcggcgtacttttgc

SEQ ID NO: 64784 - DNA, 170 bp, Triticum aestivum
  Clone ID: PAT_TA_64784
ttttccacgcgtacgcccacgcgtccggtgattgcgtgggggacaaaaagggatgtattattagttgcataaatgttacgtgcacgcttgctctggataaaagatgagttctgtgtctacagtgctgctatatgtagactatagtcaggatagaagaactaattgatggc

SEQ ID NO: 64785 - DNA, 288 bp, Triticum aestivum
  Clone ID: PAT_TA_64785
agctgtttttacaccagaagtcagccgccagagagggcgacgatctaccacacccagtcgatgctgcggactggcccgggggagctgtggttgcccaactgccggacggcatggcccctgcaggccacctgtgtatcatctgccgagtgcacgaggaacagactgaactgcccgcccgcccccggtcgccgtcaggtcaacggacacctcctgttggccggacatggacgatgaagaaactgggggctgcggcagcacaagctggagaggagcctgttgacgctaggc

SEQ ID NO: 64786 - DNA, 440 bp, Triticum aestivum
  Clone ID: PAT_TA_64786
tgttgggggcggcccgcgcatcggaggcgaatcagcgtttgaaccaagccggcgccgccaccatgggtatctcgcgtgactccatgcacaagcgccgggccaccgacgggaagcacacggctctgaggaagaagcgaaagtatgagctcggccgccagccaaccaacactaagctttcaagcaacatgacagcgaggagggtccgtgttcgatgcggtacacgtgaagcggagggctctccggcttgacactggtgacttgtatagggtagtgaggactcgacccagaagacccggccctggatgtggatacagttcgtcaaacaatgagcttgtgaggactcaaacccttgacaagaatgccattgagcaagttgatgctgaccccttaagcagtgggacctgactcattatggagtcgaaatcggtaggcagaagaaa

SEQ ID NO: 64787 - DNA, 329 bp, Triticum aestivum
  Clone ID: PAT_TA_64787
ccttttaaggatgacccccctgcaggtaccgccgcggcggtcctgggtggaccccccccgctgtcgcgtggcaaagtgcggacatcccaatagggctgttgtgccgcaaggttggtgggatatacacgcgatgtccagtctggcaggtgacattgcacaggaagaagaacctccagtcctatgaaatctctgccaagagcaagctacaactttgagaagcccttcctttaccttgctaggaagctggctgggggtcccaacatccacttggtcgaagcttaggcccttaagccctcgagaagtgaccttctacttgggcatgcaaaaac

SEQ ID NO: 64788 - DNA, 181 bp, Triticum aestivum
  Clone ID: PAT_TA_64788
tgctctcggacgcgtgggttcaaatgagaactttgaaggccgaaaaggagacaggtaacttgccatctgagatgcccttaattcagtttgacaacgtggtgaactttctgaaactgctatatatatgctaccttgataaatacaaaaaataggactccaaaggcaatgtatggaaaaattg

SEQ ID NO: 64789 - DNA, 432 bp, Triticum aestivum
  Clone ID: PAT_TA_64789
actgcccacgcgtccgcgacgagcatgtcgacgtccgcgggcgccacgcctgttctgacgaatagctccacgatggcctcgtcgaagaaggcgtccatctcgtcgagcgcgtcccggtgggtgagcgagtcctcgcggcactcgaggatgctgcgcaggccgtagctgtgctctcgatgccggagcgcacgatgacgcggaggaggaaccggagctcgggaggccgaggtgcttgttgcgcaggatcacctcgtcgtcgctctggtggagttcatacagctcaacatctacggctccatgaccacagagagtcatcatctctgctcatgggcagccacgggacatgcatcacgacgtgcttcacaaggaccacgacggagtgagcggagtctgaatcagcaatgtaagcagcgaagagccagctccctgtta

SEQ ID NO: 64790 - DNA, 360 bp, Triticum aestivum
  Clone ID: PAT_TA_64790
ccgggttgccccacgcgtattgggacccccaccggaccagcgcgagggggggccatttagaaacaattgccgttactaccgccggcaggacggcctgaggagagaaggcgaccacagcgggaagcacggcccggcgggggagcgagtgctctggggaggcgaggatgacgagcgaggaacagctgggctcgcgacgccggaggggaggacaacacgaaggaggaagcggagctcgggaggccaaggaggaagtggcgcatgatcacggtagagctgatagaggaggaggaagacaccaggacaaagactggtacaggaccacagagaagaacaacctgacggcaaggacagccacgggac

SEQ ID NO: 64791 - DNA, 391 bp, Triticum aestivum
  Clone ID: PAT_TA_64791
atcgctctcgtcgtgtcttggtcaatgtgtgttctctctcgcgaaaataaacagaaataaaaacaaaaaaaaaggagaaagcctgcagctttccgactgggaaaaccctggaagaacacaagaaaatacccttgaaaagaaataacactacaaacaaataataacaggggggggggcccctttggggtcccaggtttccgccccggggctggcccgaccgtggtttttttttggggcccccaaattccattacacgggccgggtttttccacctccgggccggggaacccctggggttgccccactttaatcgcctgggagaaaatccccttttccccggttggggtattgcagagggggccggcccggttggcccttcctaagagtgggc

SEQ ID NO: 64792 - DNA, 197 bp, Triticum aestivum
  unsure (1)..(197): unsure at all n locations
  Clone ID: PAT_TA_64792
ttctcgcggacgcgtgggcggacgcgtgggattagatcttctttaccctgttgctcgccagaaatgacattgtcctattgccgcagtaattttgatgccatgcccacagggtttgtgaacctgcctagtttgattgtcaagggatgtatgtgttactttcaaaaaaaaaaatacaaaagctaccannccaacaccaa

SEQ ID NO: 64793 - DNA, 319 bp, Triticum aestivum
  Clone ID: PAT_TA_64793
ctcgctgcccaccggcgctacgaaagggtgagggaagctttaaacagtcaacgcggatgctccaaaaagcaggccgcgctaggtgcggatccttacaacggaggtaaatatggccacaaagagaacttggggtgtccctgggggggtccacgattaaggacgtcctgcttgcccacctacacttgttgtttgagcaccttaaccccgattgcaggctgtcggttacccaagacgaactgggggaaccccgggggagaacccacagaatagcttgtggacacaaggcctattatcgcgactggcgataaatctaaaaggc

SEQ ID NO: 64794 - DNA, 289 bp, Triticum aestivum
  Clone ID: PAT_TA_64794
ctcgctgtccgcccgtcttggtcaatgtgttttctctctcgagaaaataaaaaaaataacaaaaaaaaaaaaaccaaaaaaaaaaaaaaggggcggccgttaaaaggaacacaagcttccaaccccgggcatgcaacaaaataactttataatagagaaaccaaaattgggtcccctgcccagaattacccaacttccctaacctggaaaaaccctggcattacccacttaaagggcctgcaaaaaaatacccttttggccagttgtcaaaaaagcaaaaaggggaaaa

SEQ ID NO: 64795 - DNA, 186 bp, Triticum aestivum
  Clone ID: PAT_TA_64795
ggccgccctttttttttttttttttttatacatattaataatagcacatatgctacggacatgggatatggatggaggtgtatactacatccaccgaactaatcgacgctttacaacggtttgactgggaaaacggagtctttaccgaagataaaaaaatcttgcaggacatgccccttgtcaaca

SEQ ID NO: 64796 - DNA, 463 bp, Triticum aestivum
  Clone ID: PAT_TA_64796
atctgattcgggcactggttcttcttcgaggtgttcttttcagttggtgaatattgcagcctttccactgttgccaattgttcggcatccactagtggagtacacctgttgcatccgatgaacgctccagaggaattgttctgattttgtttgccgtccctgacctgagctttgcaacgatgcaggggatactaccgctgcacgcaccgcaaattccaagggatgcgcggcgacgaagcaggtgcagcgcgccgacgaggacccggcgctcttcgacgtgatctaccacggcgagcacacctgcgtccataagacggtggcgaccgcggcggcggccatggcgcagccggcggaggagaacccggatgcgcgtaggcatctgcagaacctgagcacgagcctgacggtgaacaccgagggactcacggcgacggcgggtcatcagggctgcggcaccaccacg

SEQ ID NO: 64797 - DNA, 354 bp, Triticum aestivum
  Clone ID: PAT_TA_64797
tctcgggcctgagtgggctccatctgggggagcaaacattgatgctcaaagcatgtgtgactgagaacacatacagtctatcttaactggctgctgggagacctgcgctgtgagcattcaggaggagaatttctacgtgtctagggggctcgacggaggcctccataccagcttctgccaagacgaagttgcggacgacacgggccgggggtgcgaccaagcgggtgattggtagcacggggcccgtgctcgacggtaaggctttcttgatgagggtgatagtggaccactgcatcgtgcatggctacgcgatgggcgggaagaccacgatgacacccagcgtgtacccgatgg

SEQ ID NO: 64798 - DNA, 185 bp, Triticum aestivum
  Clone ID: PAT_TA_64798
gggcggaaaatccggggggagacacacgctcgggccggcagaggccagccgaccctctgcgggtctcccacactatctcagaccctcccctccccaccagccgactgacagagggagtcaaacaaaggagcatgtgcgagggaaaagaatgctccaaggagcgcaatggggggaccaagggggac

SEQ ID NO: 64799 - DNA, 189 bp, Triticum aestivum
  Clone ID: PAT_TA_64799
gcgtacttttgatgatgtcagagtatacttgcatcacgagcgtatgatctgatggagtcacgcacgggtgcctgtgctagggatttgcatgctccatatccgcctatgctctgcccaaggtgtcctatgtgagactctgtgtgcgcatgactgcctgtgattgctaaatctatttacagtatagacggt

SEQ ID NO: 64800 - DNA, 364 bp, Triticum aestivum
  Clone ID: PAT_TA_64800
tgcttgtcggctcttagtgggctcgatcagggcaatcaaacaatgatcatcaaggcatgtgtgagtgagaaacaattatccatttgaattggctgaattgaacctgagctgcgtgcattcggaaggagaatttatacgtgtctagggggctcgacggaggcctacataccagcttctgccaagacgagttgaaggacgtcacgggccgggggtgtgactaagcggatgaaaggtagcacgcggccagtgctagacggtaaggcttttttgatgagggtgaatttgaaccactgcatcgtgcatggacaacgcgatgggcgggaagaccacgatgacacccaagttattcccgttggaggcctat

SEQ ID NO: 64801 - DNA, 184 bp, Triticum aestivum
  Clone ID: PAT_TA_64801
tgctcggtcctgctctgatccaaacttttactggtagatcaaagtgttcatgtgaacgtggcgaatatctgtgccattgtgacatacaccttatctgaaaaggaaaaattgccctttttcttcaacaaaaagacaaaaaacaaaaaaaaaattacccaacataaacatcttgaaacacaaaact

SEQ ID NO: 64802 - DNA, 348 bp, Triticum aestivum
  Clone ID: PAT_TA_64802
tccgggccaccgctgaaaccaacctctggtgcttgcttatgaagagtacagatcctttgcggatatccagcccactcagacatagggcgacactcatgaggatctatcgcgcttagggttcctccatggtgcctatctgagtcatcggttgatacagtagatattgttttggtaccaggacaggtgtggcaaacgaaagctccaacctaatctgcgcttgttacaagatcgctagattatatatcttgcagcacagtcgaataggctgagcggcaacacgaactggttaggcccctgaaaccctttgtttaagtgatatattgaaagtatgtggacattctgcatgac

SEQ ID NO: 64803 - DNA, 344 bp, Triticum aestivum
  Clone ID: PAT_TA_64803
agctactgcgtcaaccaacctctggtgcatgaatttgaagagtacagacgatgtgcagtatttcagctgacgcagagggagggagacactcatgaatctctatcccggagaggtatgctccaaggtgcctatctgcgtccttggtggatgcagttgatattcttttggtgccaggacaactgtgtcaagcgaaatctatatccgagtctgagttcattgcaggatcgctatcttatatatcttatagcaccgtcggataggactagcagcaccgagactggttaggccgctagaaccatctgtataggtgatatattgaaagtatggaggcattctgcatgcac

SEQ ID NO: 64804 - DNA, 407 bp, Triticum aestivum
  Clone ID: PAT_TA_64804
ggtacggctccggccggacttgctgggccgacccatgcgttttgtttgggtctgcatgtgagattgcggggccgatgttcttgttggctgacgaggttgctcaaaatttaaattacgacgctatgggacagacatatatcatgaccaactggatagccgatgacaactttatatggatgtatatggatggagcacctgtgtgttaccataatgatgcagaatgcacgaagtgatctgattgacggaacacgtggttgtgatcctaagaaaccctgttgggaactggtgggagtcaagagcatttttgcggtaactatgaaaacactgtttgtacagtgggaggctataagactctgggatagacttgagtgagtaggaggcacacatgttgaattgtactgatgctg

SEQ ID NO: 64805 - DNA, 247 bp, Triticum aestivum
  Clone ID: PAT_TA_64805
acggttattttctccaaaacaagaccgagctactcactgacgctctttcgtcggacgcgacggctgtccccataaaggcggatgataacggtgcgaacacatacaactagcatgctttcttgtgagtgaagagccgacagttaattctcggtttcaagaccaacaccaagacgctgggcagccccctggcgatgccaatcatactcgggatacaagtggattcgcctctggaagtctgcgatcgagt

SEQ ID NO: 64806 - DNA, 186 bp, Triticum aestivum
  Clone ID: PAT_TA_64806
ttgttacgcgtgctgccaagcagaacgcctacctgtgcttctgccaatgctggtcatgcaagtacttactttgcttctggtctacaggaagttgccagaatcatgctaacattaaatgcacttgatgtacctgctaagaatctaaatcttaggatcttagaggagcctactgtgtggtaattttgt

SEQ ID NO: 64807 - DNA, 248 bp, Triticum aestivum
  Clone ID: PAT_TA_64807
tccggcctttgcgggtggaccgacgcactgggttagcaatggcatttcgcagcatgagtctagcattgtttgcactgcacctagtgatctgctggctgaccctcatgagttcgcataacaccaagtgggacttttatggccttcacaggccttcgtgtttctgggacggagtccatcacgaaagatgaaccagacagcccggctttgtttgctgaggactgaactgaacagtgcggccgcgattgccg

SEQ ID NO: 64808 - DNA, 404 bp, Triticum aestivum
  Clone ID: PAT_TA_64808
cctacgcgtccgcccacgcgtccgcccacgcgtccgcccacgcgtccggccaagttgttgaactcagtggagaaaacatcaacatcacatacaaacatgatggcactcacatagctgttggaaataaggaggatgagctaaccatagtggatgttcggaagctaaaacccgtccacaaacagaagttcccttacgagattaatgagattgcatggaataaaactggagatttattcttcataactactgggcttggatttgttgaggtggtcaactatccttcccttgatgttgtctgcaaattaaatgcccatacagcagggtgctattgcatagcaatggatccccttgataggtattttgctgttggaagtgcagattcacttggcagtctttggaaatgt

SEQ ID NO: 64809 - DNA, 237 bp, Triticum aestivum
  Clone ID: PAT_TA_64809
ttatttaaaaaaaaaaaaaacaaaaaaaaaccatgatatattaaaaaacaaataaagctgaacaatgaaaaagaaaagaaaaaagaacataaaaatgaagggggggccgttttaaaggacccaagttcacctacccctgcttgcaacacaaaagctttactatagtgccccctaaatctaattaactggacccctttttacaactttgggactggaaaaaccctgggaagacccaat

SEQ ID NO: 64810 - DNA, 126 bp, Triticum aestivum
  Clone ID: PAT_TA_64810
cccctgcgggttccgcgcctgtgttcgcggcccgacccacgcgttttgttccaggcatgcggatcgcgggtggacgatggtttaggtcaggatcgtgacccatggtgcatcaccctgatgagttca

SEQ ID NO: 64811 - DNA, 145 bp, Triticum aestivum
  Clone ID: PAT_TA_64811
agacggttttttgtcatggaccacccagcgcgtgagcatgatatgatttattctagctgcggtgacgaaaatgcatgaatccgaggctggtggaggaaactctgctttgaggagttcacggacatggatgaaggcttttttgatg

SEQ ID NO: 64812 - DNA, 140 bp, Triticum aestivum
  Clone ID: PAT_TA_64812
agggcccgggcctgaacgcctgggtcggcccacccatacacttacttaccaccggacacccggccgactgagctgcagccatagatgacagtacgagcactccgtttgatagcacgctggggatgacccatgagagagat

SEQ ID NO: 64813 - DNA, 218 bp, Triticum aestivum
  Clone ID: PAT_TA_64813
tgattttagtctctctgtgactcgctattagcaactgttgtggtcaagtgcaaacctatttcaagcattcagtactgttgttgcggccatcactcagaggatgtcataaagtacctcttattgaaagaaccatgtgatgtttgatggcttgctaaaaaaactttttgtatcatgagaacctgagttttgtataactaggatctttgtcttctgttatt

SEQ ID NO: 64814 - DNA, 178 bp, Triticum aestivum
  Clone ID: PAT_TA_64814
cggcaccggcccggccttacttcctggacccacccacccgttttcttcgccaggccacactccgggacccggggatccactccgggtatccattagctgacccacgactttcagttgcaccgaaccatgctatgacgccgacgaagagagcatgacccactctaaccagggaggcgag

SEQ ID NO: 64815 - DNA, 260 bp, Triticum aestivum
  Clone ID: PAT_TA_64815
tggtcacgcgtccggtcggagaacacccaccacaatggctacgcccgaggcttactccctcggcgaaaccctagcgaccggagcgctcggtggcggcagacatggccgacgacgactacaatgaagtcgacatggggtactaggatgagcctacagaggctgatattgaggaaggggctgaagaagaccctgagaacaacgaggatgcccctgatgacgtgggagggggtgaaggtcaagaaaaggaacagcgaaagact

SEQ ID NO: 64816 - DNA, 250 bp, Triticum aestivum
  Clone ID: PAT_TA_64816
tgcacggaccgggcactgactttctggatcgacccacgcgtatagttatgacctatatatataatatagaacgtgtgtgattctatccaagatggcgatgaagggccttgaggaagaacacagataaaaagacccaaagaacacacttagggggcggctgttttaaagaatcaaaattctggtgctcgtccagggaaagaaatagttcttttttagggtaacctaaattgattaaattggccgtgtttat

SEQ ID NO: 64817 - DNA, 203 bp, Triticum aestivum
  Clone ID: PAT_TA_64817
atagttatggctgccatgtctatcaacgaccatgttttgctacacatcctgattacgatggctgttccggacgatcttatagacgctggcccatatacaccggggcctgacgtgggcgatgccctaacccacgcctatactcccaccgagaaagacgtcgaacctgtgagtgtgaaacaccaagcatatactgctgcatacca

SEQ ID NO: 64818 - DNA, 236 bp, Triticum aestivum
  Clone ID: PAT_TA_64818
tcgtttaattgctgccaagaatatcaacgaacatgtcctgcttcagatccttattcccatggctgttctggacgcccttacaaaggctggcagaaatagttggggggaagacctgggccatgccataaccactgcctatactcccatctatgaaaccatcgaatatatgagtgtgaaaaccgagcatagcgcgctggataccatgaaccggatcaaaagcgcactggaaggatggc

SEQ ID NO: 64819 - DNA, 203 bp, Triticum aestivum
  Clone ID: PAT_TA_64819
tgcttgcgtgtgatctgatggagtcaagcaggtttgcttgtgcgtgtgcgtgcggtttgctcgctcgctctcccatgctctgcccattgtgtccttgtgtgtatgtgcgtgtgcatgtgcccctgtaattgctttatctatccccactatggatggagtgatgaatatgtaagaatgaaagatttacctaattaactactcct

SEQ ID NO: 64820 - DNA, 340 bp, Triticum aestivum
  Clone ID: PAT_TA_64820
tttgggaatgggatatttgattgggtagaatggacgacatctataccggagaagtagtaatctgttagtatcctccagaaaatcatagagaaggacgccacggtctcaacagatggacggcctgccgtcaagttggacagcagaatcatagaactctacaaagtgtatgggttgactgaaaggtgagatgaggggttgtcaacaacatctatgaaatacctggttaattaatcctacatttcagtatcaaccaacatttgttccttcctgagctctcaaccctagtctcatcgatgatgcagcctgcgcatcacttgttctcagttgcttggtaagtact

SEQ ID NO: 64821 - DNA, 178 bp, Triticum aestivum
  Clone ID: PAT_TA_64821
ccggccggattcctggttgacccacgcgttcgtctcttttgtgcaaggatggcaaacgcgccttgtttgttatttccatcaatatactgtcttatcgtgaaaaaaccaaaaaaagccaggtcgtgtgaggccccttctcaaaataaagcccccatctctagctttaaatacaccgcag

SEQ ID NO: 64822 - DNA, 347 bp, Triticum aestivum
  Clone ID: PAT_TA_64822
tttctataaaaatgaatcctgaatacgatcacttatataaacgtttgttaattggagattctggtgttggaaaatcatgtcttttgttaagatttgctgatgatacttacactgaaagttatatttcaactattggagttgatttcaagattagaactattcaattagatggaaaaactattaaattacaaatttgggatactgcaggacaagaaagatttagaactattacttcttcttattatcgtggtgctaatggtattattgttgtatatgatgttactgatcaagtttcattcaacaatgttaaacaatggcttcaagaaaattgatagatatgcttgcga

SEQ ID NO: 64823 - DNA, 438 bp, Triticum aestivum
  Clone ID: PAT_TA_64823
ctctcatcgtatcttaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacattaatgttactgactgccatatcctccttactggaccaaattcaattgttggccgtgctgttgtcgtcaccgtgaccctgatgatcttggcaagggtggacatgagct

SEQ ID NO: 64824 - DNA, 336 bp, Triticum aestivum
  Clone ID: PAT_TA_64824
agatccacccaccctcccaacatctgtcctcctcgtgtcccggccccggggtgggttgatgatgcatgcggtgcaaatggcaagagcccggaggtatagtatacatgtactgagccgtatatacatgtgctcatcttgtcgtacgtactacgtatctgtcggtgtgtgaaagtgtgtgctgccacgcatgtcccctcttggcagtgactgtgtccgtgtgtaacattgccactacttcaaatgtgtgcactttagtacatgtgtatgtggtttctgtaaacaatctacttcggggttaattaacccaccgacagaactacagctatcttatcgctt

SEQ ID NO: 64825 - DNA, 311 bp, Triticum aestivum
  Clone ID: PAT_TA_64825
caaggctagctccgtgtactctttgagtcgccattagttaccccggacctgatcagcctttgtgcgttgtttccctgaattatttatgccgtagcaggttagtcaggtacaaactcgcgcagtaggccatatcttgttgttaacttagttggaaggattactactgctttacatatcttattagttggggaggctctgtgttctttcaacacctttctttattgtttcactgaattgctattatctcctgtaagaatgagaaagattctgaaacaccagcgatgaatttcaaagtaataggaatgcttttt

SEQ ID NO: 64826 - DNA, 237 bp, Triticum aestivum
  Clone ID: PAT_TA_64826
atgatgctggacaagctgtgggacgacgtggtggtcgggcctcgcccggagacgggccttgacaagctccgtcgtgccgtcgtcacccaaccccttgccatcaatacagttgcaggggaggcgattaaagcagtctccgtcgatgcctacgaccccgaccacgtcggagacgccgtctttcgttacgccgtcgtgtggtggaagctttgtggcggagcgtttttcaccccgggagca

SEQ ID NO: 64827 - DNA, 462 bp, Triticum aestivum
  Clone ID: PAT_TA_64827
gctgcgccggaggggccagggcgtcgggatcctcgtctccaagcaccccaaggacaccagcgcctccttctcgctgcaggagccggccgaggtcatggagttcctgctccgcctcgtcgagtggaagcagctctccagggcgcgcctcaggctgcggcgtcaggccgacgcctgatccaacggccggactaattaattcactacgtgtagcttaattagctagttaatgaatcccctgctcatccgaacaaagccaaaggctacgtacgtggatgggaagaaggaacgtactatggcgaacctgtggctgtggagcattgttgcgccacatgttgtgttctaattaaccgcccttctctttgtggggatgtataccgtacctaccgattatgcatgcatgtaaattacctttggtcacgtacaaggggaggaaccatggaataaagaaagagcaacctgagt

SEQ ID NO: 64828 - DNA, 197 bp, Triticum aestivum
  Clone ID: PAT_TA_64828
ctggagcttggagatgctttctttacctgctgataagacgtcttgttatctaataaaaataatttgtacaaataaatttaaacaaaaaaaactgcagaaatagacaaaaattactaaaaaaaacttgaattccggaatttatctcagacacaaaacctcttaaattaaaggggggccccttttaaaggaaccaattt

SEQ ID NO: 64829 - DNA, 210 bp, Triticum aestivum
  Clone ID: PAT_TA_64829
atcttttttattttaccacagaaacatccgtaaagcgtgcggggatgcccttgcagctctgagtttcagttatgtagttctgctgtcaggcactcgggctatgttgtggcgtcgccggtccaggactaagctgaattttgtttgttcgttgcaacagaagcttatctgtaaatagctgaactaactactgcttacaggacatcacagttt

SEQ ID NO: 64830 - DNA, 407 bp, Triticum aestivum
  Clone ID: PAT_TA_64830
ctttttattttcttcattccctctctattttttttttttttttttttcggggacaaacattttcttcattatgcggaagcaacagagatggccataaaaaaaattgaacatgttcacttacagcagcacagttaactacttcaaccgaagctaaaaatatccatccctccattgggccccctcattttgattagggtacaacacatactgggcaactaagcccacggaacaattatttcggagcccaaatccaaaaatcccggtcaccccttggagcttaccaccgttgcaaccaccgcgagatacacaaaccggaagggattaatacccaggtctcacacccccaccttgggggggcccccacggcccctcttggcaggagcggtgcccgcccccgggacccgaaa

SEQ ID NO: 64831 - DNA, 205 bp, Triticum aestivum
  Clone ID: PAT_TA_64831
ttatttgtaatcatacaccctctcagtaagtcattaagacgtcttaaatacttgtgtatttattatcattttgcttagttcttctgttgtttttgtagctaagtagcctgttcggcgatccaatgcattggaatacttcaattttgtagcttggctgtaaagtgtatacacttttattcattgtttaataccaatgtgatgaagt

SEQ ID NO: 64832 - DNA, 303 bp, Triticum aestivum
  Clone ID: PAT_TA_64832
ggggtagccgcccctgacatggatggcacggactccgtggtcgatggaccagctcccgcgcctgcctctggcgcgtcagctgccgccccagctgttgccatggcgtccctgaccgcgctcgtcttcggctacttcttctgaggccatgtccttgtgcgcgcagttatttgggatttttctttggttcgtctcgtgttcatacatgatatgagtacatattgtaaattacatgttcttttctatttaaatagaaaaattgttgggtacacacatttgtttatttgataaaggatgctttttagt

SEQ ID NO: 64833 - DNA, 116 bp, Triticum aestivum
  Clone ID: PAT_TA_64833
ccctcatactctacctaatgtgctcattctctcccggtggtattttttatactttcatggggtgcttttatcctcctctcaaaaacatccattcgtctgttgtaatccttatactc

SEQ ID NO: 64834 - DNA, 314 bp, Triticum aestivum
  Clone ID: PAT_TA_64834
ccctaatatccaaccaaacacctcatcactgaccgtggggggttttattacactaggggtgtctacacagcccaagcccaatgtgaggcgaaggaccagccctaccaagaatcacagggcctagatggacctcatgccaagctacgacgaagatttagaccttccttcataaagcagataacaggcatcagttcttttaaaagtagaacactgaagtcattcaccactcaacatggccttccactctaataaatcatgctgcacgcccgcgtgcatgcgaaaatctaaacattatattatgcactcaactactt

SEQ ID NO: 64835 - DNA, 422 bp, Triticum aestivum
  Clone ID: PAT_TA_64835
cacaatcataatccacatccttacaaaaaaaaccaagagagcatatatacaaacttaggtgaataacatccaccagcactttgaaaataacaaggcgggatacgccgagaataacaagaacaatgctgcactcatccacactgataccgcagagtatatagctataatcaaagcaaagaaatggcaagagctcctcaaaggcgaggatatttacaccaactacccggccacctgacactatgccaagaaagacataggatgcttccgggcctaaagtaaaaacctttctaattcacaaatgcatcaagattcaatgaagtgttcatccctggctgcttgcttagttacttcttactttcatccctcccaagtgagtagtgtaccttttttgtaaaggcatccaatctctatatacacataca

SEQ ID NO: 64836 - DNA, 246 bp, Triticum aestivum
  Clone ID: PAT_TA_64836
ttagtggaggccgaccaacgcaccatgctccagggggggattttttgagcttatgtggggttaaccacacctatgcacgatataccgtccacatgatggaacaatgcattctcatctttatcacgatttgttgctagttactactataactgcctagattggggaactgcaccattgtatatgcctattcgatggccagtgcatcagatatcacggagtgaacaccacacttaaattcattcaccc

SEQ ID NO: 64837 - DNA, 413 bp, Triticum aestivum
  Clone ID: PAT_TA_64837
ccctttctatcgcccacgcgtccgcccacgcgtccggctgtttggttttgttgtgcagctgtgatggaaacagaagggtttaattacctggaggagacttgcccatccttgctgtctgatttgttagcaaccgtcgcagtagtggatgatgatccttcatctgttaaccggaaaaggggagtttgtatcaacgaagatgtgaatcccgttgaaagcgttgaggctagtgacaggcgcacccgcaggagggtttaggcggaggctgtcaactaatgtagctatttgctgtctcccatgaattttactatggctggagttatgtcaagtgctctgtgacaggaactttgatttgggtgagagcaacttgtgaataatctccagcattgacggctttctgtggcattagttgcaac

SEQ ID NO: 64838 - DNA, 540 bp, Triticum aestivum
  Clone ID: PAT_TA_64838
gtcttgttcagggtcaggttcagcgtccaaggatgggggggggcggtgggcaagaagggctcagaagcgagaggctgccgacaaggcggctgcagagaagcacctcaagcttctgcagaggctgggccgcgggaaaactcccgaagcgccacctgaagcactggaatcactggaggttggtcctcctgtgatcgagtgatccatcagcctctgtagataacgctgctgcggggaacgctgcagcccctgggagccccctccaataatcctcccggtgcgaagaagaggaaaccgggccttgtatcctggcaactttgtcgcgttgtacagtaatttagcttcgagtcactcgttaggtcggtcatcggagctgctacccagtctgctccagatgcagcaatgaggtcggtcggtcggtttatcccacactgatagttgtttaattcaaaaaggtcatgtactcgtgtcgtattaggggcacaaaaattgcttgctgtgctaattttcctgcaatgtggcaactgtggaggttgttcatcc

SEQ ID NO: 64839 - DNA, 495 bp, Triticum aestivum
  Clone ID: PAT_TA_64839
cgtccgcccacgcgtccgaaagctgcgggggcgctctcataggaggggggtgagcatcggaaccaagccgccgacgccaccatgggtatctcgcgtgactccatgcacaagcgccgggccaccggagggaagcagaaggcttggaggaagaagcgaaagtatgagctcggccgtcagccagccaacactaagctttcaagcaacaagacagtgaggagggttcgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagctgatgctgcccccttcaagcagtggtacctgactcattatggagtcgaaatcggtaggaagaagaaagctgctgcagctgccaagaaggaacctgctgag

SEQ ID NO: 64840 - DNA, 573 bp, Triticum aestivum
  Clone ID: PAT_TA_64840
ttgtttgcaaagacaatcctcaacagagacacaggacacactcacgccatgtcgtggacatcgtccaagccgaagagaggaggtggcctccggggccccaggccgcagccgctgagcctgtcggcacggccgtccaagaagccgcgcgtcggcggccacgccggaccagctgccgggcccgtgatcgtgtacgagcgcacgccgacggtcgtccacgccgacccacacgagttcatggccgtcgtgcagaggctcacgggcaattgcaagcagcggccgtcgacggcggcgatgacgttgccaccagaggcgacgtccggatccggagctagggacggcagggcctcgacgtggacagcagcggacgctttggttctcaggcttggccagcagcagcgtgcgccgtgtggtgctcatcatccggcaccttctgcttccccggctgctgcatcatcaccgctgctgtcctcgagcagcttcttttttccccgaccaccatgcaggcgatacgggagctcatcagctgagagtcagcttgtgaaatttgaagatcgatccggcctggtgtgatca

SEQ ID NO: 64841 - DNA, 488 bp, Triticum aestivum
  Clone ID: PAT_TA_64841
ttctctcgtccgggggttggcttctcctcccggtcgggttcgttttctggttcgggtcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctaccgcggccagcgcggcggtggcggaggctaccgcggcggcggtggcggctaccgcggccagggcggcggcggc

SEQ ID NO: 64842 - DNA, 393 bp, Triticum aestivum
  Clone ID: PAT_TA_64842
tcttctcgtccgcccacgcgtccgatcgtcggtgaggggtggttaaacaggcataatagaaggatttcctcccaaggagagagatgatgatgttgtatcatgcttccaactttttgattccgatttgccgtttctcggtcttggcgccacctgagccgagacattagttaattagcagacgctaatgtcttcccctttgttttgacagtgacaccaatgtattccctaattatgctggtgggcaccatgttttagcctgacatatgtgtgtacatgatatacgtagcaacaaagtggcaaaagctcagtctgtttaagaacaatgcaagctaaaaaagaacgtaactatatttaaaccttgagttaatgaagatcacctggttgctggatatg

SEQ ID NO: 64843 - DNA, 550 bp, Triticum aestivum
  Clone ID: PAT_TA_64843
tttatgcgtccgcccacgcgtccggtctacttcggcgcgtggtgtgcgctgaacgtgatcttcaacatatacaataagaaggtgctgaatgcgttcccgtacccgtggctcacgtcgaccttgtccctggcagccggctccgccatcatgctcgtgtcctgggccaccaggatcgccgaggcgccccagacggacctcgatttctggaaggctctctctccggtggcgattgcgcacacgatcgggcacgtggcggcgacggtgagcatggcgaaggtggccgtgtcgttcacgcacatcatcaagagcgcggagccggcgttcagcgttttcgtctcaaggttcttcctcggcgagcacttcccgttgccggtctacttctccctcctcccgatcataggtggatgcgctctcgcggccgtcaccgagctcaatttcaacatgattggattcatgggggcgatgatctccaacctggcgttcgtgttccggaacatattctccaagaggggatgaagggcaagtcgtgagcgggatgactactatgcct

SEQ ID NO: 64844 - DNA, 280 bp, Triticum aestivum
  Clone ID: PAT_TA_64844
gatccccacgcacagggcgaacccaatacccggtttgacccacacctacaatctggcgtctccactaaagatactgcccgtaatgatatgatactatagtcaacaccttatgcttctaaacatctgaccctgcataaattgttaggcacacacaggcaataccactgcacatggatcaccttgccaatatttcctacagaatcgaagctgagtgtctcgaacattccttcttacgttagcatgtatagcaacttatcccctagcaactattttgcaaaac

SEQ ID NO: 64845 - DNA, 261 bp, Triticum aestivum
  Clone ID: PAT_TA_64845
cttacgcgtggggccaagatccaggagggggagggcatctttccggaccaggagcgcctgatctttgccatacagcacttcgaggatggccgcaccctcgcggaatacaacatccagaaggagatcaccctccactcggtgctcaggctccgtgggggcatgcaaatatctgtgaagaccctcaccgagaatagcattacactctaggtggaggcatctcacaccatccacaacgctaatgcgaagatccaatacaaggag

SEQ ID NO: 64846 - DNA, 508 bp, Triticum aestivum
  unsure (1)..(508): unsure at all n locations
  Clone ID: PAT_TA_64846
attcacattgaattgttcacaaggtcctggtttaaggggggaagaaatgaaaatttgttcttctaagcaaatgctagcaaaagatgggcaacctcagactagcctgaagcgcaagtgcgtcacttcctccttaccaaattataatgagcagaatgcaaatgatgaggaaaagagtaatcaagttctagagcctctcaacaagaagagggtaccagagaaaggggaagtggagcaagatgacagtaaggtcaaactcgccaacggtgaaagcaatcggtaaatactcgtttttcttgtgattctcggttttatactagtcttgtattctgatggtgttctatttggttcaccttgccttgaaggcctgcccagcagtcgatgaacgacatgctcctcaagatccgtgccgtgaaggatagtttgagggacaaacctggcaagtttgaggagtcgatgataaacgccgcgatcctctacgtncatgccgtgaaggatagcttcagggaca

SEQ ID NO: 64847 - DNA, 451 bp, Triticum aestivum
  Clone ID: PAT_TA_64847
tttcgtttacgcgtccggctttatccaaacaagcaatcagtatcactattggcgggtgtatctccccaatttccacctatggtggcacacactatgacatcgatattttagtttggaaggaccgagcggggggcaattggtggctgcaagtgggaggtgattatgtggggtattggccatcatccatcttatcctacttggaagatagtgcttctaccatcatgtggggcggtgaggtattttcacccgatgccggacaaacttccacacatatgggtagtggacacttccccaatgaagggttcggcaaggcgagtcacatcaagaacattcaagtggtagattcgaccaactgtctcaatcccccaagtaatgcgggcttgataaccgagcagaacaactattataatgtgcaaagtgacacctatggcgactggagcacttacatcta

SEQ ID NO: 64848 - DNA, 247 bp, Triticum aestivum
  Clone ID: PAT_TA_64848
tttcggttgcagctgcagctgtggaggctagagagggggataacacactctggaggctgcgttttcactagcccgcgtgtagggatcgacaggaagatgggacacatcctgctcctgtgcgcatttctactcggcctgatcaatgaggacagcctcacggaggtaaccgaatggatgggccgatgcacatcacaccggggatgaaaccccagcccgcgcggcctcagaactggcacctgggtggcgt

SEQ ID NO: 64849 - DNA, 424 bp, Triticum aestivum
  Clone ID: PAT_TA_64849
gtctgtgcgaagaggactgactagaagcggtgcctctgatggtctggtcttttgtctacggcggtgcatatctgagtatctgacgaccgcccgccgccggcgatgggctgctggtgggagcgcctcgtgctgccggtgcgaagggcgtggctcggcgtcgcctcccgcttcggtgtgcgccagtccggtaaggccgcccgccgctagctcaccgttcagccacatgctgcagaggcttccctcgtcggtccacctagtcctgggctgactccggcgtcgctggttgcttttttggttgcagggctgtggaggctccggcaggaggtgagcacgtgcgagtacgaggacgtgcgcgtgatgtgggagatgctgagccgaccgcgtcggcgccgccggcgccggcgaccaggcgccacagcaggtt

SEQ ID NO: 64850 - DNA, 298 bp, Triticum aestivum
  Clone ID: PAT_TA_64850
ttcacgctttcgcccacgcgtccgactagttctagatcgctagcagcgccagccgccgccggcgggtgaccgtgtcattcgagtatagctatagcacacgaacttggtgcgatgactgatgaggtgtacatatgattcctgtaatttgttttttttttcggtggcgagttttctttcctctgcccctgctcgcgtattttaagagcagggatgggcatgacataatgcaaaattgtacataaaaaaaaaaaaaaaaaaaaaaaaaaaaaaaaaaaaaaaaaaaaaaaaataaataaaa

SEQ ID NO: 64851 - DNA, 462 bp, Triticum aestivum
  unsure (1)..(462): unsure at all n locations
  Clone ID: PAT_TA_64851
acggtttgcattctgtttgctgtggattgcagccgtgttccagtcgcttctgtacgaggtggcggggcgaacgatcaacccggtgagcggcgcggtggggctgctctgggcgggaagctggcacctgtgcgaggcggcggtccagaccgtgctccggggcggcgccatccgcccgctgccggagctcgcgggcggcgtcccggaaggcggagtcggtggaagcgatctgttcgcctcctcttccaggcgggccgtggtggggtgctccacgtattcggcggcgaagcgggtgacgccgaggaagacatgggcgccggaggcagcgtcccaccaccaggagccctcgtgcgacctgnggcttttcctcacccccggatcggccgcggcggcagagggggagcgactggcgaggcgggcccgcacgccgtcgatgagctccgacggctccgtgaccactagcgc

SEQ ID NO: 64852 - DNA, 484 bp, Triticum aestivum
  Clone ID: PAT_TA_64852
tggcactccctaagctcctcctgcttctcttcgtcggcggtgcactgtcactcaccttcttctccggttcagaggccggcgaggtgggcgtgtgctacgggatgatgggcgacaacctgccgcagccgccggcggtggtgcagctgctgaagcagcacggcatcacgatggtgaggctgtacgacgccgacgccggagggctgcgcgcgctggccaacaccggcatcaaggtggagggtgtccctgcccaacgacaacataccggacgcggcgagcagcatgtcgtacgcggtgcggtgggtgcagagcaacgtgcaggcgtacccgggcacgtggatcgacagcgtggccgtcgggaacgaggtgttccaccaggcgccatggctgacccaccagctcctcccggccatgaagaacatccaggcggcgctggccggggcccgcctgggcgacgcggtgaaggtggtgacgccgatcgcgctgg

SEQ ID NO: 64853 - DNA, 459 bp, Triticum aestivum
  Clone ID: PAT_TA_64853
cttacgctctcgaggacgcgagggccgacacggggggggttggattgggactgccttgtggataacaagactgctgccagcaacaaagagaactcctgcaaaggggagaggcaagcacagtgggctaccgtacagataacactgcatgagcttcaagccccagagccagtctcccacacactggagaacgacaagagcagctaccgagagctctctgagatcgatgagcaggcacagagacctagctgtgatggccaggctgctggaggtaaacacactcaatggccacgtttaatccgaggtggagctcaaggggcccgacatcaacaccatgaaaccagagctacacccagtgaggaaatgggacattgaaccaacaaacatgacatacgtgtcggagctagaccggaatggcactccgcgtgaagattgttgcggcgaatgaaagaaacaaacatg

SEQ ID NO: 64854 - DNA, 275 bp, Triticum aestivum
  Clone ID: PAT_TA_64854
acctacgcttgtcctttaatgcttcacccgccggatcttcaagtggtcgggtacactaggcgcagaggcgcttattcctgcgcttaagacagcagacttcatagaatgtgaacctgctgctcgagaggcaggactatgcatttcgatatagagcgtgcgctaactgctaggtgggaccatctccggcaaagcactacactgaagctactacaggtgcttcgacagctctctatacatactcagcatcttatggttacctctgacctactgcaggt

SEQ ID NO: 64855 - DNA, 205 bp, Triticum aestivum
  Clone ID: PAT_TA_64855
acggttggttttacattgtagcctagctagtgtaaggcaattgcaaaggatggcgcgagttggttgtgcactccgaacaaaattatcaaaaaaataatcgccaaaaaaaaaacaactgaagacaagtacgatgaaaagcaccaagaaaatatactggaaagaattaactgagacaaacgatggatttaacgtaaaaaacaataac

SEQ ID NO: 64856 - DNA, 438 bp, Triticum aestivum
  Clone ID: PAT_TA_64856
acggcttgctttccgcgacgtcactcttgcaggagcgccaaagcttgccgcaacgcccgagcttattgttggcaccgtcacagcagaaccagagcttccagtccaaggagtcattgtccgagcagcaacggagctcgcagtccacgatgctgccgttacaacaccaccaggacttgcggcaacatcagcagcagctgaggctccagttgagggaggagttgtcgcatcaggaacagaactcgcagtccgcggtgcatcgccgcagcagcgccggtgcttgaggcggcaacacccagattctcagcccgcgaacttacatcagcaccagagttcgcagcccgcactatcaccgtggcagcagcacaagagctctcagccagcgatgtcgctgtctcagcggcaccagagcttgcagagctcgcagtatgtgctaccacc

SEQ ID NO: 64857 - DNA, 217 bp, Triticum aestivum
  Clone ID: PAT_TA_64857
acgtttcgttccagcgatcttcgaggggctccagggggagggtgcactcacgcctgcttgggttattcacgtgctggtgacctaacagttgtacagcatcaagggcacggccgaaatcgagaacctcggagagctggacagctggctcgagatccgtccttgcgctatgttgctcaaagtcgtaacctggcactccgacaggggcttacgcaactag

SEQ ID NO: 64858 - DNA, 296 bp, Triticum aestivum
  Clone ID: PAT_TA_64858
aaagctggtgcgccggccggtaccgaaccccaattcccacccacacccacgctttcgatcaaacccccagcgcgcggccccagggggagattgaaaccaacccggggttgggaacacacaagccgacgacaggacaccctagacaacaatcaagtgactgccgaaaagacaacaccatgactggcatggcaagtgtgtcacaaatgctagcctgcccgccacacatcaaagccggcaccagcgcagcgcggtcgccaagagaggccgcacagcagcgacctgaccaacagtggcat

SEQ ID NO: 64859 - DNA, 373 bp, Triticum aestivum
  Clone ID: PAT_TA_64859
tactaagggaagctggtgcgcgtccggtccggatcgagttcgtgcagacccacgcttacgctacgcgcgcgcgcccgcgaggagggaggcgggctcgccgagacggtagtagctgaagacccaaagccaaacaggaagtatacgttactgagcacaggaggacacactgagggaaagactgtgacaatgagctaggagcaagtcatgacagaggcctcatgtgacagccgagcactcaaggcaagagaacggacgcggacggatcgtcagtggtcgtggtgccgagtcaaactccatggcatgaacaagtcacaggtgcagctgagtccacctcccatgataaactatgaaccaccctgtacaaaatgtcaac

SEQ ID NO: 64860 - DNA, 431 bp, Triticum aestivum
  Clone ID: PAT_TA_64860
tcggttgataggagctgtagcacacacgatcggggacgatcatagactcgttcaggacgaggttgctgatcggcgtcatggaggcttcaatggctgcgcggccatacatggcagattcctcaatttgatctgaagacggacctgcggaagatggcggcgaccacacaccagtgcctctgacctgattatgccccacaccaggcatgtggctcgactggggcttccacatgtgtccaagattccggctattgatgttaggattacgcgagttggctgggtcgtggcccgggtagctctctatcatcatatcggataggattagtggcatatgttgccaatatgatggattcaggcacattggggtgatactttgaatggccatcgtgaataatcaataaagtggccgtatgcatcttccagatgcagaggcc

SEQ ID NO: 64861 - DNA, 257 bp, Triticum aestivum
  Clone ID: PAT_TA_64861
acgcttatcgcttacgcccacgcgtccgcccacgcaggggcatgtgtccataaggatctccacagggaaaggcatccaagcacactgatctcacaatctgtttgtccgggcacatctaatgagccacacattcatgaacaactggagcgaaacaaaagcctatggtccctttgtgcctgctaagatgcaacagcagcttcaatacaggcttacagggatgcccccgcctacggaaaacatgatgcccccaccggaaa

SEQ ID NO: 64862 - DNA, 177 bp, Triticum aestivum
  Clone ID: PAT_TA_64862
tttcgtgtctggtgatgccatctgtactagtggcccaggacagagtcttgaacggcgaaaagaagaccaagaccatacacgcggaagagaatgagaagctgagggcgaggctgagaggagggcaagtggacaaggaggccgccagagacagagattgacggggggggccgttttctg

SEQ ID NO: 64863 - DNA, 382 bp, Triticum aestivum
  Clone ID: PAT_TA_64863
ttacggtatctcgccacggcggcggtcaccagggcgggggtcaactagatgcaggcttcgcagctcgccgaggcacgccgcaacgccaccaggctgaggagggaggtcgagcgccatatccgcgccaacgtcgcgctagccgtgccgaccaccagggccaaggtgcatgcggccatggaccgagcgctcgcgctggactgcatctacccgatgccgatgcttcgggacatgcccgagaagatacccaaggccgtcgagcccactcactagcggacgcgccgttccgccttgtaggagcccaacaacttaaagagctacgggcgtgcgtgaggcacatcctgcaacggatgggcccaagatcaccaggacgagatgcgaggca

SEQ ID NO: 64864 - DNA, 303 bp, Triticum aestivum
  Clone ID: PAT_TA_64864
gtttatctttatgatacatgctacaacactggactgtgtgaacattgtacaccatttcccaccctcatagaacagaagcatatatcataaggatgaacacgaacagtttgaaataaatgtgctctcatgtttggagaagttgttcatgtatagcagctgctacgaaaatttgtgcatgtatagcaactgcttggaagtcgtaatgtacaatttgtcatttgcccgttccaaaaaacattcggtactgaaaaaaagaaaaagaaaaaaaaaagacaaatgaaaaaaataaggaacacaagaaag

SEQ ID NO: 64865 - DNA, 324 bp, Triticum aestivum
  Clone ID: PAT_TA_64865
ggcctacgcttcgcgtctcgacaacattcaggtcgaccatgcgaagggtgcaactgagacctacaatgtgccttgtcagaacgttcgcagaggacgaaagggtgtgatggctacccgcgccaccaggctgctcctggcacttgtcggggtctacgctggactccgctccgactgccggcaaggcatcactgacgcttccggcgatgctatattggagcctgtgctcgtcgcgacacctgagcggtgtctgcctgcgccatgatctgaagaaagcacaagagtaagcgtcgggctgtctatacgtactcgaggttatgttcctgc

SEQ ID NO: 64866 - DNA, 397 bp, Triticum aestivum
  Clone ID: PAT_TA_64866
cacccgtctgaatttggtcttcggaaggcacttccagatggacagggtacaagtaaagtgacgtccgtgaagttcgcagctagagcaaagtatgtcggtagagggatcctggaccaccaccgggacgggtcacgactacctggagatgagcaactggaggaggcaaaattagagtcagcggggcaatgagtagatggtacatatctccgattatgctcaggatgcatgaaccattttgacgatggtagtccacgtaaccaaggatacgcttgaaagaggaatatgcatgcccctgaactgaagcaggccggcggtccaagtggtccatcaaacctgtggggcgagccacatgtttttatgtaattcgacgacgtttgcactcgacgaaatatctatc

SEQ ID NO: 64867 - DNA, 420 bp, Triticum aestivum
  Clone ID: PAT_TA_64867
gtttggtcttggacctggctgcctccgcgcgctgcgccagacagagcgccccggtgctcccccacctccgctagactgctgcgccgccgctctgagcgccggcccctctctaactccggccctgctcgactgcgtacgttccggtgctcccccgcctgtattagtctgctgcgccgccgccctgggcgccggctcctctcgacctgctgcgctgcccgcgattctgcgagcttgccattaacaggtcacgataagcaggggcacaagtggttttacgcaatgggtcatttcaagaacaggtacatggtgatggaggtcttcatcgacgctagcagaggagaggctgatcctgtcatcctcacccagttcaacataaccaaagtgatcagagacagcatccagctcaactctggggaatgc

SEQ ID NO: 64868 - DNA, 340 bp, Triticum aestivum
  Clone ID: PAT_TA_64868
gggcaaattcctagagcttttctcgccgctgctccagcgtgcttcactcagcaccggtgctggttcggggtatctctaccacggtcgtggtcgcccaactggtcgaaagatggcccgtctgggcctgtgtttctttgcggatgaggccatgacacaaggggtggtcccaaggacgttccgatcgaggtgggaacagagatgatgttatggatggctgacagggacataggaaacactggcgagctttttagccgggttacacatggatgttgtgagaagtgcatttaaaaaaggcattaagaaggtgaactcaatatgggagagaacagaagcattgatc

SEQ ID NO: 64869 - DNA, 389 bp, Triticum aestivum
  Clone ID: PAT_TA_64869
ccttcgctatcgcccacgcgtccgcccacgcgtgcgggggtcttcttcccactcaggcctgggttcccggcccggttcggttcgttagggtttagtagtggggaagaggaggaagaatggcggacgtcgagtaccgttgcttcgtcggcggtctcgactgggccaccgacgaccagtccctccagaacgccttctacaagtacggcgacatgatcgactccaagatcatcactgacagggagacgggccgttcccgcgggttcgggttcgtcaccttcgcgtcggacgaggtgatgcgccaggcgatcgaggccatgaacggccaggacctggacggacgcaacatcaccgttaacgaggaccattcccgccgctccggcggaggcggc

SEQ ID NO: 64870 - DNA, 416 bp, Triticum aestivum
  Clone ID: PAT_TA_64870
ctctcgcgttcgaccacgcgtccgtcaacgcgtcggccaaggcgtccgccaacgcgtccgtggacttaaaaaaaaaaaaaaaaaaaaaaaaaaaaaaaaaaaagaaaaaaataaaaaataaaaaaaaaaaaaaaaaaaaaggggggggcccttttaaaggatcaaagtttacgacccggggaaggcaaagcaatagttttttaatggggaaactaaaattaaattaatgggccgcggtttaaaaacgtgggaatgggaaaaacccgggggtaaccaaattaaatggcttggaagaaaatccccttttggcaagtgggattaataacaaaaaggcccgaacggatggcctttccaaaaatttgacaaacttaaagggcaaagggaacccccctttaaagggcctttaaagggggggg

SEQ ID NO: 64871 - DNA, 383 bp, Triticum aestivum
  Clone ID: PAT_TA_64871
tttcgttcgcgtgggcggacgcgtgggcggacgggtgggttgactcgtgggcggacgcgtgggttgttgggttcatggcgagtctggtaaagtctgcggggatacggaaactccgttgatctttggtgaaagttacctaaaaaaaaaaaaagaaaaaaagaatgaaaaaaaacaataaaataaagaaaaaaaataaaaaaaaaatgtaaaaataataaaaacaaaagaagaaaatgaaaataagaatggaaaaaataaaaaaaggggggggccgttttgagggctcaaattttccctggccggggttgcacaacatttttttttttatagggccccctaatttaaatctttgggcccctgttaaaacaacctctaatgggaaa

SEQ ID NO: 64872 - DNA, 534 bp, Triticum aestivum
  Clone ID: PAT_TA_64872
tcgctgtcgcgtgggggccggtggactggacctgctggccctcgtcagcctctacgacgacgcgcaccggcacacgcagcagaacgcaagctacaacccctgggagcagccggccccggcttcatcggctccgatgatgcagcagcagtatcagcagcagccgatgcacaacccgttgtacgcctcggcgcagcagcagcaggccttcatgctccagcagcagcaggccttcgtgctccagcagcagcagcagtaccagcagatgatgatgatgggcgcgccgtcgctccatcgccaggcgtcctccaacccgtcgctccatcgtcaggcgtcctccaacccgtcgctccatcgccaggcatcctccaacccgtccttccatcgccaggcatcctccaacccgttcgacagatcgtacgtgccggcagccgccgcggcggtggtggctacccttatgctccggcgatgcagctccacaccggcaacgcctataccggaacccgcatgatgtaaagatgcttgtgtggtttttct

SEQ ID NO: 64873 - DNA, 570 bp, Triticum aestivum
  Clone ID: PAT_TA_64873
cccattcttcgcccacccgtccgaaacaaaaaaaggagggggctaattaaaaaacccacgggggaacaacaaaaccaaacaacaaaccgaagaaccaaccaagccagaaaaataacccccccagcaaagccccaaaccccaaaagggggcctaaacgggccccccactaaaaactaccaaaatccccccgggcggcttccccccccaaaccccatggtttgggaaccccaaccccaaatccccccccccccctgaacaaccttaaaactgggaaaaccccgcggtgccccaaaaaaaaaccccttccaacaaaacccccccttaccaccggggccaaatacccaaaaggccccaaaaaaacccctcttcacaaaattccgaaaaccaattgggcaaaggaaaccccccctaaaccgcgcccaaacttccaaaactttggtcctttcccccccccaccaaacccccacaattgccccgcccccaacccccccccctcccttcaccccccccttaatccaccatcccccctttcccccaaacctccaaaaggggcccccctaggccccccaa

SEQ ID NO: 64874 - DNA, 519 bp, Triticum aestivum
  Clone ID: PAT_TA_64874
caccaaagctcatcttcttctccttgaaatggttttgtgttcatcagatttggaggatgtcttgcaactgtggatccggttgcagctgcggctcaaactgcaagtgcgggaagatgtaccctgatctgacggagcagggcagtgccgcggtccaggtcgccgccatggtcgtcctcggcgtggcgcctgagaacaaggcggggcagttctaggtggccgacggccagtccggctagggctgcaactgctgcgacaactgcaagtgcaacccctgcaactgttaagctgcatgcactcgtgtgatggtgtgagagtataccttaataacgagcgtgcctttgatctgatggagtccagcaagggtgcatgtgcttgtgcttgtggttaacttgtcgctctccactatgctctgcccttggtggacttgtgtgaatgtgagtgcacctggccctgttattgcttcatctatcttcactatggatggagtgaagaatattgtaaaaatggatgaattaccta

SEQ ID NO: 64875 - DNA, 284 bp, Triticum aestivum
  Clone ID: PAT_TA_64875
gatgtgtttcagaataaaatcctttctgctagaatggcggtgttaaaaaaaaattacggggaggcaaaaaaagactacaccgaaaccggcctggccgtctacggcgaccaggcggccggcctctatgctctccagctcaactctttgtctagcctgccgatgactctcaagaacgccctcttgcttgccctcctggagaccgtggtggccctcggtggcacgcttttaacccctgcccaggtggcccccttgctcccgttcacggtttaccccaccggggcgga

SEQ ID NO: 64876 - DNA, 364 bp, Triticum aestivum
  Clone ID: PAT_TA_64876
gcctcgctgttcgtaacaaaaaacatgagaaacaaatggagagagttacaacaaaaaggctgatggttctacccagatgagaaccaagccggacggctggcgtgagcatgggcgctttccgcctatgtcaataccctgacaactggggggcgcctttttaagggacccctcttacccaccccgtgcttccacggcattatcctttttgtggggctcccgaagtacaatgcatagccggcgtttcacacggcagagatgggaaaaaccctggcttacaccaggtcaatgccttgcactggactccccttttcaccggtcgggattatagaaatggggcccgacccaatcccctttcccaacaggg

SEQ ID NO: 64877 - DNA, 262 bp, Triticum aestivum
  Clone ID: PAT_TA_64877
tctgttttgtcacccgacgcatgagatcaccatgattaagttaattccgatgatgcggttcgttgatcccgatgtgatagagtacgtccaacacagactttaacatggctccctggggccatagtgtacactgcgaaggagatgatgactaaagatgaaatgaactgtccgccaccgttcgcagggtgaacaaatgaactgagatgttatcttgaacggggacgaaagaagaaactgttgctacacgatggcaaaacttaaa

SEQ ID NO: 64878 - DNA, 357 bp, Triticum aestivum
  Clone ID: PAT_TA_64878
tctgtatgaacaggcggaggggaggggaggggaggaggacttgagataggacctcgttccccgtcgcgccgactagttcgtgtttccgaacgatcgcccggctatcgccctagaaatggatcaagagagttggaaagaggcaatggatacggatgaacacactccccaggttccgataatgtgcataaacaactgcggctatttcaggaacccgatgacagaaaacatgcgctcaatgtgttaccgagacactgtctaggacaagagcatggccctgctagatgagaacacaactggcgctgctgcagcatcgtgacccacaccaatggtggcagacatcaaggatgaagcgtgtgc

SEQ ID NO: 64879 - DNA, 104 bp, Triticum aestivum
  Clone ID: PAT_TA_64879
gtaagtaacactcatgctgtaggctgacacggatcagttagtgtccgaacgactggcatgatgatggccgttcggtgccattgttggtgtctcgaggagtccat

SEQ ID NO: 64880 - DNA, 367 bp, Triticum aestivum
  Clone ID: PAT_TA_64880
gtgtagccagtcttgccgaggagcgagggaggggttgcttgattgcttgcttcggggtcggtgtgcggggtgaggtgtgtagatgatgggggcaggctcacacatcaagacaataaatagagcctgtctgtttggggccaatcaaaccaaacaacaagttcatgtctgatctcgacgtccaggttccaactgcttttgatccgttttctgaggcaaatgctgaagactccggccctggtgctggatcaaagaactatgtgcatgttcgtgtccagcagcgcaacggaagaaagagtctgacaactgttcaaggcttgaagaaagactaccgctataacaagattctcaaggatctcaaaaaggaatt

SEQ ID NO: 64881 - DNA, 234 bp, Triticum aestivum
  Clone ID: PAT_TA_64881
ttttgtgccggctcaagaccgagtctagctgggggtggtttgtattttgcccgggggtggttaataaaccgaacaaacctagggtgggtcttttttttgagcactcgtttatatgcggcgcattcctcctgagagggtgttcttgatatacctttctgtgaacaacaaatggggcagttctcctgtaagcgttcaggaaaaaacctggggatacccaaaataaaaaacttaggg

SEQ ID NO: 64882 - DNA, 408 bp, Triticum aestivum
  Clone ID: PAT_TA_64882
tcctcgcgtccgcggacgcgtgggccgcgagcaaaaaatctgtcctccgatcgcgccatagctcgccgcctactgctcctccttgtctgcgagcgaacgagcgtagcacggtagggagtagctccggggactgttggcctggtccaagaaaaatccaagcacagagcagaggagcatacagcctcgaggaaggaaagaaacagagcggctttgctgtttgggaggtggccggcgagagagatggggcagctcaggccggcggcgggaggcggcggggactgcctgatcaagctgttcgggaagaccatccccgtgccggacgccggcgccggcgccaacgcgggagacgtcgacaaggaccttcagcacagaggcggcagcaccaccgctgaactaaaggtgcaagaa

SEQ ID NO: 64883 - DNA, 321 bp, Triticum aestivum
  Clone ID: PAT_TA_64883
ccttcgtttccgctcaattgtgcaggtcaaagttcagtggtcttcgttagctcctgaatccccgacctgggaggattattctgtgctccgtcagcgctacccggaggcaagctgttgggatgaagacgctcgcgctcaaggggaggcaaatgtcacacctgatacatgagtatcggtggacctggaaggtgaaatagatagaaaggggtgagcgtgtgtgtgcccagtgggccacatgtggccaggcgtgtgtgtgcaagtataagagacctaccctgtactccgtgggggatatgaaataagaaaagtcttgttgccctc

SEQ ID NO: 64884 - DNA, 254 bp, Triticum aestivum
  Clone ID: PAT_TA_64884
gtgtattccaattcgttgtagctagcagtgacattgaacactgggtgggttagtaagaataatgtatcatgctatgttttccagctgtagaaatctgctaccagtgtagactgacaattgtcaaaatacttcttagtctagttcagagcaataaattttttgtaaattttaaaaaaaaaaaaaaaaaaaaaaaaaaaaaaaaaagaaaaaaaaaaaaaaaaattaaaaaaaaaaaatcaaataaaaaagaaaaa

SEQ ID NO: 64885 - DNA, 174 bp, Triticum aestivum
  Clone ID: PAT_TA_64885
caggataccattgataaggttggagcagggtgctcggtcttatgtgaaccgaggtatcatgtctcgaggtgcctttgcagttatctatggactgcacttgaagtactacataaaggatcctgaggttattctgggaagagagacagaagacgtaaaagtagacatagatttagc

SEQ ID NO: 64886 - DNA, 226 bp, Triticum aestivum
  Clone ID: PAT_TA_64886
cttgtgtttaacaatatcattggggcgctgcgtcaaagtgaaaggtgaatgtttttgaagtattttcttatgctcacaggattactggaagcttattaaggtggaaattagcaagcaagctacagtcggggacggacgtccatgaggacccaatatctcaccacgatgcatgatacctgaatgttgttttatagtgaaggcgaaattaatatgaggggacgagcat

SEQ ID NO: 64887 - DNA, 299 bp, Triticum aestivum
  Clone ID: PAT_TA_64887
ttataataaagctctagctagctggctaggcggcgaatctaatctgtcgtgactgaaagcagaccaatatggagggagcccaatggcttcacaagtagttgtatgagtagaatagtacgtgctaagcaacagtgggggagtgcaaccctcagatggcttgaataaaagaggcaggggcaaaggcgaggctccacacgagggcagtgcgcccgctgtgcgcggtggagccagttaggaagccagtgttaggctacgaagtctcctagtctgtggcgcctatggaagaagatgaagggggt

SEQ ID NO: 64888 - DNA, 441 bp, Triticum aestivum
  Clone ID: PAT_TA_64888
ttgtatcgtacagccaaagtaggggtcgcgggcgcggactattggttatactacggtatgcgacaggccaccgggatggaagacgcagctttcttctagctaggagcgactgtgagtgtgtgggagggctctggatgagctgctatgacgccaaagaaactttgtgctggcaggagtgtgcatagcaggtgggtggaacgtgtgatgctgatggaccataggcccaaataaagtggacaaatgaacgattaactataccccactaagggtgttggacgattaagacagcaggacggtggtcatggaaagtcgaaatccgatggggaggggcgttacaacggatctgacgtatcaactagcccgcagaaaggatggagctgtagtgtgggaccaacacaaggcaatctgggggagtgccatgacaagatgagtaagaggaaa

SEQ ID NO: 64889 - DNA, 357 bp, Triticum aestivum
  Clone ID: PAT_TA_64889
cttagtgaaggagtgttaattgaataactgagaaaaatgtgggatatagaaagagtgggtgatggcgatttttttattaggatcgatggatggatgggtggatttgtacattctttttgttgattaattcgtataggttttactttgtttcattcgtgtaggaatgaaatttcgaaaaaaaaagagaataaaacatcaaacaataaaaaaaaattaaaaaaacaaaaaaaaaaaaaaataataaatttataaaaaaattatattagaaaaatatatataacttatggggggggccttctttaggaatccaagttttttaactctggtaggggacattttatttttttttttgggtct

SEQ ID NO: 64890 - DNA, 289 bp, Triticum aestivum
  Clone ID: PAT_TA_64890
ggttcttgtgggcgggcgcctgggcggcgtgggggggtgcttctgttacggttcgggttctggttcgccccgcggtcggttcgagagagaggtcgagtagctagaatagaaaagggtttcggtagagaggaagggcgatccatggcggacacggagaaccgatggttcgtgggcggtcttggctggcaccacctactacaccatcctccagcaggcttttttctcagttcggcgagaccctagacgcctagatcatccgcgacctccagacggggagagtccgtggctt

SEQ ID NO: 64891 - DNA, 297 bp, Triticum aestivum
  Clone ID: PAT_TA_64891
gcggcgtgttatcctgtccggcgcgcactccatcagggggggccactgatcctccttgatggtgggtctcaccgcgccgtcggagcagatccacccggcctaccgaaaccttttcaaccacaagtgccactctggggacgaaccccgtcgcaatgacaacgtgcgtgatggggactactagacggtgtacaagttcatgcccggtgtcaccacccgggggcccaagatcagcgacttcctctgcaacgcctagtaccacaacaacctttccaggcaacgtgggcttaaactgcgact

SEQ ID NO: 64892 - DNA, 249 bp, Triticum aestivum
  unsure (1)..(249): unsure at all n locations
  Clone ID: PAT_TA_64892
cgctattattctattgctcttgctcgctcgcccaacagggacgcgtatttgcgccttcttggtttcattacacgttcttctacaagaagccgatccggattgtactggccggtctggacttccgacaggacaccctngacgactagcaagagctgtctacatatagctcgcttccaaggattgggtttggaggagaggctggtcgattcccaggaggaagaagaagctgcaagagcacgcaaaggggga

SEQ ID NO: 64893 - DNA, 372 bp, Triticum aestivum
  Clone ID: PAT_TA_64893
cggacgcgtgggctaccacacacacacacacgcaccgggcacgaacgcacgcgcgcaccccctgaaggccagctgcctgtgcccgtgcgccgactcgccggagcttggcgttggaacgagacacggagcttgcgggcttccgggaacgttacacgagctcttagctgggtcttccggccggcttggtttgtttggccgtgcgcagcgcgccgagtgacatgacgacgagccaggacgtggttgtttcggagatgggcattggggcgggtggggcggccatgccgggctccggcgccgggggcctcttcgcgtgccgcagcgccgtcagcgctcgagccatgaacatgcgggagacgtaccgagacctcgccg

SEQ ID NO: 64894 - DNA, 262 bp, Triticum aestivum
  Clone ID: PAT_TA_64894
cccactcgtccggatctagatcgcgagcgaccgcccggaattttttaacacctgtagagattatttcaaaagccgaaacacctttttcggttttagcttacgtgatttaagacttctttgcaaatcttgaaggagtgcgagaacgggcacgttggccccaacggcgatggcctgtgcgtgggacaaacagggcgggccgaaccgctcaaacggggaaaaggcgtcaaagaaatttgcggaaaccacctggatgcaaataaac

SEQ ID NO: 64895 - DNA, 184 bp, Triticum aestivum
  Clone ID: PAT_TA_64895
ttctctcgcccggccacgcggccggcgacgcgtgggatttttaccaggcttattgcgcttgaccccggcctctgagcagcccagttacgaacatgctgcagaaggatggccgcagggcagccctaagcacgcctgagtatgcccgcgccccacaagaacaccgtatcgcaccccaactaactgc

SEQ ID NO: 64896 - DNA, 251 bp, Triticum aestivum
  Clone ID: PAT_TA_64896
tatacttcgcaatatcacaagcgtgatgttacggggtgtcatttgaggcatgttccatctgacatcactgcgtttgtgcctattactcatacatgggtatggcggagatgtataaattagcaaaagaaatagcgctccaaattgattgcgctggaaaaaactgaatgcccgactacaatcgatggtagaacatcagaaccgagatgccagcctgacggggaacgatagaagaactgtcgcatccgcgtggc

SEQ ID NO: 64897 - DNA, 319 bp, Triticum aestivum
  Clone ID: PAT_TA_64897
acccacgcgcattctttgacaacgccgcgaaaaagtgtggcaagaggggcttgagagagagaatgtgtggttggtcgaccggcacgagaaggctgaagcaaggacgccaagagcggggataccagcaggcaacccaaagggcggaacaccaacaggaaacggcgcaaccggcgccgaaagcgcagccgaggaaagccaacaaaacaacggcaccgtccgactcagcagggtaatgcgcgagaaccccaggcagtgggttgaacatgccagagcttggaaacacaagctacacgagacacggaggagaaagcggaaggag

SEQ ID NO: 64898 - DNA, 260 bp, Triticum aestivum
  Clone ID: PAT_TA_64898
tgttttacctatgagaattggccatgccctttggaagattgcgatcgagagcagctacttccagcaaggtcgtggtgcaacccgctgatacagtggtatggtttgctagaatcaggaattcatttgttttaccctgaacgatgtatgactgtcgcagttctgtcatttgcaaaactataatgaatggacagccctatgttttgcaaataaaaaaaaaaaaatttaaccttaaattacaaaacttattattctttcactct

SEQ ID NO: 64899 - DNA, 417 bp, Triticum aestivum
  Clone ID: PAT_TA_64899
tctttcatccccgataccaaagcccatcttctgggccttgaaatcattttgggttcacagatctggaggatgtcttgcaactgtggatccggctgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaacagtggaggtggatgcactacttcgtgcctacgagagaaggtgtgagagtatacttgaataacgagcgtgtgatcctgaggagtcgagcaagggtgcgtgtgcgtgagatttggttgcttgctctcc

SEQ ID NO: 64900 - DNA, 265 bp, Triticum aestivum
  Clone ID: PAT_TA_64900
tattttgcgtgcctatccatatacatgcgtcgagggcaaaattaaaaacagatttttcctacgtttccaacaggaccaaacagacacaagtaaaaagaaaagcatggcacgtgagacccacgaacgcaaaggggggcggccgttcaagaggccccaggctaacccccgcgaccaggccgaactcatagctctttaatagggcccccaaaagcaaaacaacgggccggccttaaacaacgattggccgggaaaaacccgggggaac

SEQ ID NO: 64901 - DNA, 417 bp, Triticum aestivum
  Clone ID: PAT_TA_64901
gctttccaagctagcacgccacgcgtgacaagtggtctttcatgggagcttcatgcaatatcgaagcaatggcgacctgcgctgtgcccattcagagagaaatgcgcttttgcaacttctcaacagatcagctggcccgcactggacgtgttatttatgtgtcggcagcagcatatgcttccagcgagtacgtggatggccttcatgtgcccggccctgcgtgccgggacttgcaattcggtccatgggatcgctgtgtctcaattaggccgcattgcttttcctactgtatttaaatatggcgtccatatgatcgaaccatcgtcagcacctttctgtatgagctatgaattcaccaagcaagtgactcattccttgatacctaacccacagtattctggcacctttaactgctct

SEQ ID NO: 64902 - DNA, 474 bp, Triticum aestivum
  Clone ID: PAT_TA_64902
ttcttttcaacaactgagctagttggcactccgggctacataccacctgatttcggacatggatgggttgctacactgagaggtgacatgtacagtcttggcatggtgctacttgagctgctcactggaaggcggcctgtgctggtcttgtttttatcaaaagaacttagtgaactgtgtacaggagatgaaatcagaagggaggcagattgaggtcctggatactacactccggagcacagggtatgaagagcagatgttgaatgtgctcgaagccactcgcaagtgtgtacactataatcctttactgaggccaaccatacaggagatagtgttcttttctgaaagtttagacgccaagcttgagacacgaaattcagttcagatagaaagaggttagacttgattatttggaagtcaattgcacatggcagacgtagctttcaattaactagtactgttaaatttatactt

SEQ ID NO: 64903 - DNA, 441 bp, Triticum aestivum
  Clone ID: PAT_TA_64903
aggcacctgttaccggcacaccccggactcgacccacgcgcattttttaccacaccaaaccctagcctcctcctgcgcgcgccgccgccgccgccgccatgtcagggaggaagaagacccgcgagcccaaggaggagaacgtgacgctcggccccgccgaccgcgagggggagcacgtcttcggcgtcgcgcacatcttcgcctccatcaacgacaccttcatccatgtcacggatctgcccgggagggagacgctcgaccgcaacaccggcggcatgaaggacaaagctgatcgagatgaatcatcccctaatgcagctatgcttgcaactcaggatgccgctgtaagacgcaaggagcttggaatcactgctctgcacattaagctccgtgctactggtggaaacaagacaaaaactccaggtcctggagcacaagctg

SEQ ID NO: 64904 - DNA, 345 bp, Triticum aestivum
  Clone ID: PAT_TA_64904
ctcccatgcttccaaccagggcggtttttacaaatggttttttatcctccgctcatgccctgtgtgtcggcaacatgtgcagcgtatataggaatacatgcattccttacaatcgagttctctgtcctagaaggaattaattatcgcaaatactctgctctcatacaacgtaaaaagggagaggagagagagcaagcggatctgtacacaccgagtactccaagcaagcggatctgtacacacccgcgactccaagcaagtggatctgtacatctgacacatgatcttacattctgcggaaaatgatgagtggaaacgcctgtcatagaatgaatccaatacatt

SEQ ID NO: 64905 - DNA, 188 bp, Triticum aestivum
  Clone ID: PAT_TA_64905
ttctgctccgcacacgggacagcggcggcgccgctgaatcaggagcccaccgacgccggggtggacgccgggcgcgcgttccgcggcgtgcggaagcggtcttggggcaagtacgcggcggagatccgggactcgacgcggaacggcgtgagggtgtggttgggcacgttcgagagcccggaggcgga

SEQ ID NO: 64906 - DNA, 475 bp, Triticum aestivum
  Clone ID: PAT_TA_64906
accttttgaaccctacccacctgagcgtaaactaaggggacctttcaaactactaccttcaaccctcccaccaaccactgtgcatacaccctcccatgatcccataaccctcggaccccaaaacagtcaacgccaggggaggcacctgcgccgcccgcaccccgaacgtgctccagggcttgcacgaaccagcaaatacgcaaaacctacacatgccgcggcacaaaagaccggcgtccgcgacaggaggagagactttcgaagccgaaactcgagagctcccgcgcctggattgctctcggcagtcgcccagggtagcgcaagcagctaaggatgctcggacgaaacaaagcaacaaccagaacaggcggcataaaccacccggcaagagaagaaaaaggcccccaagggaagaacctacccaaaagacgccatgccggaaggcaaagggcccccgaagcggaaaacattccca

SEQ ID NO: 64907 - DNA, 206 bp, Triticum aestivum
  Clone ID: PAT_TA_64907
tctttcggcatgctgaggctgccggaggaagagcagcacaagggatatctcagagctctgtaccaaattctccgccagatgctgctcccggcatcctgattcgaacttccaacttcacaaacgattctatatgatgccttgtggcgccgattgcctctaaaaaaaaaataaaaaaaaaaaaaaattaaataaaaataaaaaataat

SEQ ID NO: 64908 - DNA, 339 bp, Triticum aestivum
  Clone ID: PAT_TA_64908
ttattttagcagacggccatagcctagaccatacggggcttccttcaacatttgacgggcggcaaacccatgccctcagctgaaattagggtcgcctgcagagcagagaaggcagacggccatggacggcgacagcccggcgatgacggacagcgagcggagggcgaaccggtacgtgcaggcgcccaaggtgcatggcctgggcggcatgaagaactacatggaccaaacgacatctctcttaagcctcagctacgccggcgcggggggcagggccgtcgaccactcgtgcgactgcgcgccaaccacgcacccgggctccttccgctgcaagcacca

SEQ ID NO: 64909 - DNA, 423 bp, Triticum aestivum
  Clone ID: PAT_TA_64909
tcttttcccccaacggcttgagggcattgatggatcatttctatacgccttccacaacattgccctccacgatgtcaacatgcgtgcattggacggtcttatgggaccagtctatgcaggcactggctgacagcttcgccgtgtctgcactcctatggatttgaccctccacgctccacagaacacggaggctgctgcagcagttgcttcctgaagaagcgcacgatcaagagcactgtttcctcaggcacatttgaagagacaacggtctttgtgcatggcaaactttgatgatgaggagatgaacatgtcaacattttccaagaggttcggttattcaaactacctcatcaactctatctcgaatgccgtttctaagggcgcccgcttgatgtcaccctgggtcaagaagggcgtccacca

SEQ ID NO: 64910 - DNA, 178 bp, Triticum aestivum
  unsure (1)..(178): unsure at all n locations
  Clone ID: PAT_TA_64910
tanaggccacgtgatgttcggaactcagagcgtaagttctaggaattttgatctgcgtattgccaacatgatctgattatctcatcgtttatctgaagtgattcgatatattaaaaaccaaaaatacataaaaaaaagaaaacataacaaaagaaaaaaaaaaagaccaacaccaatg

SEQ ID NO: 64911 - DNA, 373 bp, Triticum aestivum
  Clone ID: PAT_TA_64911
ttcttaaccccggcaaaggcgctgccatgatccgcgggctttttcaggactgtttggggtggggccgagatgcactggccctacgggccccgactggggccaagccggcgccagagaaactcagtcaggctcacgaccgtcgcgtgcgcggctgccagcatggtgacgcccatgaggacgccctccaggcggactgcccgggcgcgcgcctctgaggagacagagatggctctgcggtccgagacgggcctctgcatgctcaggaggggcaaggaacactgccagaggccgaacggccgccgggacggcaccatgtccaacacctacgagccggtcaaggtcctgggcccgccgacggccaacctcagcgacc

SEQ ID NO: 64912 - DNA, 366 bp, Triticum aestivum
  Clone ID: PAT_TA_64912
ccgggacacgcggcgggagaggaggatattaagacagttttgtggtgctgcccgcgacccccacggagcgcacggccacccagcggggcgcagggtgcgggactcgcggccgcgcaggctcatggacgacgcgcgcgccaaagccaagaccgggcgtcgacactgccggccgccggctgaaagaaggcacccgcgcgcgcctacaagggcaacgacagagacactggctcccaccgcggcatagacagcagatgcagcggaagacacgaagtcaccagctcgaagctgcgcgcggaccaccaccatggcacaggggggaccctggcgcccccctaagagcgagacgccgacagggccgtatggcag

SEQ ID NO: 64913 - DNA, 454 bp, Triticum aestivum
  Clone ID: PAT_TA_64913
cgtccgggggaattcggcaattacacgaccacatgttagcccttaaaagagaagaagctcaagtgcaaggaagattcaacaattgatcggtttgaaatgcgaggcgatatctgggcaaggagaaggacatgcctgcgggataactctgcctttcacttgatccagtggaggaggacagcggggcttcggcgagtacaagtgcagcagccacgggaagcctcatcgcagaatgacagcaacacgctccttaaggaactgtatgtcacgatgaagagtctcctcgaagaattgaaagtcaacaccaaggcagcgacggagtcatgccagcttatcgccaaatcttgtcaagaagttatcgaggcctgcaagatctctgcgaccagcacggggacccgtattgtgaactgaggaaccgcatgtagatgagtagccgtgactttacatgtagatgagt

SEQ ID NO: 64914 - DNA, 339 bp, Triticum aestivum
  Clone ID: PAT_TA_64914
ttattacaatcaaaaaagaaaagacaaaaaagggggactttataccatatatatataaatatctcatcgaaagaaaaaaaggatacagcggggggcccttaatacggggcggtcagcttgaagggccatgcatgaagtcacgagctgggaagcttgctgttgttttaagatgtagacaaaatgaaatgacgtgggcaatgaggaacaacttcttaattggagaaactcagagaaaaccaaaataaatggccttgtagaagatcccactttacccacgcgggcatgcaacgaaaaggccctcacatagcgccctctaaaacaaatgcactgcccgaaggg

SEQ ID NO: 64915 - DNA, 433 bp, Triticum aestivum
  Clone ID: PAT_TA_64915
agctggtacgcctgttggtatctggtctggtatttctgggttgactctacgcgtctgttttcgcgtttgtccacgcgttcgtttacgcgttcgtccacgcgttcgtccacgcgttcgtccacgcgtccgctttttttttttttttttttttttttttttttttttttttttttttttagattggaattattttgatccagaagctcttaacaggggcccaacattgcacgttagtgtccttgtaaggatgtttactttaagcttcagttttatgcagaatttttttgaattgattgattggtagagattttattacatgataccatgttacacaattttacagggcacgattggattgtggttggttgccaaactgcaggggttgtgattttaaatcaaaaaaataaaaaaaggggtggtcggttttgaggat

SEQ ID NO: 64916 - DNA, 317 bp, Triticum aestivum
  Clone ID: PAT_TA_64916
ggggggcataattaaagggaaccgccgcgatctgccaagcagcaccgaaggaaggaacgggcctccaagcgaagaacaccagcgcccacttggcacagattctaaggggaggaggccatccaaatgcccaacaggctgcccaagctggtggaggaaaccaacgcaaaaaccgcgatgacagaccgggagggactacagaagaactggagcgctgcgacgcacacgtacagagggaggtggcatgcgacaggccttatgccggcaatggctctgcgaagaccggccggagatccctagatgctacacaccatcaagat

SEQ ID NO: 64917 - DNA, 269 bp, Triticum aestivum
  Clone ID: PAT_TA_64917
tggttagacaccaaggaacacaaggaaggacggggcctttgttgaatgattggtggatactaaaggagcgtaatcatattgtacggtgcgcaagaggggcgacaggttaacacgatggaggatcacgtcacgcacgattggcctcaagttcgatcgttttgagagtgaaaggaagtcaatttactgggcagaagattaaagtgttcttgaggtataaacccgggtttcaccgagatagagtgaggagcatttattctatatatgccctg

SEQ ID NO: 64918 - DNA, 372 bp, Triticum aestivum
  Clone ID: PAT_TA_64918
cttgtattccacaggctacacctccaagtgagttcaccctgtttgattcggtgggagctcagcattgtccgggcccggcaagggaggcaaggggccgggcaagggcggcatcgagctccaccggcaggtggctctgtgacaacatccacagcatcaccaaatcaactgatccggcctctcgcgcgcaggggcggaacagacagagcatctgctggctcatttacgaggagacccgaagagcgctcaagatctgtctcaagaacgtcatacgagacggctgacactacagcctagcacttgccgctgtatgaccgttacacaacatggacgactggtacgacctcaagcgacaggaactcactctctacggat

SEQ ID NO: 64919 - DNA, 410 bp, Triticum aestivum
  Clone ID: PAT_TA_64919
tcgtccacgcgtccgcgcctctcgccccttccgtccccttgccgccggagcgagcaatggacctcgacgacgacatggtgccgtactccccctccggcgactcctcgccgtcgtcctccgacctcgacaccgagtcgacggggtctttcttccctgaccggagcacgacgctggggacgctgatgggcgtgtcgacgttcggcggcgccggtgtccagcggcggctgactcgggcggcgccggggcaggagagcgagaggccgacgcgtgcggcaacggaggagcgagacgggcggcgcgcgggcgggtggcgacggaggaggcggctgcggtgcggcagctggtggcggctgtgccgcgacgacgccagcgggccgtcgacgaggctgggcgagttcctggacatggag

SEQ ID NO: 64920 - DNA, 356 bp, Triticum aestivum
  Clone ID: PAT_TA_64920
tttagagacccaccgacgcccgtacgattggtcctactgcaattacaccacacaacggtgctccgctacgctgcgctcgctctgcccgcaccgtactgttcacaaggggcgtgggcgccggtcgccgacagtgaccggaccgagccgttcgtgcgagcacaggacgcggggaggagatgccggctgatctccggttctcagacgcgtctagctccagcgggaggaggaggcggcgtcatcgatctcggcgggggaaaggcgcgagcttgggcttgcctgacttattgctgacggcgggggcgaaggggagggcagaggcgatgctgcggctgtagtcgccattcgcagtggtgcct

SEQ ID NO: 64921 - DNA, 395 bp, Triticum aestivum
  Clone ID: PAT_TA_64921
tttttgcggccattggtgccatgctgcgtgcggtctggagaggaacttgatcagaccaggcccgacactcaaggggccgatagggacgactgagatgcagttccagtgtcttggttgcagccattcttctgagatgtttggatttgttaaggaggtgttcaattgctgcgcagagaactggaatgctgagacgctgatgaaagagctagatgttgtcagcaagtccaaaggcatattggcagcaaatcaggcgagccaatctacgattccccttctatctccggccatcagtccacccaaatccttcaatttcaatgccagcacctccattctcgactcacagattgatgcgctcaagaccagcccaaagtccctctctattgaaccctgttttg

SEQ ID NO: 64922 - DNA, 489 bp, Triticum aestivum
  Clone ID: PAT_TA_64922
tttttgctaggatgaatttaggaatggttgccatttcatggtacagttgagctgatgttgagtatctgtttatgtgtaacggttcatttcctccttttctttctgcaacatttcgtgaacttgcttatacaaagattcatcacataggcctttagcttgattgttccgccatgagaaccagcatgactttggatatatgtttctgcaggtttcagaatgtatccaagattgcagggaagttaattacaccatctgtggaagatgggttgtggaagatggacattgcccctcaggtaatttcactttgtcctagattaataacagattactaatttatttgtttaaacagggcaggttatttacgggagtattttctatgcagaaacttttagaattaactttgaccatttactattgacttgctaaattacatgttggcaggactattcctgcagcctagtataattgctctgccaatttccaaccaaa

SEQ ID NO: 64923 - DNA, 288 bp, Triticum aestivum
  Clone ID: PAT_TA_64923
tcccacgcgtgcgtccacgcgtacgaccacgcgtccgtccacgcgtccgaaaaagaaaagaaaaaaaaaaaaaaaaaatgaaatatgcttatgttctatgagggaggaaaaatggtgtagcaaatgatcacaaaagtcacagtggatagaagcaatgatatcaataaaggaatgaaacaacggaacaagaaatagaaataaaatgtagcatctcaatgggttggcagaatattgttgaatgtatagaaaactgctgcgaaaatgagcgcatgtatagtaactggttgg

SEQ ID NO: 64924 - DNA, 374 bp, Triticum aestivum
  Clone ID: PAT_TA_64924
ttgtgcagagagagctctgtttctgtggaacaacgatcatattgagggtttaatcaaacaaaacagcaaggtgttactgcccataatccttccttcgttagaacgaaatacaaaaggtcattggaatcaggcagtgcaaagcttgagtcttaatgttcgcaaaatattcttggaccatgaccctgtactctttgaggggtgcctgaagaagtttcaggacgatgaagctcaagaagatgcgatgcgatcaaaacgtgatgccacatggaagcgcctagaggaaattgcctcgtcaaatccacaagcagggaggccacaggcaatagctcatcagcagagttcttctacctaaccttctggctgacttgcatatg

SEQ ID NO: 64925 - DNA, 402 bp, Triticum aestivum
  Clone ID: PAT_TA_64925
ttgtgccggccgagggcccgcgtacggcgcgctggcgtgatcgctcgatccaatcggcggcccgtgcctccctccggcggtcaactcgagcccggctcggccgcaggggcgtggcggtaaaatcgcgctgcgattttgcgattgatgaatcgaaatccatggtggtggtggtgcgcgggtggtggcggtcgattatttttctcttgttctttctggcgtgaaggcgaggggtcggagcgtcggctcggaccggacggtgcgcatttcccacccggcccctcgctgtttctccttatcgcgagacaccccctagcagtgttcctagctctagtttccgttggttcccctatgtttgttctgggtaagacgatgataagatttgacagaaattgaagagtaaaa

SEQ ID NO: 64926 - DNA, 377 bp, Triticum aestivum
  Clone ID: PAT_TA_64926
tgttcgaccgctgcatgcaggcgaggcctagctagctagtgtcactaaccaagcagagcactaaccagtctcacaccggcggccagccatggcgctcgcgtccctccccaaggtggtgctcggctccttcgccttcgccatcttctggatgatggccgtgttcccgtcggtgcccttcctgcccatcggccggacggcgggctcgctgctctccgccgtgctcatgatcgtcttccacgtgatcagccccgacgacgcctacgcctccatcgacctccccatcctcggcctgctcttctccaccatggtcgtcggcggctacctcaagaacgccggcatgttcaagcacctcggcacgctcctcgcctggaagagcc

SEQ ID NO: 64927 - DNA, 264 bp, Triticum aestivum
  Clone ID: PAT_TA_64927
tgttctaccgtacgctcccacaatgagatgaccaattggtttagcatcaacctgattcttgctgagtgaggctcctcttctcatactctgacctcggaggatgtcatgttctgggatcgcaatctgaccagtcagtatgcggcgtataggacactagaagctatccctcttgcggggagtattgatttctccgtcgacagtccactcggcgttcatgcgaaattctaaagctgattgtgaagatccgagtctgattttcaaggg

SEQ ID NO: 64928 - DNA, 281 bp, Triticum aestivum
  Clone ID: PAT_TA_64928
caaacacaagcaaccttgcaaatttatttttagggaaccttaagaacaattttaaccttggatacccactctgtgtccctaagacagggatttaacacctggtacacgttacccaataaccggacaatagcactaaaccggtggggccccaagtcgactttttttacgccaatacaagtgcccatgttccccgggtacgtaccgggggggaaacttcccggagacgagtggctaatatccgggggggttctttgcacggggggcggggaaaaatgtccggg

SEQ ID NO: 64929 - DNA, 151 bp, Triticum aestivum
  Clone ID: PAT_TA_64929
ttttaatatagaagaactctaaattattatgccatggatggaacatgtcattaatctggtctttggttattcggtctgacaaaagaattggatgtaagtgaattttgtatcaggaaggcaaacattacattgcgtgtcgttttcatgatgt

SEQ ID NO: 64930 - DNA, 287 bp, Triticum aestivum
  Clone ID: PAT_TA_64930
ggctcagagaagaagaaactccaagcctgcgtggcgacgatgaagctggttcgaccagattagtacagccagcagtgtgcgatgtcaaccaccatgatgaatctgagctcggcgcggttcgttgcgagttgagacgggatctacaaactgaatctgtctccccgttgaagaccctctctgttaaaagactcacggaagaaacaaaatggtactgctaattaggactccctctgtaaactaatataagatcttttagagtactatcgagaaacatttctgtttcaaaa

SEQ ID NO: 64931 - DNA, 261 bp, Triticum aestivum
  Clone ID: PAT_TA_64931
ttgtctacctgagctcaccttttacttcacgtgttccttcgtgtcagcttatagatcagctcaatctccgaggacttgttcaaggagtgcacgaccagggtccaggccaggcacctagctacggacgtagctagcgaagagccacgtcgagcgcgactagcgcgcgggattgtgttccaacggcaagtccaaccggaagaccaacgccgacgccgcggtcaccaacggggacagcaacggcgggcccgccaagatgtacca

SEQ ID NO: 64932 - DNA, 250 bp, Triticum aestivum
  Clone ID: PAT_TA_64932
tgatcgctcacacgtgcggccactcgtcggcgggggcgtatttgtaaatgatccggcggttcaacgagtaaagaggaaaagaagctggtctccgccaccaaggagggccaagaagcacgctgacagcaccggaatagatgaagaggaatgcagaactaaagaggaagtccgaggggctatccaaggtgatcaaggacgcgctggccgacaggtatgcgaaggtgagcgactcaaaaagaattgactattc

SEQ ID NO: 64933 - DNA, 416 bp, Triticum aestivum
  Clone ID: PAT_TA_64933
tcgaaaaaaaaaaaaaaaaaaaaaaaaaaaaaagaaaaaaaaaaaaaaaaaaaaaaaaaaaaaaaaaaaaaaaaaaaaaaaaaaaaaaacaacaagaaaaaaaaaaaaaaaaaaaaaaaaaaaaaaaagggggggccgttttattggaccaacccttattaccccggcgttgcagcgaaatattttttttttggtggccccaaaataaatttaattggccggggtttaaaaacaacgggctggggaaaacaatggtgtgacccaccaaaattgttttcaagaaaaaccccctttttacggcgggtggaaataaaaaaaggggggcccccaaggcccttcccaacaaatggccaacctaaatgggaaagggaacccccccttctcgggggccataaagcggggggggggggggggtt

SEQ ID NO: 64934 - DNA, 168 bp, Triticum aestivum
  Clone ID: PAT_TA_64934
ttgtgccgcgaaccaaacgcacccttggttgcagttgcaaagagctagcacatcacgtatgtatgtatgtacctgcagaactctctgaatcaccccgagtgagagaacctatgttggactgagccgttttattcagagttgctgccagtgctggttttcagagtgtcg

SEQ ID NO: 64935 - DNA, 488 bp, Triticum aestivum
  Clone ID: PAT_TA_64935
tttcgtgtatgatggtattctccgcagcatcctgctgagcccgacgccgcagaacttgttgcgggctgatgtcaatcttcttgattaccgtggcaagcaaaacagagatgcagctgcggttcgccagaggttttgtgaattactccaaggcttcatccacgtcaagcagatcaaattgaatatccgtcttcggaaaggtttcaatgttaccagccacggcgttcttcttccagtcctactcaacatcgagtgcattgagcttggtctcgtctactcaccaagttgcaaggaagcggcggcaatgttgattgcggagctacttacctgctgtcctaagctccgtgatcttcggttcaaccttatcaccagttttgaagaggatggtcgccgctctgagggatctggaaattggccgacagtgtgtctagagaaggatttcaaggagtctgtccgccgttcaagcgccgtaaatgcagctgatgtgcagc

SEQ ID NO: 64936 - DNA, 223 bp, Triticum aestivum
  Clone ID: PAT_TA_64936
tgccacgcgtgcggaatcgtttgagtgggcgttttctttgccctgctctccctcaagccaacccacaaaggtgggaataatggtcggccaaggcgaccgacgtgggtcactcggggggccgcccggtggattacgatgaagatgaatcgtcaagatactgttccatcttgggtgcggatattgcagtatttcggacgataatgctaatgaagctgcttatgta

SEQ ID NO: 64937 - DNA, 441 bp, Triticum aestivum
  Clone ID: PAT_TA_64937
tcccacgcgtccgcggacgcgtgggcgaggatttttgacagctttgtgctgacccaagagcaaaagctgctgtcttggctgacatggattctattggaaaggaagcacagctaagaggttttgaattcgccaaagctgttactcttgttgctgaaccattcacagtagaaaatggtctcctcacccccacgttcaaggtcaaaagaccgcaagctaaggcctatttcgcgaaagaactcgcagatatgtatgcacagctgcgtgacgccgaatcagctaggcagaagttgtaattaatcgagaaatgttcaggagtaaggttcaaaccaatacaggacaggttcacacaacggagtaaggatttctcgtttgctccatgagcaggaatacctttcagccgtcaacagtcaggagtggtgctgggtgtgggtatctcttatt

SEQ ID NO: 64938 - DNA, 257 bp, Triticum aestivum
  Clone ID: PAT_TA_64938
tttctggtggaccttgacaagatgcttgagcgtgcgaaactcgccaatgagcagcgctactttgacgaagacgacgattagctattcaaatttgtttggcggctaccagggtttttgcagtttgctttggtcagaaaaactggctccgcatttcatctgcggtagtgtaataaactgatgtttcacagtacttgggttgtacttgtacgggagacctttttatggtacttgaatctgattgattaccttctctgaat

SEQ ID NO: 64939 - DNA, 522 bp, Triticum aestivum
  Clone ID: PAT_TA_64939
tttcaaccgcgtcgcttaatcggaagccgccgccagggaggaagagaacggagcgaggagccatggccgcccggaacttcttcgtccgatcccccaaggaggaggaatccagcgccgccatccgagaggctgtcctgttgggagggaagaacgccgccattgctggcaccgtggtcgcggttcccacggtgcgtatttgtgtgctgaattcttgtgtgcatgctcgcatatgtcctgacttctggcagatctgatcttgtgcagttcgttgcttgccgtgtccttccttgggctaagcacaacctgaactacaccgcgcaagcgctcatcatatcgacagtcctgtgtcgccggcttcttcatcaccgcggataaaaccattctgcgaaacgcaaggcaaaacaccatcggattggatcgacgagtcgacttgatccaggactgtacagaatcgcaggccctctgttccatctatgatccatggatggtgctgcatgaggagacgtcgaatttcagtttcag

SEQ ID NO: 64940 - DNA, 160 bp, Triticum aestivum
  unsure (1)..(160): unsure at all n locations
  Clone ID: PAT_TA_64940
tgctcngagagattcaggagagccctaatgagtgagactgttttcatgttttatgcttatgtcgccccatacacacctatgtaattcgagagtctatctatgatctattagcatacattggcataagtgttcactttgtggcaataatacttatctaata

SEQ ID NO: 64941 - DNA, 222 bp, Triticum aestivum
  Clone ID: PAT_TA_64941
tttcgacccacgcttctaccacgcgtcggagagaagaagaggaagccttgcagcagtggcgagggaagccaggatgtgcgcgaggggacaccgcggatgaggggtgctcccatcctgctccgctcgagggggatcgtagagcctgctgtatgacctgcctcaccggcgccagccctgcacccgcggcacgatcccatgccgcgactcctggaggaccccaag

SEQ ID NO: 64942 - DNA, 417 bp, Triticum aestivum
  Clone ID: PAT_TA_64942
tttctcggaagtacgggcctctgaagctgcaagtgttggaccacgacatggtgtccaaggacgacctgatgggggaggccgagatcgacctgcagcccatgatcaatgcggcagcatcgtttggagatccagaactgctcggcgacatacagatcggccggtggctcaagtccggggacaacgctctaaccgccgacagcgctgtcatggtgaccggaggcaaggtgaagcaggaggtctccctgaagctgcagcacaccgagtcgggggaggtgacggtggagatgactggggatggctctaaacatttagagaatccggatatacgatggcaaatttgtactttgctgcaaaggatccattgaatcgactttctgggaaaaataataatttctgctactagtagcaggcaatcac

SEQ ID NO: 64943 - DNA, 487 bp, Triticum aestivum
  Clone ID: PAT_TA_64943
tactatttgtgagatgctccgccggctggtgccgccggtgcattattgggtggtcccacgcgtcttgttacgcgtccggccacgcgtccgcccacgcgtcctcccacgcgtccgcccacgcgtccggttgaagtgtttgatgaggaaggtctccatattctcatgggcatggcttttcttacctatctggagctaaaggtatcagagacagccggcgtcatgactgtaagtagcaacgggttcaagctgctagaggtgttccactacagaattaatgaagaccgtttgaatgaaggcgaagcaccagggatagaatttgcagcaggtgctatgccagcactccggcggctccatcttttctggaacggaaattttgctagtgatggtgctgacatgggtatccagcatctttcaagccttgcgcaccttcaagtggaaactaggtattataatgcaaccatggaagaggtgaaggctgtggagggtt

SEQ ID NO: 64944 - DNA, 390 bp, Triticum aestivum
  Clone ID: PAT_TA_64944
tggtcatctcctccgccaccaccaccaccacgtgcccggcctcgctcctcgccaggcaggccgtccgccccggcgccgccgtcgtcgcgctgacctccgcgaacggcggcggcgacgacgcccccgtccggcccgtcaaggtcgacgccggcgccgcgtccggcgggaagccgtgaagctgaccggccggaacaagggtgcatccgtgcatgcattatctatgttattaggatataatcacatgtatcgctcctgtatactgcttcccttccaattttcttgctctgaagatcagactcaccatgcacacgtacgtgcatgtgcatgatcgagcgagctcccatgagaaggcttatctcgctccctccatgaatttgcatgaagatcttc

SEQ ID NO: 64945 - DNA, 163 bp, Triticum aestivum
  Clone ID: PAT_TA_64945
gaatttgcgggtcgccccaaacattgggttaccaccgtctacccgcggcgtgaggggaccatgaaagagccaggacctcagctgctgtggggtgaccatgatgggtgaccgtcatggcaacgggctgcacgatggctccagggggccaatggacttttgtgga

SEQ ID NO: 64946 - DNA, 197 bp, Triticum aestivum
  Clone ID: PAT_TA_64946
ttgtccaacggcactgcgccgcaagagcttacgatgactgaatcagcagcactgctgccggaggcaaacacctgatgagttcgcgtccgaacaacaggcataatcatggccctatggagccattgattctctgtggaggagcacataagggacgaggaactgataggccgcatactatcgctgggggaacaaccgaa

SEQ ID NO: 64947 - DNA, 312 bp, Triticum aestivum
  Clone ID: PAT_TA_64947
tcgctacgcgtgcgcccacgcgtccggggacgcgtggggccgaagatcgccctccgtgacggtcttcccctcatggtcaccgacttccgcaagcggatcttcggcgaccaagataacgctgccaccgccaccaaagggaggttactagagatccggatttcgactgggatgcttgcattcgcagttgcgacgacaaagatgctctcccaatcaagaaggagcgagagaacaagaaagacggcgtagtcccaccggcgaagtaggcgctcgtagtgagcttatactagcgcggttcctttccaaacaaataat

SEQ ID NO: 64948 - DNA, 281 bp, Triticum aestivum
  Clone ID: PAT_TA_64948
tcggtgtattccggtgacggtgcggcgagatgtactgcggtgcacaccggaactctgaccgtgacgactgccgctactactacaaggcgggggccagggacgccatcatcagggaaaacccccaggggcgcgccgccaagaacgcccggatctgagcaacaggacacgacgtctacgcgtacccggggaaacatgaagcaccgagaccactctctgactgtgtctactgagaaacagtaaaggcgtgcgcgagagcttcttaaaggtgaaaaaaacggaga

SEQ ID NO: 64949 - DNA, 278 bp, Triticum aestivum
  Clone ID: PAT_TA_64949
tgggttatctccggctcaactgctggtgatgctacaatagatcattatgctggagtggtgctgcttgctgtcagggcataggctgatgctgtgcatgccattccactaggttcagctgaaaacagtggttcgccgcctatggatactttcaccgagatgaactgccagcatgtcatggagaacaattctagctgcggcaccgatgagcaatgatgtgaggtgccaaagacatgaaacagcagattgttgtggagactctgatagaggagcttgatgac

SEQ ID NO: 64950 - DNA, 160 bp, Triticum aestivum
  Clone ID: PAT_TA_64950
gtttgatctttactactcacggacagaaccacaagcaccacaagtgagtgaccatcggagcaaggtaagaccaggagagatgggaacgcggtctattgtggtgctgggcctggcgagggggctgagcagctcctgactgcgaggtggcgcccgatcgggg

SEQ ID NO: 64951 - DNA, 412 bp, Triticum aestivum
  Clone ID: PAT_TA_64951
tcgctatacactctctatcagtcacgtcaggctcggtggatcacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtg

SEQ ID NO: 64952 - DNA, 247 bp, Triticum aestivum
  Clone ID: PAT_TA_64952
gttacatctaaaaaaacaaaaaaaagagaacaaaaagaaaaaaaaagaaccaataatgctgatagataaaccaagaagagaaagagaacgaacaactagcaaaaaacaatggacataaaaagggggtgcctctctggggaggccaacatgacgaacgatgaactgaaagcccagtctctttttattgggtgaacaaatgaaacttaatgggaggctgtctgaaacgaaagaagaggggaaaccccgg

SEQ ID NO: 64953 - DNA, 254 bp, Triticum aestivum
  Clone ID: PAT_TA_64953
tgggttacccccgcggacagggggcgggagtggaccatgactgactctgaacctcggggactgagtactaaccgtggttaggcttggtccgctcaacttgcatgatgatggtccctccacgccattggatgtgtccggaggagcacatgagaccagaaaagctgctggtcgcgctactttcaatggcaacacgcctgagccaaccatggacctctgcggatacgaaaggagagactgggactacgatgatagca

SEQ ID NO: 64954 - DNA, 302 bp, Triticum aestivum
  Clone ID: PAT_TA_64954
tcgtttacgttttcgcccacgcgtccggccacgcgtacgaccacgcgtgcgcaaaaaaaagatgataaatgaccatgaagagaaagagaacaaacaaatgaggaaaaaaatggacataaagagacattgataatatgaggaaggagaacatgacaagggggggcctgtttggaggactcaagtttatgggcgaataaatgaaaccgaatagtttttctatgggggaccaaaaatgaaatgaactggccggggtttaaaaatgaaagaggtgggaaaaccctggagtcccaaatttaaactgg

SEQ ID NO: 64955 - DNA, 193 bp, Triticum aestivum
  Clone ID: PAT_TA_64955
cttacgcgtccgcggacgcgtgggccatcccagaagacaggactggaagtgtttagacggtcctgccccaatgtaaaatattcaagtttgtaaatgcttatataatgcggacatggagcatgtgatcccgagctggggaaaacaggaccaaagatgaactgattgcccggctgctctcgactagagcacaaac

SEQ ID NO: 64956 - DNA, 185 bp, Triticum aestivum
  Clone ID: PAT_TA_64956
ttcttgtacgcgtgggggaccacaacccgagcgggggcggtttagcaacaccaccgccaccacaccggtgccaaagaagtacgcgctttttggggtaacctagaaaaccaacggcaggaacctaacaacggccactaccgggaaagcttaggccagggacggcaccgcggatggacctcaccaag

SEQ ID NO: 64957 - DNA, 374 bp, Triticum aestivum
  Clone ID: PAT_TA_64957
ttattaccccataccaagctcatcccggggtcttaaatcttttgggttcacagatccggaggatgtcttgaactgaggatcccgctgcagctgcggctcaaactgcaagtgcgggaagatgtaccatgatctgacggagcagggcagttctgccgtccatatatgccgccgcactcgacctcagagcgaggcctgagaacaaggcggggcagatcgtggtggccgtcgggcaagccggcgagggctgcaagctgcggcgacaactgcaagtgcaaccccagcacaggtaagctggatgcactcacaccaacctgtgttggtgagagagtatacgaacataaccagacgtcgaatcttgatcgaaacccatccac

SEQ ID NO: 64958 - DNA, 241 bp, Triticum aestivum
  Clone ID: PAT_TA_64958
tcttggtcacccccggcgcccgggcgcccgagggggaccgtatacaggtatccgcgccaatgcccgcgggagagaggcgaccgggtgcgaccgaggaaggcctaccaatacgaccaacccgccggcgaagatgctcggacgcgaccccaagaagagcgaaaacaccgagagcccccaggcgctcggggcgcccacaaacgccccccaagaacaagctcaacaaggcctaccgcacggccgg

SEQ ID NO: 64959 - DNA, 327 bp, Triticum aestivum
  Clone ID: PAT_TA_64959
ttttgaccccaccaccacctgtacgtatagcggagattatttaactaatattacgatgagaaacaccaaataatgcaatgcatgaaagcccaatcaccattatgccgacacaaagcagaatagtacagcgggctttggaagtggagagcacagaacacacgccactgccgagtgctggtccattcagacacctgaatggtttgcaggagacactcaatgaacggggctctggccggttcggggcgtctactaggggggacttcagagaacaccatgatttagcaaattctgcgttcaatggggcaactaccttgacacaaaactttg

SEQ ID NO: 64960 - DNA, 320 bp, Triticum aestivum
  Clone ID: PAT_TA_64960
tcgtcgtcagctcctcaacgacccaccgcagggggaccttatacaagagatcacgtcgctgcccccagctgccaccatgcagaatgaggtgggcgacatggtggacactcacgcccccaggaagagctcggtcaccaacaggatcatcacggccaaggaccacgcctttgctcagatcaacataggtaatgcagatgagaatggactgtatgatggccgtttaaccaccttagctctgaatgggctcgtccggactcagggagatgctgttggtaccctcgacaggccgaggcagaagaggaaggctgagatcaagcaga

SEQ ID NO: 64961 - DNA, 349 bp, Triticum aestivum
  Clone ID: PAT_TA_64961
acctgaccgatcggtggtggtgctggtggtggtggtgccttttacataaggtggagttgttacacaggccactaaagcttaggagatcaaggacgaagagatggcggagagcaaggactaccttgcctactacttattctagaagagctcattaccactgatgaacagcacggatcacattgttctattgcacgcacaattttgatgccttgcccacagggtacgcgaacctgcactagtttgatagaaatgggatgcatgtgttacttgctgtgcatgcgatgatttggataaactaatatgcactaactaatttcctaaataagatgtaggcttgccagcttacaat

SEQ ID NO: 64962 - DNA, 152 bp, Triticum aestivum
  Clone ID: PAT_TA_64962
gtcgtaccagggtggagacgaaggccgagcgggggacttatactaccattccggtcttccccaaaggccgaggctggcccaggaatcgcctgacacctgacaggaatcagactagcgtctggtacaccagaggctcgcccgggctcaaccaa

SEQ ID NO: 64963 - DNA, 304 bp, Triticum aestivum
  Clone ID: PAT_TA_64963
tccacgcgttcggtgtcgctgcgaagcgcgcaggccgttggcggattggcgctcctcaccgcggaggctctcgtgccaggtcagatatgctatgacctgaaggtgagggctcatggtcggcgcacggcatgtgaggtggagatgctgttggcctgacggggtgtggcagaggagatgtggcctgatctggtgggggcggtgtcagcggtaggtttttctgggttctcacgttcaggtaggtggctgctctgttattgttagatcaatatggagtctttgcgagcatctagctttctgtcattcc

SEQ ID NO: 64964 - DNA, 237 bp, Triticum aestivum
  unsure (1)..(237): unsure at all n locations
  Clone ID: PAT_TA_64964
tctgntcatttacatgtactcatctacactgtgcaatctatgtatgatacaggttacagacactgggagatgacctcccaccaattgaccaccacgtttattagatcaaaggagtcaaaactacaaaacacaggatgatgttgatgagtacatttacatgtaataatccttatgtttgcacaaagtgacagttcatgtaccttttgacagcaagttcaaggtgttgccattcttcgg

SEQ ID NO: 64965 - DNA, 252 bp, Triticum aestivum
  Clone ID: PAT_TA_64965
ctttataccgcatgctgccggaatggtgcgggggcccatgatccagaactaggcctggtcctccaaccacacggtgatcagcgtcgaaaaccgtccccacctgcccctagtacaggctggactagcaaagaaagagagcccgaagactcacggctcttaggcaacacacaaatgctcgtgtgctgacaccgaagcctggaagtacgccgatacttggcatagtgacaccaaagaccatctgaaccgctagaa

SEQ ID NO: 64966 - DNA, 273 bp, Triticum aestivum
  Clone ID: PAT_TA_64966
tctcgctgccgatcctgcctgcgcaaatcgtgcagctagttctcaacaatgcctcctactgaccaatcaagaacatgtgtgaaaatttttcccggaaggcaggggaacaagaatactggaggtgccaacgatctctcggacccagacctgaaaaacactagattctccgtcaacgcacttgctagcttcgcggtgtgcatcacctactaagcacgactggatccaccaaacggcctctggcaagatgatctagatgggcaaaagactggacac

SEQ ID NO: 64967 - DNA, 434 bp, Triticum aestivum
  Clone ID: PAT_TA_64967
tttctcccagatgcctaccctcctaacctcacccgccttcctttactactccccgctccacctcgcctaccgactaggaggagccgccgtacgaacgacctccaaccaccaccgtcggatcctcgcccccgatccccaaaccgcgccgaggggcaccaccaccggcggcgggtacgctgagatgagctggctcgggaagctggggctggggggcgggggaagcccgcacgcgtcggaggcgacggaggagctggcgcaagggcccgacgaggacaagccgacgcccgggtgcgagatcgtgcagttcggagccggctgctcctggagcgaagagctggtgtaacagcgcgtgcccggggtcaccccgaccaaggacggatacagtcagtgcgcctttaagaccccacctacaggacgtttgaccggagccaccg

SEQ ID NO: 64968 - DNA, 419 bp, Triticum aestivum
  Clone ID: PAT_TA_64968
tggtatcaacacgtaccagtacccagcacactagcagctagcttagctcaccatctgctcttagaatggcggcctactacagcgccggcaggcccatgtactactccaacaccgaggagtccttcgacggcggcaagaccgtgtactccaccaccaccgaggagtgctacgacgctggcaagctcggccatggtaccggctacggccagggtcagagctatggcaatggtgggaccaacatgtactccaacaacactggcgtcgactccagcatgtacgggcatggcggtggcggcggtggcaggaccgtgtacaccaccaccaccgacgagtgcttcgactccgtcaggcccgggtatgggcagggccacggctactggcacaacaacggtggggccatgccgtacaccaccaccacc

SEQ ID NO: 64969 - DNA, 306 bp, Triticum aestivum
  Clone ID: PAT_TA_64969
gaacccgaacaacaggccgcccattttaaatccggcgcgtgggttcaccatgattgacttagtacggttgatgctgctcactgaccctgatgagggcccgtccgggcaactggcgttatcatggggcttccgtgccaaaggatgaattgggaggaggccatgactaaagaggaacagaacggccccctgctgtcggtgggagaacaactgaaccaggatgtcagcctcacggggacgaaagaaaaactggggcttcttacgccagagcttaaataggcgcttggcgacactaggcctaagcttggc

SEQ ID NO: 64970 - DNA, 435 bp, Triticum aestivum
  Clone ID: PAT_TA_64970
ctgctcacgcgtccgaaaaaaaaaaaaaaaaagaaaaatttaaaaaaaaatgggggtcaaaaaaaaaaaaaaaaaaaaaaataaaaaacaaaaaaaaagaaaaaaaagggctggccttttatgggtcccaaatttactttcccgggctgggataaacaatgattttactttgagaaccggtgggtccctttaagtggcccggttttccccccccccccctttgggaaacctcgtttttttcccgacttaaacaactttgaaccccctcccctttttccccactgggtgattgggaaaagggccgcgccccctacttttacataattttgggccttctttttgttacttggggcgcaccttttaggggtgccttagccctgccctttgctactgtttctccccctcttgcctttctttttcccccccctttttccc

SEQ ID NO: 64971 - DNA, 167 bp, Triticum aestivum
  Clone ID: PAT_TA_64971
tatttgcccccgcagcgcctggccacccgcgggggatttttaccgtatgacgggtcggaccccatccgtccagccggtaagagtcaccaccccatcccatcgtctgacttcgctttcgaagggtcagatatggtggaccttgctaaccacccttttgtcatgcagat

SEQ ID NO: 64972 - DNA, 121 bp, Triticum aestivum
  Clone ID: PAT_TA_64972
ccccaacctagaacgcaataccttccacttaatcctacttacatattccaacccacaatttctcgctccagagttccccttacgctcatcccctaccatgactgtggtgtccgttactacc

SEQ ID NO: 64973 - DNA, 172 bp, Triticum aestivum
  Clone ID: PAT_TA_64973
tggtaaagatggagaaaatgttgcagagagggcagttctgatccagaatggagcatcgacatgtcttatctcatttcatcaacttaacacacgtacatgcgtctactaaaaaaaaaaaaaaaaaaaaaaaaaaaaaaaagaaaaaaaaaaaaaaaaaaaaaaaaaatgaaaa

SEQ ID NO: 64974 - DNA, 441 bp, Triticum aestivum
  unsure (1)..(441): unsure at all n locations
  Clone ID: PAT_TA_64974
tanctgcctcggcgccatgcaggagggcgaggcggtgcgcgtgctgccggcctgcgcgcacgtgttccacgtcccctgcgtcgacacgtggctcgcgtccagctcgtcgtgcccggtctgccgtgccctggtggagccgccaccgtcgccggccgcgccagcctgggtgcaggagaagcagggcctggagaaggagtgtgctgcaagtgggagctcggcgccgccgtgtgggctcggcgcgtcgctgatgaggatgctgaacagggagaggccgctggcgcggaggctgacgcaaggtgaccacgcgcacccgatggaaatgcatgtcgaggacctggagagtcagcacccccagcagtatcactgtgtggataccaaaaagtgtttttttttgcgttgtgtttttttttgggggttcccatttgttggtcgaatggaaaa

SEQ ID NO: 64975 - DNA, 437 bp, Triticum aestivum
  Clone ID: PAT_TA_64975
tcgtctgatcgcgagcggccgcatattacatcgggggcattttatattcagtgggcataccttgatggattaacaactatgagctaccagtaggaacctaaaccaccgacagggttcccaacagagaatgaaaatagggccaagctttaaggaagaaagggttacggacgagcaccaaatacaggggcgagatgggctttatcgacgggtgcctagttgcgctgtgctggtgatacatctgcgagatgtggtaaaactaaccggtccccaactgaaaggtttctggcacaaggcctctttgctatcgtacccacaaagagcgaatgcgtatacagagagagaattttcaaataatttcaatgcccaatggtttaaggttacaatttattcttctaagataaacacccatgatcagggctgttcccccctacctgtgc

SEQ ID NO: 64976 - DNA, 420 bp, Triticum aestivum
  Clone ID: PAT_TA_64976
tcttttgcatccgatcgacagcacaggacaacgggggcaacttataaccagaggacatacctgctggataacaacaggagcaaccagcaggctcctccaccaccgccagggtacccaacggcggatgcggagcaaggccaagcggtacggatgaaggggggccgggccagcaccaaatccatgggctagacgggcttcatggtggggggcctggccgtgctattctgctggtggatctgcgagaggagctgcgactaaccgctccgtaacagagaggttactggcacaaggcctgggtgctatcgtacccacgaggagcgtatgcgtatacagaaagcgaattgctcataatttcagtgcccgtagctttaaggtctacatatagacgtctaacgagatgcacgcatgatcaggactgta

SEQ ID NO: 64977 - DNA, 279 bp, Triticum aestivum
  Clone ID: PAT_TA_64977
tgttttcaatcaatcaataatactaatagggggtgcttgttgatggtggtgggaatagtccgctaatttgatctggtgctgaactgaacccagtgtggcttacactgttgactgatgagggttgagagagtgtcaatggctctcgcgtctgggcggtggagctgggaggagtagatccttactctgtacgtgaacaggacggcggttggatttgttatttgcgtacaattacaataatggaatgccaatgatgatggttgagcgagcatactagaacac

SEQ ID NO: 64978 - DNA, 494 bp, Triticum aestivum
  Clone ID: PAT_TA_64978
tcttacccctcctcgtcacatcgggcgcctagggttttcccacccgccggccggcgatgcccgcctcctccgtctccggcagcaccggccccggcggcgtgtcgcccgacgccatcatcgagtggctgcaggacgagatgggctacccctccgcgccgcccgcgcccgagcagctgcgcaagatctgccgcggcaacatgctcccggtctggtccttcctcctccgccgggtccgctccgagcgcacggtcgccacggcgcgccggaacatcctcgtccacggcgtcgcggccaggcgggcgcgggaggggggcgtcggggcgggagggggcgacgcggctgccagagaggccgaggccagggagcgggacctcgccgccgaggaggcggaacggctgcgcggtgtcgtgcggaggcagcgcaaggagctgcgcgcccgcatcgcggaggtcgcgcgcgaggaggcctaacgcaagcgtgtgttgggcgagcgc

SEQ ID NO: 64979 - DNA, 252 bp, Triticum aestivum
  Clone ID: PAT_TA_64979
tcttcacgcgtccgcgcccccgtccccgaccggggaagctattggtgctgtattgccattagcatcatacatgacaccgtctacctgaccgcctaagctattggtgctgcattgccattagcatcatacaggacaccgtctacctgactcttcttgttgttgttacaataaacaaacccatgcgtgcagcgtgttaaggtgaggtctggcactttgtttgctcgatgatctatacattattttggtgtttgc

SEQ ID NO: 64980 - DNA, 281 bp, Triticum aestivum
  Clone ID: PAT_TA_64980
acactgtgatatccccttccagcccgggctttggtgggggattttttaagctctatcgggagtactactagctagcctagattagggtttgtgtagacaagaagggagatcaatggccgagacggccaaccgttgtttctgggggagtccatgatgaaacaccaactacaacaacctctacgatggcttcatgcacaactgaaagatcctcgacgccaagatcatcaacaacgcgcaagacggggagggtccgtcagatctgatagaggacgttcgataca

SEQ ID NO: 64981 - DNA, 442 bp, Triticum aestivum
  Clone ID: PAT_TA_64981
ttttcacgcgtccggggaggtgcaaaacctgggcttcctaatgccgcacagaccccaactgcaggtgctcccatgaatcaaggcaccccaatggctcaaggtactcccatgaatcacagcaccccaatggcccaaggtactcccgtggctcaaggtgcccccatggctcaagcccctcctgctccggcacaaagcaccgatgaggtaaagccatcggaggctacaacagctcctgacaatgtggaggctacagcagctaccagcaatgccgaagctactgcagcccctggtactgcggaagctacagaagctccggttccagacccaacaagtagcagtcctgacgctgctgatgctccagcttcagctcctgctccagcagctgattccagtggcactgatgcacttgctgttactcccagtgattttacaaatgatgcac

SEQ ID NO: 64982 - DNA, 350 bp, Triticum aestivum
  Clone ID: PAT_TA_64982
gtctaccacgcgtccgcccacgcgtccgctgccctgcgacacaagccaccacttgaatctcaagcgcggagaggaggaagaagagaggagcaatggagtacgggcacccctgcaacagctgcagcagcaacaaggagaagaggcctccgttcaagagaggccagctcaagctgcagatcgccaggactctcggcagcctcgtggtgccgggcgccaagagcagcttcagcttcagaagatgatcacctgagcagccactcaatcagggcaagcagcattttctcagccaatctacgagtatcggatggtctggtgcttgatgtataccgggattgtgcaagttgaacaag

SEQ ID NO: 64983 - DNA, 436 bp, Triticum aestivum
  Clone ID: PAT_TA_64983
taccacgcgtgcgcccacgcgtccgacaacccggacgatgtcgatgtggtcgtcggcgcctcctccgccacgggattgaatgggctggtggacaggcgcgcgactctacgccctcctcggtcgagggttggatggagccctcggctgcgtgggaacaaccatcggcagacgcgaccccgacgactgtgctcgtggtgctcgctctgatcccacccgtgcttccacaggtgtaccagctcctctctgtatattctttgattttttttctgttcagttcatctttcatggttaattctttgcaacaatttgataagatgctgaaatcaaaggtgtggcctctatttgatgagccagacacaaggaggagtatgggtctgcatgtacatataagaagaagatggcttgaggtgaattgtgtatgttttcagttgcgtcg

SEQ ID NO: 64984 - DNA, 189 bp, Triticum aestivum
  Clone ID: PAT_TA_64984
tttactattcatctcacagcgcaggcagagggggggggtttttagcaaccatggctccacccaaaggtttgcacaatggccgttattgagctcaccattctcgttcgtactggtgctcctggacgtggccatcaccgttcaggcgcccggagcggtccccgcggtaacgctccaagacctgacttcacc

SEQ ID NO: 64985 - DNA, 295 bp, Triticum aestivum
  unsure (1)..(295): unsure at all n locations
  Clone ID: PAT_TA_64985
cttctgtatcattgtggcctcttcaggcttcgtgttgacttcagtcttcgtctgtacgtttgggtgcgtgctatgccttgtgatccgatgagatgctgtattaatcccagtttaaccttcggtgcatctggtgtgttgtgccaatctatatcccactacgattgattgttttgagcattattagttgggaatacatgcggcgtgtnaaaaaaaaaaaaaaaaaaaaaaaaaatactaaaaaaaaaaataaaaaaagaaattagaaaaaaaaaaaaaataaaaataaaaataatcg

SEQ ID NO: 64986 - DNA, 461 bp, Triticum aestivum
  Clone ID: PAT_TA_64986
ttcctttagatgcgagcgccgccctttttgggtgtatttttttgcattgcaatccatgaccccaacaaatcagaagcacttaacaaatacaatctcactccctaacaatacagcaaagaagggaaaatagaaccctcaagaaaagggaaaaatggaagaaccctcgctaatcatcagtaaccaaatgcttcaatcgcacaagacggagaggccaaagccaggctctcataaagggctcacggccgactcacgatcagaggtggtcgccgttcatgagcgcggtggccttggcgccgcacgagacggccttcttgggcaccttaccgacgcggtcgatggccttggcgaagatgacccccatccccatgtggaggtgcggctcgatgtggcagtggaacgcccacaccccggggttgtccgtgacgaaccgtagcgccgttcactcggacaggaagatcacc

SEQ ID NO: 64987 - DNA, 216 bp, Triticum aestivum
  Clone ID: PAT_TA_64987
tcgtcctcggcgcgcgcgcgccctacgcccgcccggcgcttttcgccgcggccatcatggactcggaggagaagtcggcgtcggcgtcggcgtcgtcctcctcgtggctcgggctggccagcaccgacggcgccttcgccctctgatctgcacggacggacggagcaagacggcttgcccgcttcaagagatcgtttgtagagcacttgaagcggg

SEQ ID NO: 64988 - DNA, 356 bp, Triticum aestivum
  Clone ID: PAT_TA_64988
ggctggtcccacgcgttcttctatcgcgtgggctgccatctcctctgtgtgaccacacatgaaactaacttgggacttaaacgccactaccaagggatggactccctgtgaaactggcccattctttctgtggctccacgttttgatggattataagcacgtctgctccattggataacagggtctagtgctcgggaataacaatgtctgcagtgtacgactcagtgttcttcctaaatgacactaccatgcaattggctggttctcatgccatggctagctgcagatactatatctctggtttgttcatgtgcacgcaaacgggttgtttcagcttccttaatggcttactgttg

SEQ ID NO: 64989 - DNA, 391 bp, Triticum aestivum
  Clone ID: PAT_TA_64989
tctttttcgcgtgggctgaaatctcctctctggttttttacatgaaactaacttgtgacttcaacgccactaccaatggaagtactccgtatgaaatttgtccatcctttctgtggttccatgttttcatggattataaacatgtttgttcaattggaaacagggtatagtgtttgggaataacaatttctgcagtgtacgaattagtgttctttctaaatgacactctcatgcaatagtctgtctctcatgccattgctcgtttcagatattatatctctgttatgttcatttgtacgcaaatggctttttacagattccttaattcttgactgttgataagcatatgctctgatccgtgttcctctgctgtgattttgcccccaggtaa

SEQ ID NO: 64990 - DNA, 259 bp, Triticum aestivum
  Clone ID: PAT_TA_64990
tctttggaaggaagaagatggcggtcgaggggaccgacaactgcatcgacatcattcttgccatcatcctgccgccgctcggcgtcttcttcaagttcgcctgcgggatcgagttctggatctgcttgctgctcaccttcttcggttacctacctggcatcatttacgccgtctgggtcatcaccaagtaggactgcatgcaggaggggcttctctgcctctgccgctaggtgatccatggcgaacttgttctgtgtgt

SEQ ID NO: 64991 - DNA, 378 bp, Triticum aestivum
  Clone ID: PAT_TA_64991
tttgaccagagcggccatggccgcaggccactgctaccttcgaccgccacagcctggcgccgcgcgggcgcgagcgccgcagtaaccgacgagcgagatgggttcgccgaccgtaagaaagagcgccgcgtcagccgctggccgcctccactccaagaggagccggggctgcacaggagccgcgctaggaagccccacgcagaggccgaaggccatggccgtgtgtagatcttcccgctgctgcatgccggaaggcagccgaaggccaaggcctgcatgcccgaagaccagccgtcggcgaaaggatcaaaaccggaaggcagcaccccgaacctcgtacgcagcaattagatcaaggcctcggccgccccctgactc

SEQ ID NO: 64992 - DNA, 358 bp, Triticum aestivum
  Clone ID: PAT_TA_64992
atttttatgagtccgcggcgccgccgtggtggggaggccatgatgcacagtcgtgaggaccagagaagagtacaccaccgggccggaacctgctgccgtgaaccgtcgtggcggcacggaaggagcgccgctacggattggggaggagcgccgttgcaggcctagggagagcgccgtccggaccaagctccctgctccaccgatcaaggactcttgattccggccgcctgcagcacatcaggccatcagctaacagaatgggagcactgagcaaagcttgcgggatgcaaaaaacagagaggccgttgatttgcttatatctggtcctgctattaagttactgaagcaagacaccctt

SEQ ID NO: 64993 - DNA, 364 bp, Triticum aestivum
  Clone ID: PAT_TA_64993
gtggtgggcaacccgtcggggtccaagcgcggcacggtttgcatccagggcatcgcctggagcttcggcggcatgatcttcgtgctcgtctactgcaccgccggcatctccggcgggcacataaaccccgcgggcaccttggggctgtcactggccaggaagctgtcgctcaccagggcggcggtctacatggtgatgcaatggctggggcccatatgcggtgctggggttgtcaagggggtccagaccacgctgtaccagggcaacggcggctgcgccaacttcgtcaggccggggtacaccaagggggaccggcttggggcctccattggtggggaccctcgggctgaggtccaccggtttt

SEQ ID NO: 64994 - DNA, 188 bp, Triticum aestivum
  Clone ID: PAT_TA_64994
ttttcaatgttagcttcctagctcatgtgtgtcagtttttcagttagttgcgactgcttgcttgtgcatcacccctcaatcaacaagtgaagtaaataaaagtggtggtttatgtgcacaagaacagaacttccccacagaagaacaaaactgaaaaagaacccagtgaaagaagaaaaacttaaggt

SEQ ID NO: 64995 - DNA, 200 bp, Triticum aestivum
  Clone ID: PAT_TA_64995
ggttgtcccacgcgtccggtctagcaagggtgcgtgcgcgtgtgatttgcttgctcgctctccgcctatgctctgcccatggtgtccttgcgtgtatgtgtgtgcgcatgtctccctgtaattgcttcatctatctccactatggatggagtgatgaatatgctagaatgaaagatttacctaattaactagtcctacat

SEQ ID NO: 64996 - DNA, 148 bp, Triticum aestivum
  Clone ID: PAT_TA_64996
gcggtccactgttgatctactaggtgcaggaagaaggtgtgatacagcactggcgccgatagcagctgacgccgaggaggtcgtggccttgcaatgggcagagcaatggcccttctgaggcacagtcgctctgtggaggagcccagga

SEQ ID NO: 64997 - DNA, 428 bp, Triticum aestivum
  Clone ID: PAT_TA_64997
ttcccacgcgtccgccggccatccttcaaaccgtcagctctcaggccaccggagcttcgctcgccgaccgactcgactcggccggcgatggggaggacgctggacgtgctgctgggccgaaccaccaagcagacggcgcgcctcaagtccctcctgcacctcgccacgaagcggatcgccgtggtgcgggcgcaccgggaggtgcggtgcgcgcaggcgcggggggacgtggagcagctgctgcggcagggccacccggaccgcgccctgctccgcgccgagcaggtcatccgggagcgggacacgctcgacgccctcctcctgctcgacgcctactgcgcgctcctcgccgaccgctccgcgctgctcgacgacgcgcaccggggctgccccgacgagctgcgggaggccgcggcggagctctgcta

SEQ ID NO: 64998 - DNA, 172 bp, Triticum aestivum
  Clone ID: PAT_TA_64998
cctgtgaaatgtgataactatgaactgttttcaatgcggtctttgccagaaacatgtcgccgctcgctctgctgactttcttatcgcttgctggtgctgaacctgctgatttccatgtgctgtgctaataaagcaacatagtcctcggatgctgtggtaaacaaaataaaaa

SEQ ID NO: 64999 - DNA, 182 bp, Triticum aestivum
  Clone ID: PAT_TA_64999
tttgaaccctcatactcacaacagatactaggaaaccgatcgaccataggcggaactgacactgcgacacacaccgcaacaaagatacagctgagcaaacgcaggcacacgggagcccggcaagaggtgctgcatcgatcgctcgctcgctgctgaaccgacactgggcgacgactggcccc

SEQ ID NO: 65000 - DNA, 461 bp, Triticum aestivum
  Clone ID: PAT_TA_65000
tttctagggtttgcctctgtcttccggcggccggcggtgaacggattcagacgatgtcgaagaagaacagcctctccaagcggaagaagcagcacgagttcgacctccagagggagaagaaggccaaggaggagcaggccaagaagctgcaggccaagaagtccaagatgaagattgatggcagcgataagaagaagaagggcagcagcttcaaggtgggcaagaagaaggtgaagacaaagctctccgcactgggaaaagccaaggccgcgcaagccatggagctcgacaactgactgactcccacggcctaaactgttgcaccaatgccggtcattttttatgtaatcgtcggagaaatgaagttcatttgctctggccaggtccatgtagtcgagctgcgttagatagataagagttttggtatttctccagtcaggcagatcctgatcgtgtatgat

SEQ ID NO: 65001 - DNA, 180 bp, Triticum aestivum
  Clone ID: PAT_TA_65001
tcccacgcgaacgcaagacatagcaaggggacgaaattatcatcacgagtgcaagccagagccaatcaaccacggggagcaggcaccaaaaaatatcgcgcgggacgacgaaggaaagacaagggcggcaggccttggaacacctgacccgacaaaaggctcccaagaaaaaccacagaa

SEQ ID NO: 65002 - DNA, 352 bp, Triticum aestivum
  Clone ID: PAT_TA_65002
gtccagggtctttgcgggcgcgttgggcgccgacgggctggtctacgccggcggcgccctgcacacggccggcggcggcggcggcggcgccgcgggcatcgccgtgcagtccggcaccttgaccctgaacggcaacgtcacgggcggcgcggggggcccctctccgtaccagcccggcggcggcggcgatggcgtggtgctcgggcatggcgacatcatcgtcaatgcgcggatctccggcggacaaggcggctcgcgccgttactacggtaccccgagatcggccagcggagacgggggcagcggcatatcgatcggctcgggcaccgtcatcaacaacaacgtcgtgcta

SEQ ID NO: 65003 - DNA, 363 bp, Triticum aestivum
  Clone ID: PAT_TA_65003
tcacttgtccgcccacgcgtccggcacacatggttttaggagtcccgtcacatgcgcgcacgcacatcacaccattcgtgggtgctcatggctgccgacatacggacactgaattaccctactccacattctcatgcgtcatctgatcgatccggggactgtttgagacccacaccaggttctacagatctggagacagggaggcgaacgtgttccccacaccacgtcatttgcgggatcccgtccacgtcgagcagtccatgagtactgggacaacactgtagtgagcagggtggcacgcatgcaccccgctgctccaccagatgagatccaaataaaaaaaacaagggcggcccgtttaga

SEQ ID NO: 65004 - DNA, 273 bp, Triticum aestivum
  Clone ID: PAT_TA_65004
ttgtgacgcgcgggttgccattcttcgacaaaaaaacaataaaaaaaggaaaagaggaagcaataaaaaaaccatgaagagaaagagaccgaacaactggccgcaaccatggaccaacaaggccatcgatccctatgcggcggagacaaagggggggggcgttcaggagggcccagctccgctcccggggggaggcaccgcccacgtgttgcagtggggcccgcaaaaaaaaaataacgggccctcctttcaacccggttggacggggaaacc

SEQ ID NO: 65005 - DNA, 360 bp, Triticum aestivum
  Clone ID: PAT_TA_65005
ttggtgtgctctacgcctccatcgggttgtacttgtgatccttttgttttaaaaaaacaaaaatataccacaacaaaaaaaaacaaaaaaaaaaaaaccatacactccttcttacatttatcctatctctctaccatacctccccccttttttccccccggggggggcctctttgggggccccaggtttccgcccccgggcttgcggcgtctttgcttttttttgggggccccttattctcttccccgggccgtcgtttcccccctgcgggccggggaaaccccgggggtccccccctctattcccctggcggccctcccccttttccccggtggggttatttctgcaggggcccccccc

SEQ ID NO: 65006 - DNA, 255 bp, Triticum aestivum
  unsure (1)..(255): unsure at all n locations
  Clone ID: PAT_TA_65006
tctttaacagatacaacaatcccacgagagtttacgatttacaatgaacaatttcactgctttatcatcttcttcctttatggaaaatccctcgcccgaggtagatcgtggcaatgttttggcttctattccggagtctaacaattcagtacctgttgactcatgtccttatggatataaaatggttttgaaacttaagagtaagatctacccagaagggttcacatnnaaaaaaaaaataaaaacaaaaaaaca

SEQ ID NO: 65007 - DNA, 225 bp, Triticum aestivum
  Clone ID: PAT_TA_65007
tctgtcccttccaccctcccggacgcacaagatcctcgtcggccggcgcggccgtggtggtacacgactggactagctagccatccatcgctgcggtgccgtcgcccaatgacccggctcgccctctccgactgccgcggcctcacgccgctccgcgcgcgcagccgcggcagcgccattgcgctgccgtcgcctccccacctcgctgcggggccgcgtcgcccc

SEQ ID NO: 65008 - DNA, 394 bp, Triticum aestivum
  Clone ID: PAT_TA_65008
acgcaccgcaaacaacagaaattatatacagccatgcctctgttgctagctgacagcagacaagatgttgggttaaatcattgaatcagagttttgcagcaagaccagaaaattgactgctacatggtcatgtactttgtaaacatgtctttgaccattcacttagactgaagcatggttatgcacaatcagcaacattagccattcacactatctcgcctcacagatgctgtatagttgatttacctcctcagatgaacaaagccttaccataacaaataaaaaaaaaaacaggctgattactaggtagacacgctccattctgagtgggaaaagcccatcctacagagcattcctgagcacattttacttttgacatatctgctcatgcttt

SEQ ID NO: 65009 - DNA, 404 bp, Triticum aestivum
  unsure (1)..(404): unsure at all n locations
  Clone ID: PAT_TA_65009
accgggacgacccacgcgcccgaccatgcgaccgaacgaccacgggagacaacgaaacgaaagggaggaacccaccccacgacgcnggaaaaaaaaaaaaaaagaaaaagaaaaaaaaaaaaaagaaacaaagggcggccggcccaaaggacccaagcgaacggacgcgagcaagcaacgacacagcgctgccaaaggggcaccgaaaggcaaaaaacgggccgcgggacaacaacgccgggacggggaaaacccgggcggcacccaacaaaaaagcccgggaaaaaaacccccaagccccagggggcgaaaaagcgaaaaggcccgcaccgaacgccctagcaaacagaagaacagcccgaaaggcgaaaagggacgcgcccagaaacggagcaaaaagcgcg

SEQ ID NO: 65010 - DNA, 155 bp, Triticum aestivum
  Clone ID: PAT_TA_65010
tttgatgaccagcagacgggaagtcccgtcatagcgcaccatgtcttcagcggcgtgctagagtctagcattctacacaacaatggaacatggcgtcgtctgacgaaaccaaaaaaaagaaaaaagaatctctaaagaggagaccaagacaaaag

SEQ ID NO: 65011 - DNA, 483 bp, Triticum aestivum
  Clone ID: PAT_TA_65011
gggcgaaggcaccccacggcccagcccgaatccagaacacctggttgaccaccggagacccggcgcgggagaagaggaggaaacaagcagcaccgccgaggccgcccgcagaccaagacgagcacgcgaccggacaaccggcgaaaacaaaggaccagaggggccacagcaaccaagaggaggagcccacgacgaaagaagaaccgagagcccgacaccggacggcgggacgaacaacgggacccgagaagacagccaggcggggacgaaagaagaaccggcgcaccggggggcagaccagagaggaggagccagacgacacgaggccaaaagggggcacaggacgacgcaaaacaacgaagagaccgggaaaaccccggcggaacccaaagcaaaagccaagcagaacaaaccccaaccgccagcaggaggaacaggaaagaggcccgcaccgaacgcccgaccaacaggagcacaacccga

SEQ ID NO: 65012 - DNA, 207 bp, Triticum aestivum
  Clone ID: PAT_TA_65012
tctttcgtggccatcaaagtcagctggacttcatgtaaattcattttgtacagccaaccactgtctgtacacaattaagaaacaaagtcagactcagccagcagacagacggtgccttcattgggcccaaaaaaaaagaaaaaaaaaaaaaaaaaagaaaagattgttaacaatcaaaaaactggaaataaaaaaaaaacatataag

SEQ ID NO: 65013 - DNA, 304 bp, Triticum aestivum
  Clone ID: PAT_TA_65013
ttcgtcacgcgtccgcccacgcgtccgcggacgcgggggcggacgcgaggggcggcgcgtccactgaccggcccaacacagaacgggaccccagcgccgacggcgaagggccccccgggacaacgaaggacagcggcgggccaggcccgagggaacacgatgcacgcggcgacgggcgcgggcaaaagaaaaggcgccagaagccagcagggcaacaacacacagaaccccagaagacaagggcaaacaagaacgggaagggcagacgggagcagcacgagaaccaaagaggagggaagggcgc

SEQ ID NO: 65014 - DNA, 203 bp, Triticum aestivum
  Clone ID: PAT_TA_65014
acaggctggacccgttctggaatcccggggtgacccaagccgccggtttatttcacaacgggccgctggagacacccccagggtggatgaacttaccatacaaaagttggctcacccaagactgcgggaggtgcggaagctgggggagaacaccgtcattaaagaaaaggtgacacacgcgaggagttgaagacaaaggttga

SEQ ID NO: 65015 - DNA, 327 bp, Triticum aestivum
  unsure (1)..(327): unsure at all n locations
  Clone ID: PAT_TA_65015
cccccgggggaggcaaaaacgcccccgcaccgaacccgaaacacagggtgataacaggcgaagcggcgcgagaggacaccacgggacaaacagaaccgcagacgcggcaagcaagacccagaagagaaagcgaccgcacaacngagcgaaacaaggcccaaccgagggcaaaagaacaacaaggggggggaggccacgccgaaacgacgacacgggacgaccgaacaccgccggacgggggaacaaacagaaaccgagaaggaaagccagacggggaacgaaaggaagaacaaaccggcgccacccgggagggagagaaagaaagag

SEQ ID NO: 65016 - DNA, 358 bp, Triticum aestivum
  Clone ID: PAT_TA_65016
tccacgcgtccggctgctggaaagtaacgatagccctatgctaaacggtcaattattgatatccaagaactttgtgtattccgaaaggcgcaactagccaaacacaggggaaaaaaaaagacacagaaaaagtgaagaaggcacgaacatgaaaaaaaaaaaagacaaaaaaccaaggggccctgagtgcacaaaaaaaaaaaaaaaaaaaacctaaagggggcccccttttaaaggacccaaactttcttccccggggaaacaaaaactaaatttctctaaggggaaaccaaaacaaaaaaaatgggcgcacatttaaaaaaccccaaaaaggaaaaacctgggcaaacccaaatta

SEQ ID NO: 65017 - DNA, 402 bp, Triticum aestivum
  Clone ID: PAT_TA_65017
tccgtgtcactgccaactttggtgtgcacattgctgttttgtaacatgtcttagatatattctttctaaaaaaaaaaaaaaaaaaaaaaaaaaaaaaaaaaaaaaaaaaaaaaaaaaaaaaaaagaaaaggaaatagaggagtaagaaggacacaagaaaaaaagagagtgaatgaaacgaaagaagagtgaaaaagagaaacccaaagaaaacgggggcggcgctctaaagagaaaccggatgtctgggcagggtgcgggggacacaaaactttgttgatggggggcctaaaaacgaatatgggggggggcgaataaagaagaggatggggaaaaccccgcgtcccacaactcatatggcttgaagggcaaacggccctctgcccggggggggaaaataaa

SEQ ID NO: 65018 - DNA, 323 bp, Triticum aestivum
  Clone ID: PAT_TA_65018
atccactcctccggaatcatctcccactcactaaaaatgttatcatactgtgccggaaaaaccaaaaacaaacaaacaaaaacaaaaaacacacaaccaaaccaatcaaaaacaaaaaacaccaccataaaaaccccctaaaaccacacaaaaaaaactaaacaaaaaacggctcccccatctaatgaacaaccccctggacccccatttctgcccgcctatgacccactaataacgtgcccaaactacaatccaccctccacggtccccccccgacctcatttgaaaaaccctgccctaccccaacaaaataccttttctta

SEQ ID NO: 65019 - DNA, 433 bp, Triticum aestivum
  Clone ID: PAT_TA_65019
ttgccgcccttttttttttttttttgtgtttattattgatttatttttttttttttttttttttttgctgaccctgtttagtttttaaaaaaacatcaaaaggggccaagggctttttaaactttgaaaacaaaaaggggggaacctttcaaacgctaaaaacttttttggggggctttaaaaaagtgtacaaacttacaaacttttaaaacctactggggccaaggaagatccatacatattcaaaactttaaaataaccggggaatacccggggggcccctaagagcccccccccttgttggccattttggcggggcccttttattggaacttggccctgaaccaaaggaacccctggggggggccggtctcgacccttttaaacccggggggccgggcccctcttaaggagccaaacttcctctccccgg

SEQ ID NO: 65020 - DNA, 369 bp, Triticum aestivum
  Clone ID: PAT_TA_65020
acaccggtattgcacgggctattccttgcttgcagatgatctcgattactgctgatcggcgattcttaaacacttgtaaaaaattaggagaagtgaaccgcctgagtatccgcttataaaaaagcaatcgttgggaagccagtagtggcgagcgagtatttcttattgtcttatctccatgagcaaaaaagtttaataataaatcgtaacttaacacgctaaaaacaaatagatgcatagtagtcgtgtcaagctaagcagtgaataatttggctctgcccaaaaaacaaaaaaaaaaacttaactatagtgaacctagctccgtaagggaaatctgaaaaagcacctttcttgatttgaacagacatt

SEQ ID NO: 65021 - DNA, 179 bp, Triticum aestivum
  Clone ID: PAT_TA_65021
tgtactccatctgtgagggatgggttcaccaggaggattgagaagacactacaaccgcttgaggtataatgtaattcgcatgtgcagcaggcacgtattgatagcctaagagtgcaggccaagtaatggtcttgtaggtagaatcgaaatcaccatgcaaaactatgtggatatgggcg

SEQ ID NO: 65022 - DNA, 337 bp, Triticum aestivum
  Clone ID: PAT_TA_65022
ttccgcgagcggcgccctgcctcttttcttcaggatgatttatgtattacttgcctcttgattttggcttaccctaattagttagtgtatcatccttctatatatatattgtccttgcgtgccatggacttctttgtgtaggaagacatgacgacagctttctcaccagaaagcacaagatccactccagggccccggaggcttgaaagccgacgtcctcggacccaagtttacctgccgccagctttttcagagctgacaagggagaacctttccaggccccctaatgtaggccgtcgcaccactaaaaaatcgtcttgactaagaaaaacatggg

SEQ ID NO: 65023 - DNA, 235 bp, Triticum aestivum
  Clone ID: PAT_TA_65023
cccttctcatacggctgctgcaaatgctcatctggtgtgtgtttcgtataaatagcgctgggttacaagaaataaataagtacaatgcctcactcgtcaatggataatgcaatgaatactcaagcagacgaactgttaaggggccggtcgcgtcagaactgtatgcacgtaaccactcatatgtatgtatgtatgtatgtatgtatgctccaacatgtcgagatgttaaaaagaa

SEQ ID NO: 65024 - DNA, 452 bp, Triticum aestivum
  Clone ID: PAT_TA_65024
tacaccggaaccggcgccgccacggacacaacctgcagtggccaggacggcacgcgctgcgctggaccccccttggctgggagggctcccggggagccgcgccctaggaagccacccttggaacaagcgagggtacctgcggcgtcgacccaggtagcctcacagagtcacgagcgacgactaccgtgttgcggtggagcagggctacgcaggcgacggcagtcgggccagcgacaccagagcctgcgtgctccacaccacggccagctagcccgctgtcccgctctgcatggcaccattcacaaagatggaagaaccagtggccattacctgaagctgagtcacatcccactgcggcgacctcgttcgattctgcagcctctcttttctgatgtttgatgctgtgaatcggtgcacacacgtaattcaccaaagcttgttttgtagctgct

SEQ ID NO: 65025 - DNA, 349 bp, Triticum aestivum
  Clone ID: PAT_TA_65025
tacgtgaccacgtcatcagggaagaaccagtgcgtgatcactgggcagttcgacgtgatcggctccgcacggcgcgcatcttacaagagcttgataccagccgggatcgtcaccatgcttgtgcatatgctcattttcggcactggctcacgtagatagcaggcgagccagctgacatcgtgatttgattattattacctcggcgtattcagaggtagagacgtcgccatccctgctgcgcttagtcggttagtcgtatggacgaagagttggcatggcctgagcattcttactgtacatacagaaaatgaaaggtctattgttcatgtagtacggcctcctttttctc

SEQ ID NO: 65026 - DNA, 392 bp, Triticum aestivum
  Clone ID: PAT_TA_65026
ttctcacgcgtccgaggataactcgccgctttatttatctaatgaaagtttgggatctccttggagaccacatctaaaaaaaaaaaaaaaaaaaaaaaaaaaaaaaaaaaaaaaaaaaaaaaaaaaaaaaaaaaaaaaaaaaaaaaatgaaaaaaaaaaaaaaaaaaaaaaaaaaaaaaataaaaaaaaaaaaaaaaaaaaaaaaaaaaaaaaaaaaaaaaaaggggggggccgaactgggggtaccaagttaaccaccgaaagaggagactgaaaacacttgttataagggaggcaaaaaaaaaaaaaatagaacgtttttaaaaaggaaaacactggaaaaacccaggttaacccaaattaaatacattttgaaaaaaacccctttttcc

SEQ ID NO: 65027 - DNA, 267 bp, Triticum aestivum
  Clone ID: PAT_TA_65027
tgcctgcgcacgtcgtgcccctgacgaacctggactacatcgcgacgtgcatactggtgaagccgtgggcgcacaagccaggcgcgcggctcatcacccagtgcgtgacgcccgaccgcatcgccgccttccacgaagggatgctcgacatgaactgaccggggccgagcacgacgacggagccaaagaagaagtcgaagacgaaggcgagaggaattgacttgtttatgtgatgattaaattagtagaagtagtacaggatattgg

SEQ ID NO: 65028 - DNA, 304 bp, Triticum aestivum
  Clone ID: PAT_TA_65028
tgtcaccaccggcctcgtcgaggtcgccgtcaacatcactctcagcgccggcaagccgctcgccgcctactcggacgacaaggtgctcctgccccaagcgctgttcggggccaaggcgccggcgccggtgcccggcgcccccaagggggccaagaacaaaaagggtgaagcccgcctctggccgggcgagtaagacgacgacgccgcgcccacgggcgccgcgggcgccagggccgcccgccggggcatggctggcatggacgcccttcttggctacctcttgtgagatgggtagcttgggatg

SEQ ID NO: 65029 - DNA, 386 bp, Triticum aestivum
  Clone ID: PAT_TA_65029
tgttcttccacgcgtccggcccgccgctggtgctggttggggcgcgtacggcggctacgggtacgctcctcaggcgcaggctccggccaagggccacggcggctactacggcgcgagctcgccggcgtggcacggccagggctactgatcggtgcgcgcgctccgcgtcgaccgagccgaccgcgcgggccggagacgggcgagcacgtgggatcgtcataccggagcacctgacgacgatggcatatacatatgcgtactccttttgtgctagcagcagtatatctcagttcagctaatcagtagcaatcgggcggttgatcgagcagaggcagtagtagccgcagcagtgatcgatactgaatacagggagcagatatagtact

SEQ ID NO: 65030 - DNA, 319 bp, Triticum aestivum
  Clone ID: PAT_TA_65030
ttttgtttttttctttttctcacattttatgttctgctgttattcacttttgggtttacttctaaagagaacgggccggttaaaacaacaccgtcaaccaggggggaccagggtattcaagggtccctgcagcggggacaaattacaaaacggaaccgaaccgaaatttttacaaaatgaggcaccctactggtctgaggttggacataatttgggtggggctacaagaaaaaaagggtcaagtgcgggttattttaccgccatgggaggcaaggggcatgtcaggggcccctacgtttccgtggtcgactcaaaattt

SEQ ID NO: 65031 - DNA, 519 bp, Triticum aestivum
  unsure (1)..(519): unsure at all n locations
  Clone ID: PAT_TA_65031
tctccacgcgtccgcgagcagtggctgcagacggaggcgcagagcttcgacgtgcccagcgctgacatgatctacagcctcgcctacctgccgcgcaccatgccgctcgacggcagaaaggacggcggcgccggcgccggccgcgaagccatgcagcagaagcagcagcagcagcgggacatgatgatgagcccgtcccacatgcagaaggtggaggagatgaagcagctgttcgagaagagcagcagggatctgagcaaggtgctggacatctacgaccagcggcttgaggaggccgagtacctcgccggcgacaagttcaccctcgccgacctctcccacatgcccaacgccgaccgcctcgccttcgacgaggcgctccgccgnctcatccagtcccgcaggaacgtcagccgctggtgggccgacgtctcgagccgcgagtcctgtgtgtacgtcaaaagcctgcatgcgcccgcgttcgccgaggcgccattctgatcaccatgcactggtcgc

SEQ ID NO: 65032 - DNA, 469 bp, Triticum aestivum
  Clone ID: PAT_TA_65032
tcataaacaaaaaaaaaaaaaaaaaaagaagagaaaattataaaaaaaaaacaacaaaaaagtgaaagaagggagaacaaaagaaaaaaaagcagaaaaaaagagaagggatggaaaggagcaagatactcaatgaaaaaaaaaaaataaaagggggggggcgcgtttgggggacccccgttttccggcggggccttggcccgcctgtgttttttttgtgggggcccaaactgaaattaccggggcgtgtttttccacccctggaagggggaaaccccggggggaccccaaattgttggtggggggagccttcccccttttcgagggggggtaaatccgaagaggggcccgtccatggcccttttccaaacatttgcccttcctggaggggcatgggggcccccccctttggggcctttttagccggggggggggggggggccccgcggaggtgggccgtttcctttgg

SEQ ID NO: 65033 - DNA, 274 bp, Triticum aestivum
  Clone ID: PAT_TA_65033
tttcgttcacgcgtgcggtcaccccgaacccgcagatcctcttcccggcgccgccgcaacagcaagatggtgaagggacgcaccggccagcgcgtgaggctctacgtacgtggcaccatcctgggatacaagcggttcaagtggaaccagtacgagacggtgtacttggtgcagatcgagggggtgtacaccagggaggacgcggcctggtacggctgccagaggatggcctacgtctacaaggccaagaccaagagcaacgggacgcactacc

SEQ ID NO: 65034 - DNA, 465 bp, Triticum aestivum
  Clone ID: PAT_TA_65034
tttcttcgttgagcgcctcaagaccggcttcgagaagttcaagaccgaggtctacgaccagaagccggatctgttcgagcccctcaaggcccaccagtcacccaagtgaccttgggcctggagccaggcgaggccttcaccgtccgcaacatcgccgccatggtcccgtgctactgcaagaacaagcacactggtgtcgggtcggccatcgagtatgccgtctgcgccctcaaggtcgagttcatcgtggtgatcggccacagccgctgcggcgggatcaaggccctcctcaacctcaaggatggcgccgatgacaccttccacttcgtcgaggactgggtcaggatcgggtacccggccaggaagaaggtgaaggatgagtgctccgagatgccttttgaggagcagtgcggctgtcctggacaaggaggccgtcaacgtgtcgctccagaatctgagcaccta

SEQ ID NO: 65035 - DNA, 289 bp, Triticum aestivum
  Clone ID: PAT_TA_65035
tctcccacgcgtgcggccacgcgtccggccacgcgtacgataaaaaaaaaaccaaaaaaagatgcagaatgaccctgaaaagaaagagaacgaacaactggaagaaatgaatggcccttcaaggccatagatactatgagggggggggccggtctaaagaagcacactgttggcccccttcgatggctgggagaacatctgtactggggtgccctaaattacagggacgggcgcggaactgacaccgcgtgtggtggaaaaacccggggagctccaaaacaaaaggcct

SEQ ID NO: 65036 - DNA, 538 bp, Triticum aestivum
  Clone ID: PAT_TA_65036
ttattggtcaccgctttcatgactataatagatgacatatttgacacatatagcagcactgaagacagcatgcaacttgcagaagcaattaataggtgggatgaagatgcagtaaatgtgcttccagaatacatgaaggatatctacttatatttgttggaaacatttcattcttttgaggaccatttaggacctgagaacagctaccgtgtggtttatctaaaagaagcgttcaagaaattggttcaagcatacagtgatgaactaaaatggcgtgatgaaaattatgtaccaaaaacacttaatgaacaccttcaagtttcatcagtaagtattggaacctctgtggtagcatgtgctatatttgttggcatggatgacacaacagtggaaactctcacttgggtgtcgagcgaccagaaacttcttgaagtctttgctatatatacacgttttacgaatgacatggcatcagcaaagcgtgagcaagcagggggcagtgtgctctactatccatcgtacatgaggagcatggatg

SEQ ID NO: 65037 - DNA, 386 bp, Triticum aestivum
  Clone ID: PAT_TA_65037
gctttcttcacgcgtccgcccacgcgtccggccagaaggtacccatcaacacacctctccatgacaaagcttgcttactcagcttgcaacaagcaagccttggtcttcctcttctaccctctagctagctagctttctcgaccccccaagaaaaaggagcaaccaaaatctcatactagatcgattgatgggagctagctggcttgattagctgcaatttcatggcgcgtaattaagatccagggcatcatggtgaagtagctcggcaagaagtcaactcatcaagaaagcttgctagccgcccttgaaactacacaaggaagatgaagaccagatcgaggaaggaagcacgctatagcacagagagctaggctaggtggagagat

SEQ ID NO: 65038 - DNA, 449 bp, Triticum aestivum
  Clone ID: PAT_TA_65038
tctttcacgcgtgcgcttattttccactgctcccggaggcgtcaagggcgtcatgccctctgtcatgatcggatggggatcccaagttcagtcccatcttcactttgctccccctcactgcagcttctctcctatctgtcgagatttactatgtctgtctacagctattctacttgatattgttcttggagcatcaaaggcaattgctttactggttaacatgcgtaggagggtactgttgctcagcgttattatacctctgtaaatacatgtataggaggattcttggagcttcgcacactcagtaaggccatcaaagctacttgccttgctggtcaacatgtataagaggacccctgtacatacatgtttgctgtttgctataaaagaagtactctttggtggattgagaagattgtgactatgaaaccttctagatgtacagaaag

SEQ ID NO: 65039 - DNA, 265 bp, Triticum aestivum
  Clone ID: PAT_TA_65039
tctgggacctgctgcctccctgcccgagcgtcgacgttgactcccgcgtccaccatggcgctgccgaaccagaacaccgaggattaccccagctcaaagctcgtcatcaggggcgatggcggcactggcaaaaccacattggagaagaggcatctcactggagagtttgagaagaaatactaacccaccattggagttgacgttgacccgttggattccaccactaactgaggaaagatccgcctctactgcatgggacactgat

SEQ ID NO: 65040 - DNA, 363 bp, Triticum aestivum
  Clone ID: PAT_TA_65040
tcctctcatcaccaaaaccccaagaaaccttcagacctctctcctccccttgcaccgtgctgttctaaagcagcgagatcagagggggaaggggggaggaaggagaggcagaccgcaaaaggggcagccagggcggcggactcgtgcggagaggagagaggggtaggccaggacctcagatcgagctcaaggagctggacattaacactgcaacccagacggacgaaagacggaacaggacggcgggggtgacccatgagtcatacggtctcagcaagcccttcaagaagatccatgtgaagctcatcaaggagctcctgaagaatcctagcggccaggacatcggctttgttgcaacaaaga

SEQ ID NO: 65041 - DNA, 259 bp, Triticum aestivum
  Clone ID: PAT_TA_65041
ggatgcccgaaagtgtttgtgtgcccacaggccgaccggagcgagggctgtgcctgattcaggaagaaccgggggagctcgcgggcacccccgggggggggccacgacgaacaagtgaggaacgcaggggccgtgggcagtactacgtgagtgtgtatgcgcacagaaggaatgatcaacggagggcccagacactgtgggggggaggacgactccacgactgatagacagaactgacggggacggaaaggacaacagg

SEQ ID NO: 65042 - DNA, 194 bp, Triticum aestivum
  unsure (1)..(194): unsure at all n locations
  Clone ID: PAT_TA_65042
ccggnccgaattcctgtgcgtacccacgcgtttgttgactcccgggcagacgcgtgggcagacgcgtgtgtggagttgcctgaacatctacatgttgaaggggaccaagatggcaataaaaattcatgctgtgaaaaaaaggacataaaaaagacatagtaaatatgaggaggagtacatgacgaaagacgaac

SEQ ID NO: 65043 - DNA, 306 bp, Triticum aestivum
  Clone ID: PAT_TA_65043
aaaaaaaaaaaaaaaaagggaagataaaaaaaaaaaaaacaaaccaaaccacacacccaaaaaaaaaaaaaaaaaaaaccaaacaaataaacatgggcccgcccctcaaaagaaccacaactcccgaccccgggcacgcaagaaaaaaccacttccatagggcccccaaaataaaaaacaacggaccccgttaaacaacccggggacggggaaaccccgaaccggccccacctaaagcacctggaaaaaaaacccccttcccccagaggccaaacaaggaaaaggcccgccccaaccacccttcca

SEQ ID NO: 65044 - DNA, 497 bp, Triticum aestivum
  Clone ID: PAT_TA_65044
acatttgtccttgccggacgcgtgggggcaaacgacagacaatttacaccgacccgctgattcaccaatttcacatcgacaatatgggcgacgctaccgtggagtctccttggtggcgcctggccaaggtcggtctgtggaggatcacacaagacaacggcccctacaacggcagaatcgccaccatcgtcgagatcatcgaccacaagcgcattttgatcgacggtccttcatccgacgagatgcttgtggtccccagacaagccatggcactttacgaaattctcctggcccccatcgtcgtcgagtcgatgccccgcgccgtccgcactggtaccgtcaagaagttctgggagaagtctggcgtcgactccaagtggaaggagagctcgtgggccaagcggcaggagcagaaggagcgtagacgggccctcaccgactttgagcggttcaaggctctcagactcaagaagcagcgacgattcgaggagcaaaag

SEQ ID NO: 65045 - DNA, 172 bp, Triticum aestivum
  unsure (1)..(172): unsure at all n locations
  Clone ID: PAT_TA_65045
ccggtccggaaccccctggttgtccttcgcgaccgtttgttgctaaccanctgnngaagngggaggaaactgttgattcagtgcgtagatatcagttttttttctattccagatgtgttttggttaattcattgggcttttaattcattgccattggttcaggctatattca

SEQ ID NO: 65046 - DNA, 267 bp, Triticum aestivum
  Clone ID: PAT_TA_65046
ccggggcggaaaccccggggcgacccacgcgaccgctcaagtcaaaaccagagaaaacgggaagagagggaggatgaaataaaaaagaaccgccgaggccgccggcagaccacagagagagcgcagaccggccaacgggcgcaaagaacggccccggggggggcaccgccagggggcgaaggcaaccccgacgaaggacggaccgaccagcccgcccccgggggcggggagaacaacagaaccgggcagccagcctgacagggacga

SEQ ID NO: 65047 - DNA, 264 bp, Triticum aestivum
  Clone ID: PAT_TA_65047
cgaaacaatcaattggcggcatggcgggaactacgacggacacctcgaggcggtcgccgaccgtgctgagcctgggtccgctcatcctgcgcaaggatgggcccgccaggggcgacggcatctgcgtggacgagccgtgcgcagacgcaactgtgagccgcggcgacgggttcaccttaacaacggaccccggagggcacgacgactggttctacagaagaacgcagctctccccctgcgacagccgacttaacctggggaacg

SEQ ID NO: 65048 - DNA, 457 bp, Triticum aestivum
  Clone ID: PAT_TA_65048
ccgaaacaaccaattggctccatgggggttacttctacagcaacgccgaggctgtcgccggccgaactggtgctcatactcctcctcctgcccgcggcaggggccgccaggggcgacggcaacggcgtgtacgagccgtgcgcggacgcgacggtgagccgcggcgacgggttcaccttcaagggtggccttcgcggggcgcgacgccttcttctccggaggcgtgcagctctccccctgcgacagccgactaaacctggcgaacgcaggaccgctgctagagctattccgccccaccgtcgacgagattgcggtgctcaccgacaacgcctacgaccccaaagccctgacattctgatggtgggcacatggaggcctttgccaggaggaagatcgcggcaaggatgccgcccgtgtacgtaggcaacaacttcgacacagataccggattgaccct

SEQ ID NO: 65049 - DNA, 362 bp, Triticum aestivum
  Clone ID: PAT_TA_65049
gttatatggtggcgcctttgcggcgacgccggctgaagccgcgtcgggtgccgagttcgtcttctgctgcgtcggcaacgacgacgacctgcgctcggtcgtgctgggcgatgagggcgcctctgccggcatggcggcgggcgccgtcttcgtcgaccacacgaccgcctcggcagcggtcgcgcgtgagttgcatgccgtggcggccgaacgtggcctgcatttcatcgacgcgcccgtctccggtggccaggcgggtgccgtcaacggcgcgctgacagtcatgtgcgggggggacgccgcgcccttcgacgctgccaggcccatcgcgctggccttcgccaaggccgtcacgctgctgg

SEQ ID NO: 65050 - DNA, 201 bp, Triticum aestivum
  Clone ID: PAT_TA_65050
ttgcgacgttctcatcttagctggctatccaaaaaaagagagaaagattatttttaaagaaccgacggtgcttttcaccaaaaccagaagagatcgcgtacgcacaactggcgcaatgatggcccttcagagccattgtttatttgaggaagagtgcctgacgaaagaataactgggtgcccgccttcgctgggtgggcga

SEQ ID NO: 65051 - DNA, 488 bp, Triticum aestivum
  Clone ID: PAT_TA_65051
ctcgtttggttgcatatgtccttctccatgttttagtgtttaggcataatggatggttgtaagtgtgtgttacccagaggatgaagtttgcaccacctcagacagataatgagtcaagagatgctaaggagatggacttggcgcggaggcggaatttgctctctattcttgcaattctggcggcaactgtcacgtaccaagctggcctgaacccgtcaggaggcatttggcctgctgagaacagtaagggtggcaaaccaggcaatccagttcttcaagacagccacccatagcgctatgatgttttctactactccaatgctgtctcatttgcgtcatctgcggctgtcatcattcttgttgctaatagggaatcatgcgaggatggaatcaagtcgtacgcaatccgtgcgtgcttggtagcggatttgctgggcctactgattgcctattctgcaggaacctgcagcatagcgagacccgtaata

SEQ ID NO: 65052 - DNA, 253 bp, Triticum aestivum
  Clone ID: PAT_TA_65052
ggccgggaccggaacggaagggccgtcccatgcgaccggttccgtgcgagcaaactacacgagggagcaaaccggcacactgctgatagccgggagcctgccccagacccatggcgctcacagggatcctcaaggagctcaaggacctgaacagggacccgcccaccagcggcagcgcctgccatgaggcgcaagaaaggatccactggcaggcgacaagacacgggtccatcggcaagcccagatgccggcg

SEQ ID NO: 65053 - DNA, 203 bp, Triticum aestivum
  unsure (1)..(203): unsure at all n locations
  Clone ID: PAT_TA_65053
gccctccggcgcgcgcaccgacgatgattctggcagtaccgcttattctgtctccggcaccttctgaggagncgccagcgcaactggcgcaagcattgtcgtttagttggacggactccgacttgtggttagcttgactatagacgaaatattggtcccgctgcagatggaggggcgaccactgtacattgtactgagtctgc

SEQ ID NO: 65054 - DNA, 351 bp, Triticum aestivum
  unsure (1)..(351): unsure at all n locations
  Clone ID: PAT_TA_65054
ttgtcctcgcgaccgttgngtcctagccacgccctccggcgcccccaccggctttccttttaggtctaccgcctactcgttcgccgccaggtcctccggagccgccagcggggctgccgcgaggtctatgttgtacttggagggacgcagactcgtggtagtcttgtgtatacacttcatatcggtcacgcggtttatggagggacgaccaatgtggattatacggcatatacatgttatattgttacagaggcttgtagatatgagtcgcgtatacgattattcgagattgggtacgtaattttgttacacatgcatgagattatttatgaatatacaattttttcgttt

SEQ ID NO: 65055 - DNA, 358 bp, Triticum aestivum
  Clone ID: PAT_TA_65055
caaactcacacgagctagcaaaccaggccacactagctcgatcggatggggccctgccccagagctgcgcgcttcctggtgctcctccagatcgtcctggacgtgatctgggacgcgctcatgagcggccccgtctgccatggagcccgagcagggatcgacgggggagctatagatcctaatccaccgacaggcacagaggctgctggtgacccctacaccggtcgtcagtgcagcagatagtacaggtgctcaccaagtgttcagccctgataacagcagaaacacctctcccgaacaatggaaggtgtggacgattgcaccgcctggatgcatgcccacatctagctagcaatac

SEQ ID NO: 65056 - DNA, 329 bp, Triticum aestivum
  Clone ID: PAT_TA_65056
ccccagagctcggtagggttttttgctttctcgggggagacatctcttgtggcggcaccatgctcgtgtaccaggacacgctttccggcgacgagcttctgtcggattcgatcccttacagggagctggacaacggcatgctctggcaagtcgatggccattgggtcgttcaaggagcacttgacgtggacattggagccaatccctctgctgagggtggtggtgatgctgtgggtgatctgaaacaggagctggatgacactaggtctaaactcggcacttgcctggcggtttacaaccgctgtgctgggaaaaccctgatgttaccc

SEQ ID NO: 65057 - DNA, 240 bp, Triticum aestivum
  Clone ID: PAT_TA_65057
atggcccgggctctgggttatgatttttttacagagaattcatgtgtttttcatgcccaggggattcagcaaagtactgacgcatgcatacagcataccactgcaaatgctgctcataaccttggaccatcaagagatgaaccaacaactgatgtcttccgcagagagccctggtgtcaccccacacagagaagaacacctactggagttgaacaggaaaaggcttctgccgttaccgag

SEQ ID NO: 65058 - DNA, 110 bp, Triticum aestivum
  Clone ID: PAT_TA_65058
ttcagtgcatactcaagggtgttcttgtttatgcaaatcccttgttattgggatgccgggataatgcgggaacatactggcgaatggatgacagattgctgttacagtcc

SEQ ID NO: 65059 - DNA, 143 bp, Triticum aestivum
  Clone ID: PAT_TA_65059
gcattctactggcccacgttttacaccgactttgactgtgaaaaccacgaagagcacaactgaatcgccttgtggcacatcccccattcgccagctgacacaatagctaaaaggtcggcaccgatcgaccttacaaaaagttg

SEQ ID NO: 65060 - DNA, 285 bp, Triticum aestivum
  Clone ID: PAT_TA_65060
tcccacgcgtcctgagttgtttattttttagccggttgctccatttcttccagacgacccaggaaggctggccgcccctcaaaggggaggaagatgccccgcctcctccagtgtgttgctgcatgggcgcacgccaggagagcagatctggtcagacccgcgttctgccgtgcctgaacaccaccaatgggaccggagcctgactgtacaaaggaccaactggggcttcctgaggacaggctgaaagaggcggtcggtcactctagccctaacaatgtcacgggc

SEQ ID NO: 65061 - DNA, 459 bp, Triticum aestivum
  Clone ID: PAT_TA_65061
tttgctccgccgccgccgccccgtgcttttcgcacgtgagcctcaccttttcggttggccaactggaagggggcgttttacctggactaaaccgccactatcgcgacttcttgattcagcggctcgtgcagttcttccaaggcgccatcaccgtgaaggatctcgtcttgcggtttactgggccagagatgtggatcatgccgaagaatcccttctctgcaatgtcgaacctgagaaggctgctggtcgccgacgtgccttcctcatgggacgcctcatggccgcgcctgctcatcgaggcggcgccgttacttgagagcctatatgtgcatgtctcccacagcgaagatgagccgagacaggaggtgccgggggagacctcgggttcgcgccattgccatttgaaggagctggttgccattggattccagaggacggacaggcagatgcaccttgtga

SEQ ID NO: 65062 - DNA, 347 bp, Triticum aestivum
  Clone ID: PAT_TA_65062
agattcattgataatctcgtggtgtgttcaggcggtttggcgagatctgtcaaggagggcattcccgctgatgaagcagatctgcgtgacatgataacgtctctagagagtctgttacgtgacgggatccagcctcgcgtggggcggtatgctgaacaagagttacgtggttttgataccaccttcaagagtttgttacctgatgctgctgcagctaccaccatcaaggaagagccggataatggtgatgccaccagtagctgccgtcaggatcaggaaggggcggcgagccactgatgaacgccgtacatcaaggatgctgggatcttggagtcttctacagcttt

SEQ ID NO: 65063 - DNA, 303 bp, Triticum aestivum
  Clone ID: PAT_TA_65063
ctctccaacagaggagaaaggtaatagtaagagggtgccccgatatctcctctccgccgagggtgctgccggatggggaagagatggggaaggtgctcccagctctactataagtagtaggactagcttaggtgtctacttagtggcgactggcgcgacgccggagattgggtttatgactatggaggcctagtctcttgcgcgccccagccgcttccggtggctgctggagctcacctccataattggggtgagatgccatgagcgcaaagctgctcacttatgcgcagttaacagccatac

SEQ ID NO: 65064 - DNA, 289 bp, Triticum aestivum
  Clone ID: PAT_TA_65064
ccacgcgtccgcccacgcgtgcggtttttcccgcggctactcaaggttgtgtcagggcaacggcaggatcatggacatggtggagctggacgaggtggagctggagaaggcccaggccaacggcaaggcggtcaccatctcggtgccggccgccggcggggaagccggcatgtagcgcgacaacgagaactgatcgctggagcaagagatgggtggatcttgatgctgtggtggtgtgcgtagcttaaagatgagctcgatgacacgaggcctaagcttggcactggcc

SEQ ID NO: 65065 - DNA, 318 bp, Triticum aestivum
  Clone ID: PAT_TA_65065
taccaccgagcgagctcaggtgttttttgagagcacctgccgttgttgccggagccggatgagcgggtgagctagcacctggcatgctgatggccgtcttgggccacctcgtctctgaggcggagcgcatggcccaagatgaacccatctggctccacatggtcctgatggaagagcactacggtgctaatataactgattggagctacaagaagagctagcgctgcgagtggcacaaatgcatgaggagactgatatcacaagggctcaaattgcgactattatgtagaggacaacggcaaaactggggaaacacga

SEQ ID NO: 65066 - DNA, 118 bp, Triticum aestivum
  Clone ID: PAT_TA_65066
gacagagcgggcggggaggattttttcagaaggttcagcgattcttgccacgcacgcagacatggtggggaaagcgccggcaggggctgcaggcggctactcggacgatggttcaaag

SEQ ID NO: 65067 - DNA, 343 bp, Triticum aestivum
  Clone ID: PAT_TA_65067
cggcacacgcgcctcggcggcgggcccttgtccgaacggtctccttgttttccctgccgagcaagctttatttatggacgtctctctgcgcggcggaacgtgaacggcattgtggctttcgcattatggctagcactctgtaatgcactcctgtctcctcctggtgtccgactgactgactgtcttacagtcgcaaccggtcatggtatcgagtaagcgtcggcctctggtattatggcactaaaaaagagcatggaaaacatcgggcgctactttttcgacagcaccgtcaacaagcggcgatgcccctaaagaacatcttggggctggcagctcagaggac

SEQ ID NO: 65068 - DNA, 167 bp, Triticum aestivum
  Clone ID: PAT_TA_65068
gggcggacgcgtgggaaaagaaggattatatatagaagacctccttattttttcagacaaagaagagaagaagaagcgccaacatgcgttataatggtggtcctgggccgcctgttgaatctgtggaggaggccatcactactgaagaacatattgccgccctcctg

SEQ ID NO: 65069 - DNA, 303 bp, Triticum aestivum
  Clone ID: PAT_TA_65069
ggctatccggcgcgggagtgtaccattttttaggcagcaccgctgttgttgccggccgaccctgaggaggtggtgtccgtacaagtggcgtaatgatggcccttgggggccattgcttttctgtggaggagttcatgacggatgatcaactggttgccctcctccggttggtgggtgaacaactgcaccgtgatggcatgctggcggcgacgaaagaagaactggtgctccgggcggcacagctagaagaggaggttgatgacaggaggactaaggttggtactggtcgttgtactacaacgt

SEQ ID NO: 65070 - DNA, 250 bp, Triticum aestivum
  Clone ID: PAT_TA_65070
ggctcacgtgcgcggagaaggacggttttttcggcggatttctagtgtctatcggaccacagagactgcaagtgcatcttgctggtgtggtagacggcgctcgagaatgccgacgctacacgtaaggcggccaccatctgggtgccggactgaggcagggaaagacggcatgcaaagcgacgactagaactgagcggtggagccagagatgggtggatcttgatgctgtggtggtgcgcatgtcttgtgc

SEQ ID NO: 65071 - DNA, 433 bp, Triticum aestivum
  Clone ID: PAT_TA_65071
agcataggtggccaggcaggtgtgatatgttaagatagatttcccatttttcatgaataccaccatggcgcatatggaagaagttgcttatagctttacctgacaggcaggaactctagcattttctgcttgctgcttttgtagataagaattgtgccagatagatttcgagacgacacacggaacagagataaggttgcacatagcagttatgagtctgcacattgttgtacaaattttgtgattttacatactccctctgttcacttttgtaagacgttttagacagctgaaatcgaattgttctaggtgtggtctcagatgtgtaaaacatgtgacagatgggaactccgggagcagcagataaggctgggcatagcatgtatgcaattgcatctgtcatgattagctgctggtagagaaacagatttgt

SEQ ID NO: 65072 - DNA, 528 bp, Triticum aestivum
  unsure (1)..(528): unsure at all n locations
  Clone ID: PAT_TA_65072
ctataaaaaattggtatgctcgccgttttctagaattctaggtttgttattattttaggctgccgatggctatactggaaatgtgcagtttagagatgctacataagaactgtgtgagcactcatgttttacaaattaggatcacaacagtgacactaaagaagtgaagatgcaagtatctgtttccgcgaagtcactcctttgtacttgtattgtttcgttttactcaagtgccttgatacaagatacttaagtatttttcggttttacctcgttccttattactaacccacaaccgtacttncggttaatgtggtctggactgtcattcaggtgcttgctggagcttccagctacaggtgccatggaaggaataaacatgatcacaacgggctctcttctcatccttcctgagtagaaactaatcggctgtgacagatcccacaatgctggctgtggccggtaggctcatgaactatgcttttagtttgtgattaataatggcggagtgacacgaaggatgacttc

SEQ ID NO: 65073 - DNA, 458 bp, Triticum aestivum
  Clone ID: PAT_TA_65073
gccgtccgccccgcgagcggacgaggttttagggagcaccgcgggtacttctggatcagcctgacgagcgagcgagcgagcagctagcatggcgatgaccggaagcgctcagagcctaccggtcgatgcagccaggaccagagatagactgatcatcaaggtagtggaggcgcgggcacaggctctccccctcatgcgcctaacggaagcgaccgacctgcaagacgagcacgctgcgggtcctgcgccagagcacgggcacatgaccatctaatacggagaccaggcgctggagcataacgaggtccctgcagaaagggtggccgagccgatcaggatagctgccacaacaggcaccgtgccaggggacggcgaccagcccatggggaggaaggcgctcgctgatcggaccatggagaagcgcagaggaagggttgccccgcgcgcagtaccttaca

SEQ ID NO: 65074 - DNA, 183 bp, Triticum aestivum
  Clone ID: PAT_TA_65074
tccggcgcgtgcgcgggggggtttatattagagcttctttcctttcttcccgagcaccaggagagagtgagtacccacaacgggggtagctgtcgccgttgagggccagtgcgtccatgtggtggaatccatgacctaagatgcactggttgctctgctgcggtgtctgggagaacagatgaa

SEQ ID NO: 65075 - DNA, 227 bp, Triticum aestivum
  Clone ID: PAT_TA_65075
agcgagcgagcgatcagctggaatggcggcgacagggagcgctcagagcctacgggtcgatgcatctgagcagcagagatagtcggtgcaccaaggcggccgaggcgcgggcagaggctctcccccttatgcccggagcggaagtgcccgcactgcatgacgagcactgctgtgggtcctgcaagcggagcacgcgcaaatgaccatcttttactgcggccaggtgc

SEQ ID NO: 65076 - DNA, 311 bp, Triticum aestivum
  Clone ID: PAT_TA_65076
ccggcgcgtgagtgcaccatgatttttttaggaccgctgtcgctgttttttgaccacgatgagtaggggaccgcccaactggcgttatgatgaccctcctgggccatcgttcctctgctgaggagaacctgacccctgaagaactgattgtcctgcctcgctgagctgcgggaacaactgatactcatgatggccggctgacggtgacgaatgaagaactggagctccctgtggctgagctgaaggaggaggtggatgacacgaggactaaactcggtactggccgacggtttacaacgccgtgactggga

SEQ ID NO: 65077 - DNA, 443 bp, Triticum aestivum
  Clone ID: PAT_TA_65077
ggctgcggcgcgcgcgtggaacatgttttaacgggcgagccggtggttgcccgccaggagggcttagccctcttcgacacgaacggcgatggatgcatcagcttggaagagctggccgcggtgactggctccctgagcctagatccgaccaaccaagagctcaatgacatgatgcgtgaagtcgacatggatggaaatggcaccattgatatacaggagctctggagcctcattgccaggaagatacaagatggatatggcgatgaagagctcaaggaagcttttcaggtcctggacaaggatcagaatggaaatatcttcgctgtcgagctgatgacggtgatgatcaaactccgggagaagatgaccgaccaggaggttaggcacctgatcagggaggccgacactgatggcgaccggcatgtgaactacgacgaatccgc

SEQ ID NO: 65078 - DNA, 131 bp, Triticum aestivum
  Clone ID: PAT_TA_65078
tttattaagacatcatcgcaactaccgcttgaacgccaccgccgctcaacctgaacggaacctgatacctatgatatgaatctacggtccatgctatggcacctactgggcactgtatcaccagatgccgc

SEQ ID NO: 65079 - DNA, 457 bp, Triticum aestivum
  Clone ID: PAT_TA_65079
ttttggctttagtcataaggaggggtgacgaagatactgatcttgcttttcagtgcaatgagggttattcgtatggtgttttgtttagtcatggtcggttgaggagtaaattccatggtccttcctgggaacgattggtcagtgattatggtgttcgtcctcgtgatataatgaccattaggcttgaacactatggaacatggattggtattgattttaatcgtgttggtcgtggagatgcgttgtctcctttaccttctgttggtaaggtttatttttaaggaactttttagcttgttttattgcacatgatgatttgtctgttccctcgagactgtgtaattatattttgcagctcttgatggctcgagcgactccgagatggaacttattgagagttgttattacacccgtggtgtttttcttaattatcagcagatgtatttcatgaggtgtc

SEQ ID NO: 65080 - DNA, 541 bp, Triticum aestivum
  Clone ID: PAT_TA_65080
gttctagatcgcgagcgccgccctttgtttttgttttttttgttttaaagtccaacatacttttaaatttgaagaagatatcactacaattacatatgaaaaatgtcagtcactctgaacttttataagggcaaaatcactgtctacttgcttatattaaagtacaacattgttcaaactttatattgatgaatatttggtagcgaattcagcgatattcttgtcggaacttccttcttcccgcattgcctccttggccttttgcatccacttcacagcatttcttttggacttatcatttctctccacatccatcatctctctaatgcacctctcaacctcctccatctttagatatccattattgtccttccgtacacgcacacccatgctccatgcactctccatatactttgcaatggtgggttggtctgcccaatgcggaatacccacaagaggtacaccattagcaagtgcctctagtgtcgagttccatccacaatgggtaacaaagcaaccaatagccctatgtgcaagaacc

SEQ ID NO: 65081 - DNA, 436 bp, Triticum aestivum
  Clone ID: PAT_TA_65081
ttttataaaaacaaaaaaaaaaaaaaaaagagaacagaaagataaaaaaaaaaaagatgatgatgctggcctgaacatgatgagaacatgtacatacaacaggcgaaatacatggacattatgtgccattgtttctttgcgtagggggccgtgtcttaagaggacccgtttgcccctctccgctcggtgggcgaaccacttttttttggggtcccccagatctatgtctcttggacgggtttgtcccatccgtgtggctgggcaaaacgtggtgtttcccaacctaaggcctttggttggcacttccccttcttcccctggttttaaaaaataaagggccctgccgtacccccctttcaacacttggccccccatttcgggtaaggggacccccccttttctggggctattaggccggggggttgtggggttcccc

SEQ ID NO: 65082 - DNA, 292 bp, Triticum aestivum
  Clone ID: PAT_TA_65082
ttgttttactgtgcttaacttatggcgacgacggcagccttgttatgccgggctatcattgtgcctctgttgtcaactctatttcatttttacactgtcatgcttggagtttaatgcaagtgtattaaggaataatgatgattattgagctgggtagtccttgtggtgcagcttgtatagttctaaaaatttctggtatctaaaaaaaaaaaaaaaaaaataaaaaaataaaatatcaaaaatcatagtgcaaatctcaaaaaagtttcttttacactcgatatcaaacctg

SEQ ID NO: 65083 - DNA, 459 bp, Triticum aestivum
  Clone ID: PAT_TA_65083
ttgttacgcgcccgggattatcccaacagaccgccatcagttaggatgacttatgcgatgtggtatccagacgggtatgctggcgggcgtgtgtgcatttctattgttgatgcacctggtgatgacccgaatggatgcgagcttgcaagagaacggcggacacctgtgcgcacagttgagagcatagttttgagcattattaggatgctctctaggccaaacgatgagactgcagcagatattgacgggggtgaagactggagagaaaagagggccgaggtcaggagactggtgaggagccttgatggcatgcttcaagaaatgctgtgcatatggaggagcatacgggggagtccacaagcgctggaatactataggtggcaccaagatggcgcacctggtgccagcacttggactattccccatgtaatgttccattcatggtgagtcgaatggtga

SEQ ID NO: 65084 - DNA, 549 bp, Triticum aestivum
  Clone ID: PAT_TA_65084
tgttgccaagaagaagtgtccaattgcccttgaagaacggaatgatcgcaagtcatcacaagccgctcattcttcatctattaggagtcaaagggatatgaagagtagcattcgtgaggaaatgtttttctctggtccacaaccttcgcctgagcctaggaaccgaaatgttcctcttctttcgggctttgaacgtagagtttgggttgagcttcttgcttggcgcttccatacaggaaagttttgggctttgtataagctcaagaaacatttgttcagtgctttgcattatcaggattataacatggttatgtccatttacaatgatatggacatagataattatgttttccaattcggttgttgggctgattgtccctcttggagatcttgtatccatcgtggttctatttctggcaactcaactcagccactttaccattatcaaggaactccacgtgagttccttgatgaagggtctgagactgggtctgatatagaggagcagatggccttcggttctggagtgccctcttgtccaattgaagc

SEQ ID NO: 65085 - DNA, 395 bp, Triticum aestivum
  Clone ID: PAT_TA_65085
acacagggcgacagcaccaacgaataagcgggtcgacccaaacacttggttaccaccgccgacccggcgcgagagacgaccaagaatcaacaagcaccgcggacgcagggggatgaacgagatgagggagagggcgcacaacaggagggagcaaggccactccaggccaaagattcgcagcaggaggacaccaaacgaaagacgaaatgagtgggcggcccggctcgcagggcgaacaactgaaccgagatggcagcctgacggggacaaaagaagaacgggggacccgggcggcagagccaaaagaggagcgagatgacaccaagcccaaggcaggcacaggacgcaaagaacaacaccgtgactgggaaaacccaagagcggcccaacagaac

SEQ ID NO: 65086 - DNA, 376 bp, Triticum aestivum
  Clone ID: PAT_TA_65086
tctgttcacgcgtccgctttgtttgggtccttgaagtaggccttcttagaagcacaaaggagatgtggagatttgggttaaactctccatgtgtttgtacaaacgaaacagttatattgattgttgattacttatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaacaaaaaaaaaaaaaaaaaaaaggggggggcctttttaaagtacccaattttacctccccgggctggaaagctaaaattttttttttggggaccctaaaataaaataactgggccggtttttaaaaaccctg

SEQ ID NO: 65087 - DNA, 484 bp, Triticum aestivum
  Clone ID: PAT_TA_65087
tgagcctttcttctactggtgagtgctacagctcaactgattgtggttgttggagtttctgaacctttggtcagatcaagagatgatgaagttatgaccttatggactgatgatcaccatgtttggttctttaggctcgacatcggagagggcaaggagatcaacctcgaggaccgatgcccgcggtcgaagcttctcagccagtgcatcaagtatcttggtccggtaagcttttgcaaacagtttagtacatgggataaatttagagaatgcaagtccatgagagttcagaaggactaatgattcaaactggatttttgttgtgcctgcagaaagagagagaggaatatgaggttgtgatcgaggatggcaagttcatgtacaagaacagcaagcagatcctcgactcctcggcggtccgagggacgcaaagtggatctttgtgctgagcacatccaggaatctgtatgttgggcaggtaatg

SEQ ID NO: 65088 - DNA, 308 bp, Triticum aestivum
  Clone ID: PAT_TA_65088
gcggaattggggggtcgaacgacgcgtgtgaccacgcgtccgcccacgcgtgcaggggcgcgtacgttccattgaacaaaagaacatgcacgtggaaaaccaggcgaaaacgaatgcaccacagacgtcagacaaatggacgcacgcgacgcaaaagaaaaaagaggagacacgaaacatcgaccgaaagatacaccaccccaaaggagggcagcataaagaaagcatgtaacgattcacagactaggacataaataccgcagcagaatagctaaccgaatcgaactaaggagctcagagacacaaag

SEQ ID NO: 65089 - DNA, 198 bp, Triticum aestivum
  Clone ID: PAT_TA_65089
cgcagagaccgggccggaatatctgggtttttccacacgcgcctcccggccacggatatggcagcagatccggtgaagctcatctgctgcaccggcagcccactggatcaccgacccgcgatgcactatggacttgagggcatacgcaactagatgatccagaaggacctcatcagcaagatctaccacctgccaaca

SEQ ID NO: 65090 - DNA, 412 bp, Triticum aestivum
  Clone ID: PAT_TA_65090
gctgggctcaactacgaggagaaggatggagcaatcgatatgatattggaattgtcaagaatttccaacaaatattcggagttgacaaatctcccactacatggctattaccgggcaaacctgatattggtgatggtcatcgattccccaccttggcttcattaacctctcttgctgaagaacaagaacttgctcgagctgttcaaccttgacctccactagggagcattaaccaagttccacgctttaaccaaccttttctgacccccgcccgcattctcaagctacattaacaacatgacaatcggataacggatgggcaggcagtgcagtgctatcgatgccacaactgatgatcactaatcaagatgaatgtgtagcatggaccatcgatgacacaatgataacaatc

SEQ ID NO: 65091 - DNA, 100 bp, Triticum aestivum
  Clone ID: PAT_TA_65091
cctcgagagttggtaccaccccttcccatcccgaacaggaccgtgaaacgactccacgccaatgatagtgctgcaaccagtgtgttgtctcattgatcat

SEQ ID NO: 65092 - DNA, 250 bp, Triticum aestivum
  Clone ID: PAT_TA_65092
cagggaaggaggcaacaacgccgccggccgctacgcaaaaaaagtctcgagaccagcggagacgcggcgcgagagcacaccatgacacagacagcaccggtgacgctggggggagaccgagaagagacggtgccgcacaaacgggggaaacaagggccctccggggccatggccccccgggggaggagcccaggacaaaggaggaacggatggcccgcctccgttggcggggggaacaaccgaaccggga

SEQ ID NO: 65093 - DNA, 271 bp, Triticum aestivum
  Clone ID: PAT_TA_65093
ccaacgaaccgccgcgggaggtgaccaccattcagcaagcaccgccgatgctgctggcggacgccgatgaggaggtgccgccccaacaagtggcgtcatggtgccccggggccaccagagctctgcggaggagctcaccacgaaagaagaactgcttgcccccctccgcccgccgggggaacaacagaaccgcggtgtcagcccgccggggaccaaagaagaacaagggctccccggggcagaactgaaagaagaggttgatgacaccagg

SEQ ID NO: 65094 - DNA, 311 bp, Triticum aestivum
  Clone ID: PAT_TA_65094
tatcagcgttatgattaaggtggaaattacataaattaaaaaggatcgaaatgatggaatgacagaattaagtaacaaaacgaaaggaataaaaaatgcataataaaagctcaaaaagcggaatataaaaaatgagatattacagaaaaaacaaaaagttttaagagtcagacaaaataaaagttatacaacgtgatactaagcagcagacaaataagatcaaaaattgacaatgaaactctgagacagaatgacctgagatatgtgcaatatagctactctaacaagaactaaaagccgacgatttacaa

SEQ ID NO: 65095 - DNA, 281 bp, Triticum aestivum
  Clone ID: PAT_TA_65095
agggaaggaagcaacaacgccgccggccgctacgcaaaaaaaagcgtgcagaccaccggagacgcggcgcgagagcacaccagtgacacagcacagacacgcgtgagatcgccgcgtggcgagacccgagaagagacacgtgcccgaacaacgggcgaaacaagggccctgcggggccatggtccctcgggggaggagcccaggccaaaggaggaacggatggcccgcctccgttggctgggggaacaactgaaccgagatgaaagcctgacggggacaaa

SEQ ID NO: 65096 - DNA, 287 bp, Triticum aestivum
  Clone ID: PAT_TA_65096
tccacgcgtccgcttatataaaaaaaaaaaaaaaaaaaaaaaaaaaaaaaaaaaaaaaaaaaaaaaaaaaaaaaaaaaaaaaaaaaaagaaaaacaaaaaaaaaaaaaaaaggacaaaaagagcaaaaaaaaaaaaggggggggccgccttaaaggatcaaattttacttccccggccatgcaaggtaatagctcttctttagggccccctaaatcaaatcaacgggccgtggtttaacaccgctgggacgggaaaaaccctggggtgccccaagttaaccgccttg

SEQ ID NO: 65097 - DNA, 329 bp, Triticum aestivum
  Clone ID: PAT_TA_65097
ccggaccggcattctcctggccgtcccacgcaaacctcaataccaccaatgaaccgggagctgcggacaccttttcacaaagcgcaccaattttgctggaggttacccgtggagagtacatgtacgtacaagtggccagaatcatggcactgtcggagccattggatcatatggggtcgaatacatgacgaaaaaggccctgctggcccagctccggacgctgggataacaactgccaccgggcatgaccctgacaggaaccaaagaaaaacttgcattgccgaatgtagaacttaaataggaccttgattacacaaggcctaaccttg

SEQ ID NO: 65098 - DNA, 354 bp, Triticum aestivum
  Clone ID: PAT_TA_65098
tttttacgcgtccgcccacgcgtccggggcgaagcgccatgcgggagagagggagaggatcagaggaggggcttagaattagattgatcgattagctatcaaactggcggtgccagagttagctgctgcttaatttgctgacggaatggctgatgctttcgttctggaactgtgggatgactgataaacgtacgctgccacgcgcgaccgatacatgcatgtaaatcttgtttaacaccttattaattgaaatggttaccagtttgtaaaaaaaaaaaaaaaaaaaaaaaaaaaaaaaaaaaaaaattaaaaaaaaaaataaaattaaaaaaacaattatattaccaaacttaa

SEQ ID NO: 65099 - DNA, 264 bp, Triticum aestivum
  Clone ID: PAT_TA_65099
ttacgaccgtgatccgcgggggcgtcgaactgcccgcgcggcgcgaggagatcgagctgcacaccgccgacggcctcacgctggtgggggagctcgccacgccgctcgaccggacgcccgtcgcgacgctggtgaccctccacccgcttccgaccggcggcgggttcatggactcgcacatcctgcgcaaggccgcggggcggctgcccgcgctggccgacatcgcggtgctgcgcttcaacacccggggaacggcctcaccgc

SEQ ID NO: 65100 - DNA, 136 bp, Triticum aestivum
  Clone ID: PAT_TA_65100
tccgtttacccgtcggttgaaccccaggcggcccttttataggggccaggtttaggtaccgttgcaggctacttataaggtctcttatagggaaaccaaaggccaatgaattgcccgtcgtttaccaccgaaaccg

SEQ ID NO: 65101 - DNA, 232 bp, Triticum aestivum
  Clone ID: PAT_TA_65101
gttttacgtttttatactgtgccttctttgataaccttcataatttggtgcgagatatgggtatataacatcatcttatctaaatgcgggtgatgtacaacaggacttcaatctctgtatctattgaggaacgacaatatgacttcatcgaaatgcatatggcattataacacttcgtatatactgaaaagattcgcagctaagccgtctatgggaagccaaagtcgcctgt

SEQ ID NO: 65102 - DNA, 370 bp, Triticum aestivum
  Clone ID: PAT_TA_65102
tcgttgaccactttttacccatccagttggttcaccttgatttaggaacctccgctgattctgcatgatgacacagaagagcaagggtgcggacatgtgccgtactaatgagactgcgcggacgtcgaccgtctgcaggggagcccataagcagctagccaccaaggtggccaggtaagctgcttcgcgaccgctggagcgaagaagccccactgactacaggccaaggaccgagtggctctgggagagccgcaagtaccagaagagcacggagctgctgatcctaaagttgcctttgcgcgctctggtccgagagatcgtgcaggacttcaagacggacctcaagtttcagagcttttgccgtgctggc

SEQ ID NO: 65103 - DNA, 178 bp, Triticum aestivum
  Clone ID: PAT_TA_65103
cggaatttcccgtctgacccacgcgaccgattactcgtgtattaccggtgggcttctcctcgggttccgggtcaggttctgggtaggtccgggtccgccagtagctacccataagcagggttcccgtcaaccggagagaacatgggcgcttcagagccatggcggagacggaataacg

SEQ ID NO: 65104 - DNA, 467 bp, Triticum aestivum
  Clone ID: PAT_TA_65104
tttccggttggtccgggcgttcccgacgaggacccgagagctgtccctgttgcttatctcttcagcttatcgagtgggactatccagttggatataaattccgacacaacactcctcactcctcagtgcaatccatcgtagctagacaccggatcgaagacaccaatatcgcaatggctgcgcgccgctaccgacgacgccgatgccggcttgacgggtaccgcagcgttgccgctcgacggacgcgtggccatcgtgaccggtgcgtcacgcggcatcgggcgcgccatcgcggcccacctctcctccctgggcgcgagcgtcctcctgggctacgcgtccagcgcggccgaggccgacgcgctcgccgcggagcttccgcgggccgtggccgtgagggccgacgtgtccgacgaggccagcgtacggtccctcttcgatgccgccgagtcagcctttggctgtgc

SEQ ID NO: 65105 - DNA, 407 bp, Triticum aestivum
  unsure (1)..(407): unsure at all n locations
  Clone ID: PAT_TA_65105
ctgttcaagaactcaagatggccaaccacgttgcacttctcctcctgctgtctctccagctcaccgcgtcattctctcagcagcccggcgacgacccggacctccggaccctcctcaagatcaaggagcagttcggcgaccaggccgcactggtgtctttgctgcccggcaccgaccagtgcaactggccgtacgcctactgcaaccagcaccgccgcgtcgtcgccatcttcctccagaacgtcaacatcacctccacgatcccaccggccatcggcgacctcgaccagctccacaccatcagcatccacagcatcccgggcctccatggccccatcccggacacattcggcaagctctcgcacctctccatcttcaacatcatgcgcacctncgtcttgggctcc

SEQ ID NO: 65106 - DNA, 517 bp, Triticum aestivum
  Clone ID: PAT_TA_65106
attattttaataaatgttttggcaacgccgttgagcaaagggaaaatttaaaacgatttagctgataaaacccgattactccttttaagaattagtgccccaatttttggtttaaaaaaataaatttatattttataaatgagagaaaaaaaaaaaaaaataataaaggggggggccctttttgggggtcaaatttttcttccccgggattggaaaattaaagtttttttttgggggccccaaaaaaaaattaatgggggggggtttaaaaaaggggggggggggaaaacccgggggttccccaatttaatttttttggaaaaaatcccctttttgccggggggggaaaaaaaaaaggggccccaccaaatggcctttttaaaaatttggcaaccttaattgggaattgggcctccccttttttggggtatttaaaggggggggggggggggggttttccgacatggggccctttcttttttaacgggcctattgccgcgttttttttgtttttttc

SEQ ID NO: 65107 - DNA, 329 bp, Triticum aestivum
  Clone ID: PAT_TA_65107
ctaaaactatagaaatatataaatcaaaaaataatataaaaccctttggaataggaacaaaaaaaaaaaaaaaaacataaaaaaaaaaattctacatcctactatgggctcgcgatctgtgtcggccgagggtgaattcatgagatcggcctcggctcaagtgttctatcgtgcgatcggggttaccatacaattctctcctagtaacctgtcggaattggaaaaaccttggggggccccattttatctggttagcaggaaaatcccccttttggtcccgccgctttattttcttaagggctcttccccttttccctttccaataagtt

SEQ ID NO: 65108 - DNA, 324 bp, Triticum aestivum
  Clone ID: PAT_TA_65108
cgtaactgctgcattgacactgaaaaaccagctggcatgtcacatgtcaactgttatggcagctgctgtatttggcgtcagattctcacttctgctcatcacataatgtccttgagtctcgtagtgaagctatggtcaaaaaaaaaaaaaaaaaaaaaaaaaaaaaaaaaaaaaacaaaaaaaaaaaaaagcaaataaaaaaaaaagacaaaaatacaaaaacaaaaaaaagaacctatccttggggggggccctttttagggaccccattttttccccccgggggtgggaaggattttgtttttttttggggaccccaaattt

SEQ ID NO: 65109 - DNA, 250 bp, Triticum aestivum
  Clone ID: PAT_TA_65109
ctacctagcctgatcccgagggaagggaagggagaaaccgttgagctgttagtgttgatgcgtttgttgttgaatcgaacaaaaaagccgctgtgattcggaattggaattggttggtggaatgctatggtcaaaaaaaaaaaataaaaaaaaaaaaaaaaaaaaaaaaaaaaaaaaaaaaaaaaataaaaaaaaaaaaaaaataaaataaataaaaaaaaaaaaacaataaatatcggggggggcgttt

SEQ ID NO: 65110 - DNA, 373 bp, Triticum aestivum
  Clone ID: PAT_TA_65110
cttgtaacaaagtaagcaccacatccacctcacctcagccacctcgccagagaagaagaagaagaagaagaagaagaagaagaagaagaagaagaagaagagaaggagatcccgtcatgggcaaggggaaggaacctgcaaaggatgcccctaacaagaccaaggcaccgtcaatcagtacccagttgacaaaaccaccgtcgttcaagaagaaccaggtgcagtccaggaataacccgatgctgacttagaagaagaacaggaagctgccgcctaagaataaaaagtgagagtaagcctccaaaggggtgagaccacctgatctccgacatcgtccgaccaggacgaagttaagcggcgtgtttgcgtcaag

SEQ ID NO: 65111 - DNA, 505 bp, Triticum aestivum
  Clone ID: PAT_TA_65111
tttttcgcgttgccgttcctcccgcggccgtcagccgtcgtcttcgccgccccggttttcctcccgtggccgtcagacgccgtcggagccgccctaccccacgccccgccggagccgcccccttcgccgcgggagccgcgggccgctggagccgcccttcgccgccccgccgctcagcttgccggagccgcccgccgccctacgccacgccccgcgggagccgcccccttcgccgtgggagccgcgggccgttggagccgaccttcgccgtcccgccgctcagcttgccggagccgtccgccgcacccccttggccacgggagccgagtgccgccgagccgttcctccacgaccaccacaaccaaggtagggagcgctgctccaaccttctctcctatgactccaagtctgacgacgcccgcgaccaggcgtgctcccctacatgggacgaggaacgtcgtatacaatattgggtaacagcttgtgtgacggaattgccgagttt

SEQ ID NO: 65112 - DNA, 328 bp, Triticum aestivum
  Clone ID: PAT_TA_65112
tatttaaacaaaaaaaaaaaaaaaaaaaaaaaaaaaaaattaaaaaaaaaacaataatgaagatggcatactcttaaagaagttcgagttccatcagctggcgcggtcatggccctccgtggctctggctcctctgaggcggagtccctgcctttctgttgtattgcttgactacctgcgatcgctgggcgttccacagatccgtggcgtgggactgcctgggccttccgacagttttggtcctgccggtggaggcccctttccgcggcgcttgatgacacgaggcctccccgagggactgcccgtcccttccttcgctcggcctgtt

SEQ ID NO: 65113 - DNA, 408 bp, Triticum aestivum
  Clone ID: PAT_TA_65113
ccttcgcgtccgcccacgcgtccggcgagagctgggctgatgaacccgcgggtgctcctcctggacgaagccaccagcgccctggacgctgagagcgagcaccttgtccaggatgcaatggactcgttgatgagagggaggacggttctcgtgatagctcaccggctctccaccgtgaagaccgccgacaccgtcgccgtcatcttcgaggggcagatcgtggagagcggtacgcacgacgagctcctcggccgcgacggcatctacacggccctggtgaagaggcagctgcagttgcccatgttagactatgtatagcttcctgacctatgtaccgatatggacatatttttacacaaccattatatattatgggtaaggccttcctaaggggtggggctgggtccc

SEQ ID NO: 65114 - DNA, 582 bp, Triticum aestivum
  Clone ID: PAT_TA_65114
ggcggttttgttaaataaacgatagtcaatcaccggttagaatatttaaaacacggggggttccataccaaccctgaaaaagagatcctcgaccttctttcatccgtctccgtttcgggggcccgcgtctgggtcccccgctttgctccctctcttgccctttgggggggccctttttggggggcccgggtttctttccggggcggggcgaccccatgctttctttgggggggcccctcttttctctttccggggcgggcgtttccccccgggggcgtggggaacccctggggggtcccccacttttgtcgtttggggcgcccttccccttttccgcgtggggggatttgcgcaggggggcccccccctttccctttcccccaggtgggcccccctttgggggggacggggcccccccttatgcggttttattgcgcgggggggggggggggtccctcctgggggcctctcttttttgggggctgtccccccgtttttgtttttctcttttttttgcggggggggtttcccggggttttttgggggtttttggggggtttttgtttttgcccccccccaatt

SEQ ID NO: 65115 - DNA, 393 bp, Triticum aestivum
  Clone ID: PAT_TA_65115
tttggttggtgtgatcccagcagcctggcctccatgtgtgataaaaaaaaaaaagaacataaaaaaagcccaaaaaaagaagcagagaagacatccagcatactcacaggacggctggcgccaccagagacacgaacgaggggggggccgcccaagaggacccaagggcccggccgggggccccggacgacaaacctctcctaagggggcacccaaatccaagtcacgggcggccgtttaccaccctcggggccggggaaaccccgggggttccccacccaaagggcctgggagaaaaaccccctttcgccggggggggaaaaagcaaagggggccgacccggacggccttcccaaccgtggcccacccggaagggaaaaggggcccccccct

SEQ ID NO: 65116 - DNA, 307 bp, Triticum aestivum
  Clone ID: PAT_TA_65116
ctttgtactcgccacccggggtcgtcctggcgctcctgctgccggccgagatcgcgctctcgttcgtccgctccctatccgcgctggcgcccttcagcatcctcgccgacgcctgcaccgagctggccgtggccgccgacgtcaaggaggacgtccagctgctggccgagcgcgggcgcccgttcgacggacggagcgcgttcgctgggctctggggcgcgccgagcgactgcggcgctcccgtggtctgcttcgaggggttctgcctcacgctggaggtggaagcgtgcaagtggaaccggggcag

SEQ ID NO: 65117 - DNA, 217 bp, Triticum aestivum
  Clone ID: PAT_TA_65117
gttcagtcttatcacagccgccgccgccgtcgaggaagaagaagaagaagaagagaggaagctaccggaccaagcccggcgggcgaagatgaagacgatcctggcgtcggagacgatggagatcccggaggaggtgacggtgaaggtgccagcgaagatgctcttggtgacggttcctcggtggacgctgacgcttaacttcaatcactttaactct

SEQ ID NO: 65118 - DNA, 152 bp, Triticum aestivum
  Clone ID: PAT_TA_65118
ttgataattattgctggggatcttgctcaaagtgaactggtcaccaaattatgaatatattgattggcttagcatacaggtcacccaaacaaaaaatagttgaccacatgacacaacgaaacccaacccccccccccgaggcactccctaag

SEQ ID NO: 65119 - DNA, 144 bp, Triticum aestivum
  Clone ID: PAT_TA_65119
tatgctggttaattcaacatcgcttccccaactgtccaccttggaaatagaggtggaagaactgcaagcggatgacattcagatcattgggatgctgcctgctcttctgtgtctggttctgttcgcacgtcacgtgatgggaac

SEQ ID NO: 65120 - DNA, 270 bp, Triticum aestivum
  Clone ID: PAT_TA_65120
tttgttaccaccaggcatgctacaggcgagtagatagacattgatagaaatcgggattgacatctaggtgacaccgcaggggggcgagtcgtacaccatggactactctgaccctcccccgtcatcgatcgtgtacgtagaggagcataccaaatggtcgattgaccgcgcggcgatcgccgagtgcgtgacaacggtactgttgctctacatcagcgtggccaccatgatcaactacatgcacgagtacgacctcttcgtaaagaccac

SEQ ID NO: 65121 - DNA, 260 bp, Triticum aestivum
  Clone ID: PAT_TA_65121
ttggttaccgaccgcgagccgccgcgcgagaggacccaggctcacgcacgcgcgcaggcgacgccagaggaccccgacagggccaccgaagtacaactcaccggaccggcggcccacaaccggccagaccgggaacaacggaggcgctacccaacacaagacgcctagcagcacatgacccctgcacgccagcgcggcgcaaccagcgcacgaggcgccgacaccagaccgccccccaaccaaacagaacgcgccagcca

SEQ ID NO: 65122 - DNA, 166 bp, Triticum aestivum
  Clone ID: PAT_TA_65122
tactggccgaccccgcggcgatcacgacggtgaccgtggcggccgaagaggaggaggagagcttctacttcgggtggttcgaccagcacccgacgtggcacctgacggcgctatacgtgccgtagttcgacgtggcgccgtctccggaggactgggagcgcgagct

SEQ ID NO: 65123 - DNA, 387 bp, Triticum aestivum
  Clone ID: PAT_TA_65123
gctactttgtgtgagaccgcgcgcaagtaaacagggacctagcaagcgaaaagaaccttaagatatgacagcttgacaaggaggtgaggaccatgctggtgatcatggtcaaaagctgccttggcacctatgacaccatgggctacagcagcgatctgcttgggcttatgttgcaggcgtgcgcggaacaaggtgggcataaatgcgattctgattgtggacgaaagaataacatgagggcaagacctgcttccctgccagaggtgacagcagatagcacgtgctaacatggaccatgtccttgttgaacacacaccctgagtggcaacagaagctgaggccggaggtgctcagatagcgtggcagtcaggtttccaccggtgacat

SEQ ID NO: 65124 - DNA, 120 bp, Triticum aestivum
  Clone ID: PAT_TA_65124
ggtcattccacagagcatcagccggagcacttgtatgtccactttgatcttcatccggctccggcgctctcgcacgcgcgaacgagcgagaccaccacctcgaaaaccaagaagagatgg

SEQ ID NO: 65125 - DNA, 261 bp, Triticum aestivum
  Clone ID: PAT_TA_65125
gatacttccgcccacgccgcccaggagccagcggagggttatttggcaccgacctcgcacctcaccgacggcgccgagcgccatgcccaaacaaggggggaaggccaagcccctaaagcaggcaaaggccgccgggatggactcacgacagaaagacccgggaaacccccagaagaagaagggggagcacaagggcctgaaggagcatgaaggcccaggcaggacagaagggcgcgctgggaggatcgggtctcaagaaga

SEQ ID NO: 65126 - DNA, 241 bp, Triticum aestivum
  Clone ID: PAT_TA_65126
tttgctacccgcgccgagacggcgcgggagagggcgatgatttagtcagtaccgttgatgtttaatgctgacaccgatgagatcatgtccgcccaactggagtactcacggtccttcgacgcccacggagcatcctgtggcggagcccatgactgagagatgaactagattgccccgcgtaccactagcagggcgaacaaactgaaccgttgatgttagtctcgaccgggaccaaaagaat

SEQ ID NO: 65127 - DNA, 325 bp, Triticum aestivum
  Clone ID: PAT_TA_65127
tttattagctggggatactccctggagcacattgcccacaatttgcaatcgcagcgagggcctgggtgatgcattgttagggaacatcatattcacgggcatgttactcctgggagtacgatatatgctcaaattttcttgagacattacacggtagtcgagagattctgctagccgtcatcatttgaagctatttcaagacatttatgctgacaatgatggttcgggagatcccatgatctgctatatggattggctaaacaaggggcctgtcatcacaaggtgtagcccttgagagtggtgacgcggttcccaaaggcccact

SEQ ID NO: 65128 - DNA, 213 bp, Triticum aestivum
  Clone ID: PAT_TA_65128
tctgtattacaggctgagggtgctatccaggctctgaattgcagcgggatgattttgggcacactgccagtcagggtgagcccttcaaagaccccggtgaagccacgtttaaattgggtggtgtcaaactgactgcttgggctacacactggattgtcgactggtaggctgcctgtccattagctatagttttcgcgatccattgaaaccatt

SEQ ID NO: 65129 - DNA, 446 bp, Triticum aestivum
  Clone ID: PAT_TA_65129
tttcaacgtgttggaagcggtggctgcggagctccactccctttcgtggatgacagtaagcccggtctacatggaaaggcgcagcgctctccccttccactgtgatatggttctgaggttgaggagacttctccactacgccgatcggcatctctctcagccaacagacaagggagatgttagctagcttagagaggtgattgctaattcacatgattgaaactatagctgtttgttttacacaggtaaaaaacaaggggtagatgccgcttaaacccaagtgcctgtctctgtgtatctagattagggtaggcaggtgaatggtgcgttgatgagcccggttctgctctgatagcaagagtgttcatttcttggcgtgaggatgtatgtaatagcaatacctctcccttgcatgatgtgtcaatcgtgcaacattgtagaactgg

SEQ ID NO: 65130 - DNA, 198 bp, Triticum aestivum
  Clone ID: PAT_TA_65130
atagaagaagatgatcaagattaaaatcaagacctcatatatgataggatatggaagaatacaccatctaccttaggaggtctttcctgaattctttacaatgcaagaatgtatctctcttattaagtatccatgtatgtcatacgccagataactttgtaatatttatccgattatcaataaagcttgaattatctt

SEQ ID NO: 65131 - DNA, 194 bp, Triticum aestivum
  Clone ID: PAT_TA_65131
gtattgcgaggcgaccggggggcaaccctaaaacccgccagtctacgccccctataccctccccctccctcgccgacgcccgtgggcgcggatggacaaagcccaggcgccgtcgggggagagggtgcctcagcgggcgactgctaggacagagcaagcgcagagccggcccctcgtcgctgagcgaacagctg

SEQ ID NO: 65132 - DNA, 343 bp, Triticum aestivum
  Clone ID: PAT_TA_65132
acacccgtttacaacaggaacaagcgccacacggacgacgagaacataagggccgccggggccctctaccccgacaccatcaagcggctcctgaacccgacgcaaacaccgcgggcagccgaaagccgagcgcacctgagccctgatcgcctcgatacaaggacactagcttgcgcatattagaaaattcaggaaagcccgcggataccagcaggcccgggccaacccaaacagaaaaatcggccgccctagactccaagacaaggccgggctcctaggcccccaggagcaagcacggccggggcgaacccaaccagcaccgagaaaacggaaaaccccgggg

SEQ ID NO: 65133 - DNA, 400 bp, Triticum aestivum
  unsure (1)..(400): unsure at all n locations
  Clone ID: PAT_TA_65133
acgcgtgggcggacgcgtgggcgagccgcaccggtgcctggaggtgccccacatcgactaccggcagaactgcatcgcaggtcgccccgaccagcggcccggcgagcagtgcatcgagttcctccaccggccgccggcccagtgtgccgcgcacgggcaatcgtcgccaccgccgatgtactgatacgtggcagacggcaatactgcaatttgtaactgtttgctgcctttgtgccgcgagaaaggataaaaatgtacacatttggtatatactgtaatctttatttttcggaaacaagaaataacaatggattgatagatttgcgttnaaaaaaaaaaaaaaacancnncaaaaaaaacacacaactataaacaacaaaaataataaaaaaacaacaag

SEQ ID NO: 65134 - DNA, 191 bp, Triticum aestivum
  Clone ID: PAT_TA_65134
ttatttgaagagttgaactttctggaggggtcggtgttagatcgacaggggctagtagcagctatagtggactgtaacagcagcagcaatcagcctttctctagatggaaaatttggagggtgataactctgtggaggagaccatgacaaaagatgaaactgattgcccacctccggggggtgcgttatca

SEQ ID NO: 65135 - DNA, 175 bp, Triticum aestivum
  Clone ID: PAT_TA_65135
tcgtttacccctgggataggcccttgtgtgaagtgatgactggagcagcgaccgatgatgtgcgcttccttctcaatatacatgagaaaatgacggaggagttaagcatggccttttcatggcgtctggcactacgctgtgagctcttctgcatgggatgaagcataaatgacaa

SEQ ID NO: 65136 - DNA, 366 bp, Triticum aestivum
  Clone ID: PAT_TA_65136
cggacccacagggcgaaggcagaaacgactctgccggatacccgaaacaccggttgaccaccggcaacccggcgcgcgagcgcaccatgattcagccagcaccgccgacgctgccggcagaccctgaagagagcgtgaccgaacaactaggcgaaacagggccctaaggggcccacggacaaatgcggaggagaacacgacgaaagaggaacggaatgcaccgccccgaccgctgggggaacaacaggaccgagacgccagccggacggggaccaaagaagaactggagctccgaggggcagagccgaaagaggagcccgacgaccacccaggccaaaacgaggcacaggccgccgctaaacaacc

SEQ ID NO: 65137 - DNA, 209 bp, Triticum aestivum
  Clone ID: PAT_TA_65137
tgctaatcagagtggtgtcgatcggacatggagcggcttaattctcatcatgggctgcatgtctaactatccgcttagacttattattccgccagatactgagtctattttgctccatagaaaatttcttctgttgagcctggctatggagaaagatgaccttattggcccgactccctttgctggctaagaacttcccctgcccaatc

SEQ ID NO: 65138 - DNA, 338 bp, Triticum aestivum
  Clone ID: PAT_TA_65138
tgttacgcgtccgatcgccgtcatcggcggcacagggaagtacgagaccgccaagggcttcgccgccatccgcacactgcaccccggcgaccagcacgccaccgacggcgtcgacagcctcctccagttcgatattcacctctcctgagctgagctgcttccctaactagtggtatcagattatatgatgctctgccgtcgcgctgaacatttgaaatctgaattttacggcctatgcattttactaccataacacctcctatatggtaatgcaaactaagtacctggtgtattttatgcattattttatgaaaaaaacttaggttttttaatgcctt

SEQ ID NO: 65139 - DNA, 352 bp, Triticum aestivum
  Clone ID: PAT_TA_65139
tttctcctttccccaacccaaaccaggagcgccctccctcccccagccgcccgccccctccccacccaggaaaccagccatgaagggggccaaatccaagggcgccgtcaaggccgacaccaagttggcggcgaagagcaagggggcggagaagccggccgccaaggggaagaagggcaaggccggcaaggaccccaacaagcccaagagggcgccctccgccttcttagtattcatgggcgagttccgcgaggagttcaagcagaagaacccccagaacaagtccgttggcgacgtcggcaaagcggaccgtgagaggtggaagaacttgagcgaattcgacaaaggcccc

SEQ ID NO: 65140 - DNA, 332 bp, Triticum aestivum
  unsure (1)..(332): unsure at all n locations
  Clone ID: PAT_TA_65140
cttctagccagcttggttcagtggagttctgtctctgacgattcgatttcggtaccgcgacggctccgaaatggagagcgactgccagttcctgctggcgccgccgccgcgcatgtacgccgcgccgggggacgacggcctgttgctgccttgtctagctggttgatccggaccatgtagatcatcaggtcgatcggaccgtcatgtagaatcgtagaacagataggtaggatcccacatgcaagcagccacgaaatctacatgcgagaaatcttcccgccggccggccggcgatctgcttcgtcgactcanaccangaatgtgaaaaccct

SEQ ID NO: 65141 - DNA, 471 bp, Triticum aestivum
  unsure (1)..(471): unsure at all n locations
  Clone ID: PAT_TA_65141
tgggtgnatcaccaacgtatcctaaagtctgcagtgtgaattgtgttggagtgctggtcgcactgaaccttaagggcctgtttgatcatacattcaatttgtatagagaaatcatgtgttcttcgtgtggtgcaaccaaactactattactgactaaaaaaaaaaatgcccacctaaaaccactggaagaacactcagcaatgtaaagaaaaaataaacagtcactaaaagaaaaaccgttgcttaatgaggaaaaatattaaagaggagattgattacacaaggcctaaacattggggggggcccttttttaaaaaccaaatttctggcaccagccttggggtacccaaattttttttttttggaccacaaaattaattttccggccggggtttttcaacctgggggcggggaaaacccccgttccaccacacataatatctttttaaaaaaatcccctttttgcggggg

SEQ ID NO: 65142 - DNA, 414 bp, Triticum aestivum
  Clone ID: PAT_TA_65142
gtgttatactcggggggcacgcgttggtcggacacccagggttagcgttgcacactctaggggaggtgtgactggcaatttggggaggccaaaactacatcaatggcccgcgaggtacaaacggcggtaattggaaaatccctggggggaacccaaaataaagggggtgggggttataaagtatccaaccttgtgaccacatccatacgaggccttaactcttctatggtgcaaacaaaaatcaaacccttgggcgcaaatttacaacaccggaactgggaaaccccaggcgtaacccagcttattgccctttgaaaacaaccccctttgggaaaatgccgtagtaccaaacaggcccgtcccgatgcacttccccctttttccgcagcttgaataccaaaggggacccccccc

SEQ ID NO: 65143 - DNA, 315 bp, Triticum aestivum
  Clone ID: PAT_TA_65143
ccctctcgtccggtggtgatcagacttggggggctaacacagctgagtacacagattaagtaactatttatcttctccaattgaatctctcgtttccaagggtgttccttgtgtgaaaaaaaaaaaaaaaaaaaaaaaaaaaaaaaaaaaaaaaaaaaacagaaaaacaaaactaaaaaaaaaaaaaagagggactaaaccgtaaagcaaccctgacagggaccacagaagaactcgcgcttagtttggctaaaagtgaaacaaaatgtagttgactggtggtctatgcctagcactgggcgtggaaaaaccccg

SEQ ID NO: 65144 - DNA, 385 bp, Triticum aestivum
  Clone ID: PAT_TA_65144
ctttctcgtacggtactattccgaccatgcataggccacgcgtgaacagctccgagcactgacccatgacacacacacacatacaacgccagggtcttattctgcactgtgcagagagaagagcagagagcagaggatgcgcatagtaatgccacatgaacggtgagggctccttggtgtgagaagatggcgctaaagacggggccggggccggtgtgagaggacatgaacatgcaccatcacatcgagcgacagggtgacaaggactggcggacgctgacgaagcaggccggtctgatgtgctgagcaaggagctgtcgcatgcggtagatgatgtacctgttcacggatatcatgcgcggacacgtgccagcgaggaggatga

SEQ ID NO: 65145 - DNA, 279 bp, Triticum aestivum
  Clone ID: PAT_TA_65145
gatgaagagaggagagacgtgaggggagccacagacaaacccacatgcaaggcgcactcaccagcgcgcaggctacatgggaggaggcatgggacggggcaccgggctgtacatctggggctgcgagtggctctgcgagctgctcatcttgttcgtcgtcttctcctgctagataccttggtttattgctcatatacatgcatacttccatcttatttgcattagtgtgagagacagggagcgtgtcagtgatcttttaggcgaggatggccgggaggg

SEQ ID NO: 65146 - DNA, 236 bp, Triticum aestivum
  Clone ID: PAT_TA_65146
ctcatgcgtccgcccacgcgaccgcccacctcgaggggtattcctcctctgccttgctccccccaccactttcggccaacgctcctccagccagatgagaccggcagcggggacctaccccaggccattcggcgtgcgcaactccggagcccccgccgactgggcccctccggccggctccatgcacggctactacgccgcgcaggccgcctactccggcgggtacgacaagatgc

SEQ ID NO: 65147 - DNA, 251 bp, Triticum aestivum
  Clone ID: PAT_TA_65147
ggtgaagttcaaggaagccatggtaaggatgggcgctatcgaagtcaagaccagggacgattttttcaatggtgccgctgttgagatcaggaggaattgtcgcatcgtcaactcatactaaacttgttgatcttatcgcatcatcgctagtttttcaacagtagattgagaataagctcgtgctttctcgggtttccattgatgtttattttgattacttttgtaatgttattattttttccctataataa

SEQ ID NO: 65148 - DNA, 382 bp, Triticum aestivum
  Clone ID: PAT_TA_65148
ctttctcgccctcccccgcccgccaccggcagccatggcgacggagctggcctacgcgccgccgatgaagtcggggaagctcgggttcgagggcacccaggaggtgcagcaccgcatccgcatcaccctctcctccaagtccgtcaagaacctcgagaaggtgtgctcggatctggtgaagggcgccaaggagaagcagctcaaggtcaagggccccgtccggatgcccaccaaggtgctcaacatcaccaccaggaagtccccctgcggagaaggtaccaacacctgggatcggtttgagatgcgggtgcacaagaaggtgatcgacctcgtcagctccccggacgtagtcaagcagatcacctccatcaccatcgagccc

SEQ ID NO: 65149 - DNA, 252 bp, Triticum aestivum
  Clone ID: PAT_TA_65149
atgtgtatctggtaatatcacggacgcagctcctctgacgtgctgtcagcccactgacatgtgggcccggccccacgcgtcagtgagccaacggcagggtgcagtacggcagaggagccctaatatcactgtactggaacatggttaggtgtttatggtgtgctggaaatgctgcatgttgttggcattgttccatttgagtctcggatgatgtcgcttgttgcttatttgttttcagttagtggggtcctt

SEQ ID NO: 65150 - DNA, 393 bp, Triticum aestivum
  Clone ID: PAT_TA_65150
gcgtttttccggatgccaaatttcaatagcgttcactcggagtcggaaacaacgacccaaccagacacaccacacgccaccgattaccattcttgcggggctcggcggagggtgtaagaatgggctgcttgtagtgcacgcgcgggccgttgatcggcaggggctcctcggccacggagaagatcgccgtcaaccgtcggaccgggggggaactagcgggcaagagagtggccgccgatcgggacgccgagctgaggggcgagcggggcatcctccgaggactaagatcgccggacgtcgagcgctgcctggacacgcaggacaggagcggaggacttctcaacatgataatggagaacgcgttcggaggctcgctgtcggacgagatcaggc

SEQ ID NO: 65151 - DNA, 534 bp, Triticum aestivum
  unsure (1)..(534): unsure at all n locations
  Clone ID: PAT_TA_65151
agcatatccaatagagaagagagaggcgcaccggccctttccaggccacctggccctcttgccctcgagttcagctcggatgaacgatgatgtgaggaagcagcaagagaagcaaaagggaagaggaggcggaggtggaagcggaggaggaaggctggcgaggatgctgcgggagcacagggccaggctctacatcatccggcgctgcgtcgtcatgctgctctgccaccatgactgatgctcgctccaccgatcgatgtttacctgcgaccctggcccctgctacatcgtctctgcctgctactctgtccggccaccatgtatctaggttaggtattgtggtttcgatcttggttttgcttgtgcaggctcgacagattaactccttggtgtacatataggcaggggatgtaggtagttgttttctgaattctgacggntactctgggtttcgaggtttggtgggagtgtggcgtggtgctcccaagtcctgcaatggcgaggatgcacatgtatcgatctgttctgggtact

SEQ ID NO: 65152 - DNA, 453 bp, Triticum aestivum
  Clone ID: PAT_TA_65152
aacctgtcctatgcttaccttgatagtatctgtttgcaccgtcaaattttgctaccttcgttctgtggctgaacctccaggcatgtctgttgaactatttgctatgtgcctgtgttacctggaattcgaatgattgaagtagtcctcgatgtgtgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaggggggggggcctttttaaagaaacaaattttcctccccgggtattccaattttttttttttttttgggggaaccaaaaataaattcccttgccccctttttaaaaagggggaaaagggaaaacctctggcattcccaaattaaatgggctttggaaaaaaatccctttttggcagatgggaaaa

SEQ ID NO: 65153 - DNA, 138 bp, Triticum aestivum
  Clone ID: PAT_TA_65153
ggcgaacgcattgacgcctatgtctgtaacctgaaaaactgggtgttctccgcccacacggcgcgcgagtctcaccatgatacagtttgcaccgttgttgctgctggctgcccctgatgagcttgtcatcgaacaatt

SEQ ID NO: 65154 - DNA, 303 bp, Triticum aestivum
  Clone ID: PAT_TA_65154
atcctgtttatcaaagatcattttctaattcatgatgtcattgtgcctgcatcagacgcggcggatccattgcagcagctgatccggttgactgtgctgttaagagtgctagttgcgggaagatgatacgccttagatgtcgtgatctcaggatctttgctgaccaagaaagtgtcgtgaacgtcctatggatgccaactgcgtacagggcggactacttaacatgtggcctgatgcagcaccaacaggtctaagggctgagcgctacaccttactaggacactgactgtgactggtgctggt

SEQ ID NO: 65155 - DNA, 539 bp, Triticum aestivum
  Clone ID: PAT_TA_65155
tctttctcttgtccccctcctcctccgccggaactagggttttagcggtcctcgcgccgtcgccctcgggagccatcagccatggacgactcggcccagctgcagcggttcatcgagcaagagaaggagaggatgatggtgagcgagatgatcggcaaggtgacgagcgagtgctgggacaagtgcatcacaggcgctcccgggagcaagctgagctccggcgagaccagctgcctgagcaactgcgcgaagaggttcatcgacatgagcgagatcatcgcgaaacgtttcggtgtgcactagaacaaggccgccacatgcacgtgtgcagttgcttcctggccttttgagctatgtgtccttcggtgtgagcggattttggtgtggcgttaaagatgcataggtatgttcagtgggggtttaactgagcaccgaagtatgcctgtcattgtcgtcatccttgtagtaattctcgcactctgggttgaacttttgaccgcgcttccaggagcaagcaagaagcttggcctgttttaaca

SEQ ID NO: 65156 - DNA, 441 bp, Triticum aestivum
  Clone ID: PAT_TA_65156
gtttttgatcgggagctggcgcgcgagcggacgctagcgaagatacacgcgtatgcgcgggtgtatgtcacgtattgggtcatctatagtgaaatcactggtcgatgcactgcaccgcggtgaacggcaaaacgattgggaaacccatgtcaatacccaagtaaaacatcttgctgtacatagctgttttaatagctggcaggatcgcgccgagggccgtaccgaacagacttgcaaacagaagggcaaacgggacgcgcactgggacgcgccatgaagcgccgcattaggcgcggctactgtcatggttacccgtacactggccagtacactagccagcgctctattgcctgtttcttctgctttcctcgctacgtttgtcggcacgttcggcgaagctctcagtcaagggctaaattgagggctccgtattagggctcg

SEQ ID NO: 65157 - DNA, 468 bp, Triticum aestivum
  Clone ID: PAT_TA_65157
ggcggagtctcgtggacgcgcgcctggggcttgccatgcagctcataccacttgtgaactcccctgcgactccgtgggcacggccggcgcgcatggcgggggggccggcggacgccctgaaatcttgtcgaggatatgagcggtacgacgcctcaggcgcggatagcaaagctggaagccctgttgctgaacaaacaatggcgcatgcgaggcaagtttatctgccatgagagatcttcagtcacagcttggcgcagccaccaaagaatgtcttgccgagaaggaacagaacccgaagctgaccgtggagaactgagaaggcttccagtatgcgagtactcccagtctcataccgaacaatcaaagaggcggagtccagatagataagccccctggaagctggatcccgaaaactagtcctattttggcttccagagagaccgccatctggcagatctgtgtatgcgc

SEQ ID NO: 65158 - DNA, 388 bp, Triticum aestivum
  Clone ID: PAT_TA_65158
ctttttcgtcatcttccatgtcatctgcgcccatgtcgggccgcggggaggtcggcaagggcctcgccaagggccgccccaaggtcctccggaacgtcatccaggacatcatccagggcatgaccaagacgccgacccggaggctcgctatgaagcgcatcttgaagctcatctacgaggtgacctacgaggagacccagagcttcctcaagaacttcatccagaacgtcatccgctacaccgagaactacaccgagcagacccgccccaagatcgacaccgtcttggacctcaagtacccgcttcagcgcctgtaccgatccctctactgatcccccggatcatcgccgttagctctgctgctgaccctgctgcttcctgggtttgt

SEQ ID NO: 65159 - DNA, 440 bp, Triticum aestivum
  Clone ID: PAT_TA_65159
cccacgtgtccgcccacgcgtccgcccacgcgtccgcccacgcgttcgcggacgcgtgggcggacgcgtggggccgaacagctcccctgtcgcctgcccctgctccgccccttctcgtgcccgggctccgctccgctctcggtaattggatggcctcgcctacgacgccgacgaagttcaccggcgcccaggaggaagccgcggcccgccagtcgctcatcgggatctcccagtccatcccggcggcgggagaggccctgagcgtcaagtcgccgaacggtcgtacggaacacgggcaggacgacagcggggcggccgacaagtccaggtcgatgctcatgtccatcttcaaccagtcgccggaggcccgccaatccactccgtgcccgcacaagaatgccgcttaggcttaagcttgatcttagtcctgtaatagtact

SEQ ID NO: 65160 - DNA, 434 bp, Triticum aestivum
  Clone ID: PAT_TA_65160
aaaattttggtgcaccacgtactgtccagttctagtgccaggttcgagctagcagagcagagagactcacgccatggcgctggccaccccgacagccgtggtgctggagctgatgacgatggggcagcagtccgcggcgcacctcagggagcttctccgggcggcgtccccgccggtgcaggcggagcaccaggcgctcgccgcggagatcctccgctgctgcgaccgggtgatcgccgcggtgagcgcgggcgccaccgataaaaagaggaaggcgacggaccctggcgccacatcctgccatcttcccctcgccatgatgccgtccaaaaaaagggtgcgtggggcggaagcccacagagaggtccatgccgacacgacggcggacgggttcgtgtggaggaagtacgggcaaaaggacatcaacggaagca

SEQ ID NO: 65161 - DNA, 282 bp, Triticum aestivum
  Clone ID: PAT_TA_65161
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttgagggacccatgtttacttccgggtgtttgcgaccatatattttttttttggggacccctaaattaaattccctgcccggcgtttaacaacagagggactggaaaaaccttggggttacccaatttaagcgctttgagacaaaaccccttt

SEQ ID NO: 65162 - DNA, 300 bp, Triticum aestivum
  Clone ID: PAT_TA_65162
cccatgcgtccgcccacgcgtccgcccacgcgtgcgcccacgcgtccgcccacgcgtccgcggacgcgtgggcttggatcctgtcaagcgatcgacctacagcatcttgaggagaatgtcaaggatgccgtcaagagcatgcttaaaatgacggacctgaagacattgagcacgcaccaacaatgggcaccttcacaatgcgcgattctgtgagaaagaactccttgttaccattgaccccgaggcggtgtttgcgaatgcagatgaaccttgcagggccaactacccattgatgcagaa

SEQ ID NO: 65163 - DNA, 398 bp, Triticum aestivum
  Clone ID: PAT_TA_65163
ctcgctatttcgtgtatgcgtccaccttctacggcttcggcgccggcaaaccaatcgcgtatcgagcgattcctccaatcacgagaggcgagccggctggaagagcacctacccagcaggagacaagatgacgttcacgttaaccaacctgatcaggctcatgttcaccaagatggagatgcggatcctgatcgagaatgataaccccatcctgaagaccaccatcctctacaagctcaagatcagggagatctacaccaccatgctcaccatgaggttcaatgctgtaactgcggtgtacaagaacatcagctctactgtgtgcaatgtcatgggttacgacaagatcaatgcactgtggaggcattacttccagaacacacaggggctcatctttg

SEQ ID NO: 65164 - DNA, 430 bp, Triticum aestivum
  Clone ID: PAT_TA_65164
cccttttgtccgcccacgcgtccgcccacgcgtccgcccacgcgtccgcccacgcgtccgggaatttctgataatgatgctgggagcgcggagtctgtcgaaaagttagatctgctgaaagatacaaaagtttctctctctgccaaccatctgcagaagttacgtctatcttttcaactatctacaccacttggacgcacatttaaaccccaccaggttttcttgaagttaaagcatgaaagcaaggttgaacacttatttgtggtgccaggttctgcgaggcaattcaaaattgttctagattttcttggattggtagagaaattttactacctttctggaacatatgacctcgagctttcagttggtgatgcttcaatggaaaattcgttcctacgagttcttggccaactggagttggacttgccgg

SEQ ID NO: 65165 - DNA, 358 bp, Triticum aestivum
  Clone ID: PAT_TA_65165
cccacttttccgctcctcgctgaactcttcctcgtctcatcccaatgcttccaagatgtcggtggattcctctacatcgtcgactccatcaagcaagactcatctgatgttgccaacgacatcatcggtgccatcattgccggtatcatggccaagaaagccatctcagactgcggaccaatcccagccatcatcaacgaaatgatccacggttagatttgattagtatgttcttcatattgtatcaaatacccctcgaaccctatatctaaaatataagtattgaggaaggccttttataatgacatcaaaaatcaattactggaaaacgtttacaaaaccaaaaaataggaaaacg

SEQ ID NO: 65166 - DNA, 136 bp, Triticum aestivum
  Clone ID: PAT_TA_65166
gcgtttattcgtgcgatttatacagcggttatgttcattaaaaaagcaaccgatgatgctgatggatgaccctgatgagatcgtgtacgaacaacatggagaaaaaatggcccttctgggccatgggcggtctgtt

SEQ ID NO: 65167 - DNA, 378 bp, Triticum aestivum
  Clone ID: PAT_TA_65167
ctctcttgtcagcgtctcctccagttcggaaccccaagctgcacccccggctccggcgaaatggccccgaagcgaggcggcaaggcaccggtgccggcgaagaagaaggcggcggacaaggtggtgaacccggtgttcgagaagaggccgaagcagatcggcatcggcggggcgctgccgcccaagatggacctccaccgggtcgtcaagtggcccaaggtcttgcggatccagcgccagcgccagatccttaagcagcgcctcaaggttcccctggcgcttcaccagtttatccgcaccctcgacaagaacctcgacaccaacctgtttaagatgcttcttaagatcctgcccgaggacaaggtggcttacaaggag

SEQ ID NO: 65168 - DNA, 365 bp, Triticum aestivum
  Clone ID: PAT_TA_65168
ctcttttgtaggcgcttcccggtgacaacgtcggcttcaacgccaagaatgttgccgtgaaggatctgaagcgtgggtttgtggcatccaactccaaggatgaccctgccaaggaggcagccaacttcacctcccaggtcatcatcgtgaaccaccctggtcagatcggcatcggctatgccccagtgctagactgtcacacctcgcacattgctgtcaagtttgctgagctggtgaccaatatcgacaggcgatctggtaaggagctggaggccctgcccaagatcctcaagaatggagatgctggtatagtgaatatgattaccaccaagccgatggttgcggagacccttgctacttaccct

SEQ ID NO: 65169 - DNA, 376 bp, Triticum aestivum
  Clone ID: PAT_TA_65169
tagatgaaccacgatccggaacgtgggaacaccagggttcagtattgaccattcgggctgacccatgaccatgatgagaaggagctcgtcagaacgggcaaggatggaccgtcgtgccatggacattttgttacagagtgctacacgaaagattaacggataaggccctgaacgcttgctggataaacaacagcaccgtgaatccatccagactgatgataaagaagaacagggagtgcatgtacaagaaggaaaataacatcttcatgcctctaggcctaaacttggcaccggcctatgatttacaacttcacgactgggaaaacactgaggttgacgaacataatcgccttgaatacaaatccttttcgccaac

SEQ ID NO: 65170 - DNA, 429 bp, Triticum aestivum
  Clone ID: PAT_TA_65170
tggatgcgtgggcggacgcgtggggttcgactcaacccctctgcgcctctctccgtcgcccctctgtgcggcagcggtggccgagcggagaccgcgatgcctctgccgcactacggcggcatcctctacgtcggcacccaagacggccgacgcccaggcctcgcgcgggaggcgctgctgcgaaggcacggcggccccggcggccggttccgaaggcccgcgagacggggaaaactctctggatcgaaaatgctttttctggttctggaatcatctgtcatcatttaatcgatctaggaacttgtggtcacgatttcttttctttagactactcgaaaaatctagagcctagatcgctctgacaccattgttaagaacatgggatcgactaggctaggatttcggagtagaatgaactatctatgaact

SEQ ID NO: 65171 - DNA, 269 bp, Triticum aestivum
  Clone ID: PAT_TA_65171
acacggattattctagtgagctgacagctgagatgaccaaggtttacgtcccagtgcgtgctctgtcatccatcgcttataggagcacgtacaggcaatgcaatgggcggtgtgctaccacgtcgagagtggaagctccgtggagaatccgaccaaaatagtgttggtttccatccgcctgtggtgtgctggcctagtagacaagaggaccgagcctatcgtcattacgagcagactcgcagccttgatggagaaaggggagcgctctg

SEQ ID NO: 65172 - DNA, 138 bp, Triticum aestivum
  Clone ID: PAT_TA_65172
tcatgtttgcggatccggagcgtgagtgcacgggggttaagttaaaagcgaaggtgctggtgcatgaaacagatgagatcgtgtaagttcaacctcaaaaaacaattcgactgccatggcatagatcctctgtgaaag

SEQ ID NO: 65173 - DNA, 402 bp, Triticum aestivum
  Clone ID: PAT_TA_65173
cacatttttagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtctacgagccccgaaatgtggcgctgcgcggatatgaaatccaccgtcgacggcacctgcggtggaccctgcaagaagtactgatcggttcatgccggcatatgatatgttccgcctaaaattaaataaaaagctcggacgagatgagcagcgtaatcgtgcctatgcgtgt

SEQ ID NO: 65174 - DNA, 329 bp, Triticum aestivum
  Clone ID: PAT_TA_65174
ggaagctatgtcgtcctcctaagaagtgggtaattctataggtcttctcttaattttcatataggttttgcagtagttgcaaataggctggaacttggaactggttatatacatgtatgtccatccagctggtgaacctcttatggaaaacttaattttattcctagttgaacttgttagttaaatgctgttcatatgactggctggttgtcaaattgtttgtgtatttcttgattccgttccttgtgattggtgaatgtatgaactggtgctctctaaaaaaaaaaaaaacatagaaaaaatttaaaaaaattaaaaatataaaaaca

SEQ ID NO: 65175 - DNA, 199 bp, Triticum aestivum
  Clone ID: PAT_TA_65175
tttattcatgtggaaatgtgatgtacagtgctcgggagcagcatatcgcggacagacgagctgtctacaccttgacattgctcaagtggaaactaaaaaaaattaactgatcaacagaatcacaacgtcttggctgaggaaaccatggcgaaacccaacttaattgccatgcacaacatcgctctttaacaaggtggcg

SEQ ID NO: 65176 - DNA, 244 bp, Triticum aestivum
  Clone ID: PAT_TA_65176
gcagctgcatgcgactttataggtcgtctatagcgacacctaaaatgaacacactggccgtagcataacaactgtcccgactggcaataccgtgacataacccaactaaagcaacttgaagtacatacgctttaccacagacttcgtaggactggagagggccgcaccgatcgtcatatgaaacgcgtgagcagactcaatggtgaatgggacgcgacctgttgccgttgattaagaaggtatg

SEQ ID NO: 65177 - DNA, 144 bp, Triticum aestivum
  Clone ID: PAT_TA_65177
gctgtatagaatgttagtctgctgctgatctagcggatcatgatttggaggagctttgtggtacaacccttgcagactcttacgttgctggagatttcgccaaattctgtaaaaaaaaaaaaaaaaccacaaacataacttaat

SEQ ID NO: 65178 - DNA, 267 bp, Triticum aestivum
  Clone ID: PAT_TA_65178
gtcgttcgaagggaatatttctcacttggttaatttgtgttcgtcaacgtcgctccaatggcgtctgaccgcctccgggacatcaaggccttcgaggacaccaaggccggcgtgaaaggactcgtcgatgcaggattgaccaccatcccggcaatcttccgccacctgccagacacgataccggtcgacgcgtcgcgcttggccatcccagtcatcgacctcgcccgcatcacgtcccatcgagccgagctggtggccgagctgaaa

SEQ ID NO: 65179 - DNA, 393 bp, Triticum aestivum
  Clone ID: PAT_TA_65179
ctttttcacttctcgtcagcttaactcttcgatctaaggaagacatatccatattaactctagaagcccagcaaaaccgaagtcaaatgcctcttgaaaaacttacgagtttgactctggaagggcccaacagcttgatcagaagctccggattgtcaagctcacaacttatggtttggaaatgctttccgttcgtgagaactttgacgattagcaaatgcagcaatcttgtccgctggccaacaaaggagctcgggtgcttggatggcctccgctatctatgtatccaaaattgtgaaaacctgggggggaacacttcatcgcctgaggaggaaacccttccactgtacctagaggtattaaagatttcagagtgccgcagcgtggtggcac

SEQ ID NO: 65180 - DNA, 426 bp, Triticum aestivum
  Clone ID: PAT_TA_65180
ccctcgcgtccgcccacgcgtccgcccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaataaaaaaggggggggcactattgaagggacaaatttattctcccggggcaggaaaaaaaaatggtttttaaaggggcaaaaaaaaaaaaataaatgggccgacattaaaaataagctagacgggaaaaaccgtggtacaacaaaattaatgggtataggaagaaaaatccctttttcaaaggggggaaaaaaaaaaaaaggttagaacgatggcgtattaaaaaaagaggcccaacctaaagggaaaaggg

SEQ ID NO: 65181 - DNA, 439 bp, Triticum aestivum
  Clone ID: PAT_TA_65181
cctatttgtctgctctcgtgtccggggcacctccagcggccgttcagcggggcgaagcgaccatgacgcttaagtgcaggaacgtaggtcgcatcaagcatggcctaggtcaaattaagtacatgcgttgttacaactgcgccactggctgaaccaaggacaaggctatcaagcgtttcttggagaagatcatcgtggagcaagctgctgtgatagatgagaaggacgctcgtgtccatgatggatatgtccttacaaagctgaacggccaagggcacccactgtgttcttgtgccatacatgctcacattgtgcgggttcggtccagtgagaacagtacgcaccgcaagcccctagagcgatataggtgcattgacgaccgtctctatgctctggacagggtggccctatccgtgctagtggccatagaggcccttgt

SEQ ID NO: 65182 - DNA, 219 bp, Triticum aestivum
  Clone ID: PAT_TA_65182
cccacgtgtccgcccacgcgtccgcccacgcgtccgagaccgtttgctgaggaccggcgcatcttggctccttgtgtgtgtgtgtgtgtgtgtagtccctcttgactgtcctgtatgctccagtcaagtgtgcgtgcccactcccctctctctgtcgcgccacatgccgttacagttgatacattctattctacagtaataatgatcgtgaatgatacg

SEQ ID NO: 65183 - DNA, 206 bp, Triticum aestivum
  Clone ID: PAT_TA_65183
tatcgtgcgacctaatagcaattcaatggccgcacctaaacaaaatccagagtgcgaaaacccacacgtaccgaccggaaaaaccttgcagcacaccaacttaatggcagtggacgacataccgatgaggccagctcccatcagtacctaacaggaccggaccaatcggaatggccaacggtacgccacccggaacggcgaatgaa

SEQ ID NO: 65184 - DNA, 405 bp, Triticum aestivum
  Clone ID: PAT_TA_65184
actcggagtaggcccgtgagccggcccgcgaggctagcaaggatcatttggcgaagcggatccccctggctcacctggaggaggcgatgcgcggacaagaggagcaggacaggctcatcaagggcaccagcgctgggggggggagcccacgacagatgcagaactgatcgacaacatgacctccaaggagggacagctgagcagtgacgggtgcctgtcgggtactaaagaagaactggcccttggagtgtgagaccttaaagaggtttttgattcattaggcctaaatatggtactgtttgtccctttactacgtagcaaccggaaaatctatgtagtatttaattgttttaatagtattatattttgtttttgaaattatttatatacgtcaaatgttctcat

SEQ ID NO: 65185 - DNA, 557 bp, Triticum aestivum
  Clone ID: PAT_TA_65185
atcattcttgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcct

SEQ ID NO: 65186 - DNA, 311 bp, Triticum aestivum
  Clone ID: PAT_TA_65186
tcggaccatatcaaagctgcggcggtgcgcgcataggaggcgaatcagctttggaaccaagccggcgacgccaccatgggtatctcgcgtgacttcatgcacaagcgccgggccaccggtgggaagcagaaggcttggaggaagaagcgaaagtctgagctcggtcgccagtcagccaacacttatctatcaagcaacataacagtgaggagggcccgcgttcgttgaggctacgtgaagtgctgggcctctccgtcttgacagtggaaacttcttatgggggagagaggctgttaccagtaagacccgtc

SEQ ID NO: 65187 - DNA, 375 bp, Triticum aestivum
  Clone ID: PAT_TA_65187
acgtcattaaatacacgaaaaaaaaaaaaaacaaaaaaaaaaaatcaccaaaaatgctgctggcaaacacaaaaaagaaaaaaaacaaaccaacgggcggccatctttgcgcttcccggctttcgttcctttgtttgcaacgcgggggcgcctctttagggggtcccccttttactcccctggccgtggccaccttaccctttttttggggctcccctggtctaacccagggcccgggctttgccaggcatacccttttaaacctcttgatttcccccattttatgccttgcccttcgcccccccttttaacagcttggattatatgaaaaatgggccgcccccttttctttccctttcagtgcacccccctttt

SEQ ID NO: 65188 - DNA, 317 bp, Triticum aestivum
  Clone ID: PAT_TA_65188
aaacgggcgagatccctgattatgcgccggaggagaccatcatgaatacttcaggaccgatgctgctggctgcctcccctgaggtgttctggtccgaacaaggtggagtcactgggcgcccttcggccccagttgcttctgtgagggggagtatcatgaaaaagatgcagtgatggcacttctgctctctgtgggaacacaagtaccccgcggtttcatggtcccagacacaatacgaacactggctctccgtgagacagatcagagaggggattcttgaacacacgaggcactattgtgactctgctctgaggtac

SEQ ID NO: 65189 - DNA, 292 bp, Triticum aestivum
  Clone ID: PAT_TA_65189
tccatgcgtccggctacgcagcacacaaccctgtggaccgccagcaatccatccatccaccgaaggctcagcaggatgtctccttggctggcggggggattatctgtccccgctcgtgtatggtcttccgtgtatcatggagttgagaaccatgaggactgcgttctgaggttggcggccatcaagcacaagaggatgcaccggtttatatcctacaggctgcaaaggattggctggggctatgggggacagactggtgagcgcgagggaacatcctaaggcgtgatcaaga

SEQ ID NO: 65190 - DNA, 245 bp, Triticum aestivum
  Clone ID: PAT_TA_65190
gtttctatatgcttctttgtatgttgtaaaatatgctagagatcacgagcaagcttggactaggttgtgggggtggtgtgtaaaatacaattgatttagtttgtattaggtggttgatttaggttttttttttagtttggtggctgatttagttgagccaacatctcatgtgtcaaatgttgaaagttacttcagttcagaatcactataaacctaactgcggctgaaactactccgatcagctc

SEQ ID NO: 65191 - DNA, 500 bp, Triticum aestivum
  Clone ID: PAT_TA_65191
cccactcgtccggtcggtggacagcttcggttccgggatggaaaccaacgacaccttcggcgtagatagtgcatcgccgtcgtcgaccaacgatgagatggacttctgggtcacactgttcatgcaggctagtgacatacagagtttgtcacagatttaaattttaatgagaagattgggctatgttcatatttctcgatagcattcgcggcggaccaggcgagcggcctggccgaacctggaccgggacgaacaaagaggcttttggccggaagtttctgtagttcgtcggctgagttgacccttgttgctggctcagtttcacttgcgcattggctggccatagcgagagaattttctccggccaggacgtgaaactgaagagacaaatgatggggcggaaaggttgacacgatcaaggactgaaagcctgataataccttttagcccgaggttcatattgtgaaaataccaaggagctaaatagaagaatttggccc

SEQ ID NO: 65192 - DNA, 412 bp, Triticum aestivum
  Clone ID: PAT_TA_65192
ctcactcgtccgcccacgcgtccgcaagtatgttttcttgtttctttctttcaaagtgcgtgtgttgcagcaactgtttacactttgatggtctcgcacctttgtggctccagccgccacatcagatgtataggtttcagatgaacattactccattattagtatcactctttaaaaatagagcatatactgatgctaaaaaaaaaaaaaactggaagaacaaaaaaaaaaaaaaaaactaaagggggaaaaaaagaaaaaggaagaagaaaacaaaaaggacaaaaatagacaaagggcggagaaaaacatatacactgaatggaaaaaaaaaaataataaagggggcggcccttttagagaaccaaacttttttccccggggttgggaagataaaagtttttttttaggg

SEQ ID NO: 65193 - DNA, 450 bp, Triticum aestivum
  Clone ID: PAT_TA_65193
cgtctttctgcaggagtacaacatcaccaagaagatcgagcacgccgtcaagtcgatgcagtacgactcggtctccatctccgcggtcgaccccgagttctactcggagcgcttcctcaagttcatccagaccgtcttccccgagaactcgtagcgcctcggcccaccaccatccctcaaccagtgaacgctccatttccctgccatggcatgatcctgtgtagagaacgaggaacgagggcgtccgcagagggtcttctggagggctggaatttttttttcaagcatgagcacaaaccatgtctttattctgggaataaaggtggcatggctgggttatggagcatggagaatccaccggtgtcccgctgtggaagagaggaagagcgtccgactttctgcgcgaatatgtgtgtccgtcgagatcaagagcgatgtgctgggcatctg

SEQ ID NO: 65194 - DNA, 496 bp, Triticum aestivum
  unsure (1)..(496): unsure at all n locations
  Clone ID: PAT_TA_65194
atttttaggcatagcgctgctcctcgtggtggcggaggcacgcggctgcacattctgcaaggacatgccgggcatctcatcccgcggcggtgctgtgcttcgggtggacaatggggtgacagaagggcaagaagcaagcgaaggagttgcgctacaggcagtgccggctgaggggcccaagaagaccacgctcatggctagctgctatcagcagtgcattgcttatatccactacccatatatttttgaatcttgcatgagtcagtgccacccaaccgctggaatcgtcggcgtcttgggggatgccaagaagacgntgcagacgaaacagcagtagcagcaagaggaggcaacaggaggaggatttggggtcctggcaatgccaactgagcatgccgggcgggaataagaagggaagcggaagaggacgcctgggcccggcaccatcttcatggccatctgacaacccaagatgggcgacccccgcgagtacatg

SEQ ID NO: 65195 - DNA, 501 bp, Triticum aestivum
  Clone ID: PAT_TA_65195
tgtgcacaccacaccactcctccactccactccactccccgccagcacttcacgtacctagccagccagcaatggcgatgcagccgggcggcgagggggagacgctgatgcagcggtgcaagccgtacgtggcgatgatctcgctgcagttcgggtacgccgggatgaacgtgatcaccaaggtgtcgctgaaccacggcatgagccactacgtgctggtggtgtaccgccacgccttcgccaccctctccatcgcgcccttcgcgctcttcctggagcgcggcaaggcccgcccgccgcggatgacccccctcgtcttcctcaacatcttcctcctcgccctcatgggccccgtcatcgaccagaacttctactacgccggcctcaagtacacctcgcccaccttctcctgcgccatgagcaacatgctccccgccatgaccttcgtcatggcggtcatcttccggatggagaaggtggaccttaagaggccaggtgcat

SEQ ID NO: 65196 - DNA, 348 bp, Triticum aestivum
  Clone ID: PAT_TA_65196
taataaacagaaaaaaaaaaaaaaagaagaaaaaaaaaattaaaaaaaaaaagatgatgcaagaagagaatacacatgaagagaaagagaccttacaactggcgaaatgcgtggcccttaaagagccattgatgctctgtggaggacttcatgaggggggggtcttttgaggggcccccttctttcgctgggggggcggccgatcttttgtttttttttttgggggccaccatttgaagaactggcgccccgtgttgcaggcctgatgcgggggtagctcccgcggggcctaattttggcgctggccggcgtctccctttgtcgtggctgggaaaaccctgggggggc

SEQ ID NO: 65197 - DNA, 298 bp, Triticum aestivum
  Clone ID: PAT_TA_65197
tttcacgcgatggctggctacgaggaagatgaggaagagagggagaacgatgacgtggtctcggattacgatgacgacaccggccgggcgaacctgaggcgctcgctgtcggggagctatgatctcgcatcgacctaagagccacacctgatgacatacatgagcttcgtgtgggacggtatggggtagggcttcgctcacccggagagctacctgtgggggcttgacgaggaggcacaattgtcgatcggcactatcgacatgtaggccgacatactaaaggtgaaaagggaacagc

SEQ ID NO: 65198 - DNA, 392 bp, Triticum aestivum
  Clone ID: PAT_TA_65198
tttacgcgtccgggcgtccctaccaccgccatgacagagatagagctccagtatgctgcaaccttctttgcaaaaatgctaccacccgtccatggcaaggtcttcgtggtgaccggctttgggtacaccctgggtctagatttggccacggcaacgttcgtgatactacagctaccagctggagtgcggtacaattacatgctctcatccgcggagggttccgggatctatcttgtcactgcggaccggtttcagctcagcgtgtggcttcatcggatgacaggtgacaaccatggtgcaggcggttggctcttggtggacacgttttctgttctcgaagcatgcacacgttttgcgggtgacagtttgggtgccttgtgaatattttaatg

SEQ ID NO: 65199 - DNA, 465 bp, Triticum aestivum
  Clone ID: PAT_TA_65199
tttcgcaaggagcttgggactgagtacttgactggggagaagacacgatctcctggcgaagaggtggacaaggtgttcatcgccatgaaccagggcaagcacatagacgcgttgctcgaatgcctcaaggagtggaatggtgagccgctacctatctgctgaacgacgtatgagaaattgaagagaagatagtgtgcttcagatttcaaagaatccggatgttcttagttgacaagtgataataatgcttttcattgtattctctagaaatgttatgttttgaaacttgctcttacagagctgttcttttgttgccaaaaatttcaactagattgtttaagtggtatataaccaatacaacttctatgatgtaaggtaacagcgtacaatatatggtaagtattcgtgataaatgtactggttccttttttgagatcaaatggtccggtggaggcacacggcatt

SEQ ID NO: 65200 - DNA, 304 bp, Triticum aestivum
  Clone ID: PAT_TA_65200
cgccggcccggaatttgcgggttttcccacgcgtatgtttagcaccagatcgcgagcggccgagcggggggattaaaaaaaacggccgcgagcatgccacgtcatagcataagaaacccgacacccaaactcaagccactggccgccgtcttacaacgctggagacagggaaagaccctggctaaacaaaatgtaatcgcctggcacaacattcctctttcgacagcaggtgaaaaaactaataggcccgaacggaccgcccattccaacacttgcgcagactgaaaggagaatgggacccaca

SEQ ID NO: 65201 - DNA, 312 bp, Triticum aestivum
  Clone ID: PAT_TA_65201
ttgctcacgcgtgcgcccacgcgttcgtccacgcgtccgcttacgcgttcgtggacgcgtgggatagaagagtttttatttgttgttgtatttaatatttatgtggatattgtatccttcagtgcaatttattgttttgtgagtagatgtatgtataatgatgaattgtttgtcttgttagtgtttcttggttttcaattattgtttgttgttattttttggtttataaagaagaatttgttttttttttttcagtgatgtaagagtaattttatgacacgaggcctaatttttgtactttagttgttttta

SEQ ID NO: 65202 - DNA, 298 bp, Triticum aestivum
  Clone ID: PAT_TA_65202
atatatgtgtcttgattccaagattcacttgtgctgattgtcagatagtgttggtagattattttgataactttaggccttcattttcttatcttccattgacacaagcacttttatcatgttagtaacgtctgtaaatagcatgattactgcctagctgctatgtgcctattttctctaaaaaaactgagacatgtttgagctgaaaaaaaaaaaaatcttaaaaacaaaaaaaaaaacaaaataaaaaataaaaaaaagcaaatgaaaaaaaaaaaaaaaaaaaaagaataaagaa

SEQ ID NO: 65203 - DNA, 302 bp, Triticum aestivum
  Clone ID: PAT_TA_65203
cctacgcgtccgtatcgatatatgtctatgctgaatgcggcatgcttcaacaaaaaaaaaaaaaaaaaaaaaaaaaaaaaaaaaaaaaaaaaaaaaaaaaaaaaaaaaaaagggaggacagagggggggacgcttgagagggtccgggtgaacgcaggggggaaggtaaagcaaggggttccctaaagggaaaccaaaggccagtggattggcggggggtgtcaggcgaggggatggggaaaacccgggggatacccaacgaaagcgccttgctgaaggggggccggtgggatagctggggg

SEQ ID NO: 65204 - DNA, 316 bp, Triticum aestivum
  Clone ID: PAT_TA_65204
gctccgttgcccacccacgcgtgtctttcacccggcgatccgactcgtgagagacgaggatataaacaatgctgccgatgttgttcactgaacctgataagtttttgatcgtgcaactgaaagtaacatggccgttcggagccaacgaatttctgaggaggagaccatgaggagagacccaactgtaatgcccgactacgatatctgggtgtacacaggtgccgtgatgacaaactgacggggaccaaagatgatttggcgcagctggcggcttagattgaagaggggcttgctgcctctaggcctaaacttggct

SEQ ID NO: 65205 - DNA, 211 bp, Triticum aestivum
  Clone ID: PAT_TA_65205
tgcggacgcacacggcgaaggcgttaacgcctctgcgcgtgaccccaaaaactgtgtttatcaccggggatacggcgcgcgagtgcaccatgatttagacagaaccgctgatgctgttgtgtgtccctgtggagagcgtgtgcgcacacatgtggtaatcatgggccttttgggccatagttgttctgtggaggagaccatgtcgaaagag

SEQ ID NO: 65206 - DNA, 230 bp, Triticum aestivum
  Clone ID: PAT_TA_65206
tttgttcagaagttactttctggcatcttatttagtgctgccgttaatatggtcactactatattattggctgggcatatttattagactaatacactaggcaatcattgctgtaggaccttaacctaatgtataatatcaggcgcgttatcttggcagatggttcagacacgtgtgttcatgtcgtggccaggctatataaacattgccttacgcatcgaaaacattac

SEQ ID NO: 65207 - DNA, 323 bp, Triticum aestivum
  unsure (1)..(323): unsure at all n locations
  Clone ID: PAT_TA_65207
cgcacgcacccggcggccgcgccgccgcagcagcggcaggacggggcgctgccgcggccgatggaggggctgcacgaggccgggccgccgccgttcctcaccaagacgtacgacctggtggaggacccggccacggaccangtcgtgtcctggggccgcgccggcaacaccttcgtcgtgtgggacccgcacgtcttcgccgaggccctgctcccgcgcctcttcaagcactccaacttctccagcttcgtccgccagctcaacacctatggattcagaaaggttgatcctgacagatgggagtttgcaaatgaaggtttcct

SEQ ID NO: 65208 - DNA, 349 bp, Triticum aestivum
  Clone ID: PAT_TA_65208
accagcaacaggtcagctgaagataggaggttgacacgcccatcgcacgacaaccggaggcgcgcacgcagtagctgtagctcttgctagggaaagaaggtagacgacgacggcttcttaggtgagctagatgtagtgactggtcatgtaaagtacattactactattacgaagaactagcaccactaagacacctaaaatgactcgatcgccatggtcgtctagctggattgttctagggaaaaaagaagttttggcctagagctgcaatattaaggtagaacaataatctattcaatatcttctgcgcggttaaaaaaaaaaaaaaaaaaaaaaaaaaaaaaaaaaa

SEQ ID NO: 65209 - DNA, 168 bp, Triticum aestivum
  Clone ID: PAT_TA_65209
ggcgcatcctgtcgcaccctccctgcggcgcgttcctgacccactgcgggtggagctcggtgctggagtcgatggcggagggggtgccgatggtggcgctgccgctgcacatcgaccagccgctgaacgccaacctcgcggtggaactgggcgcggcggccacgcgcg

SEQ ID NO: 65210 - DNA, 478 bp, Triticum aestivum
  Clone ID: PAT_TA_65210
catctggtgacgaacacctcctccttctcttctctatatgtgctcctccgtaaaggagatccggattctgtttctattagcagcagatatgttgatttgctgctacctgaaacatttgtcaatgacacaataatgtggcttatagcacagcatggcggtagtgtagaaaagatctaaacagattctgaattaacccaactagacatggaaaccaagaatgacctatcggctgggtccagttcctcatctttgtctctgagcaaaatgatcatctggtgacgaacacctcctcctcttctctatatgtgctcctccctaaaggagatccggattctgtttctattagcaacagatatgttgatttgctgctagctgaaacatttgtcagtgacacaataatgttgaatctttctttgctatctgcacaatcatcttttattttatagccttaattgttaaatggtgatgtccaattaca

SEQ ID NO: 65211 - DNA, 394 bp, Triticum aestivum
  Clone ID: PAT_TA_65211
gcgcttcacgccagaaatcgatgctgggttcttcccattacatggaacgtcaggttgagtttgctgggatgttgagcgatgatgaagatcagaatccagattttcacaactggaataaagtgaagataaggtattgcgatggggcatcattttctgggaacgtcaaagacgagtttcagagtggcacaaaattctttttccgaggccagcgtatctgggaagcagttatggatgaacttctactgaaggggctcagacatgctaaacaggcttttctaacaggatgctctgctggtgggttagccacttacattcactgtgatggttttcgggcactgctgccaaaagattctagggttaagtgtcttgcggatggtggttttttccttgatgt

SEQ ID NO: 65212 - DNA, 329 bp, Triticum aestivum
  unsure (1)..(329): unsure at all n locations
  Clone ID: PAT_TA_65212
ttaagctgggaacctatggttatgtggcgggctttacgagaaaagaaacaaagagcgaacatgagcgactctcagttacagctcttgagtgtctggcgtggtctgaggttgaaataaacactagcttcttttttaatgggtattcccgtggagctgttggtccagagggtttgcctgtgttactcaagcttaaagattggccacagcacagctcattcgaggatcgactgccacgacatcttgctgagttcatatctgccttgcnctttcgtgaatatacagatcataaatctggtcctcttaatctggcagtgaagcttccaaagaaa

SEQ ID NO: 65213 - DNA, 303 bp, Triticum aestivum
  unsure (1)..(303): unsure at all n locations
  Clone ID: PAT_TA_65213
ttgtccctcctcttcatcctctaccttcagcgcgagtactcacacgccctgctcttccccggcccgtcccgtcgaatccggtcgccgaagtgcacgaggaggcgctccagctcgtcatgctcgcgggcgagcncagccttagcgccgtctgaggcggacgcggaggcgcgggactcaccggcggcgacgccctgacccgcctggcctcacccgcggtgagacacgccgtctggcatccccgcgccctgctctgagtttgaaggcgtggagcaagatagcgggccacgggccaccgtggccgtg

SEQ ID NO: 65214 - DNA, 199 bp, Triticum aestivum
  Clone ID: PAT_TA_65214
tcgactgaactcttgcatgaaatggctaccgccgggaagtgatcatgcaaacggcggtggcgtgggagccgggaaccgctgtcgatggagagtggagtggcgccccgcagccatggagtgcgcgtcaagatcctctacccgccctctgcccaccgacgtctacttctgggaggccaagggccaaactccggttttccct

SEQ ID NO: 65215 - DNA, 309 bp, Triticum aestivum
  unsure (1)..(309): unsure at all n locations
  Clone ID: PAT_TA_65215
ctggaaatgatgggagcattactagtattgaagctctcaacgtccggattgacaaccaggtttgttgtaccagtctgtcatgggcacatgactctcttttatgtttaaacaacaccttactggtgcattcacatactatcatgtgtgatcatgcaagaagcacaaaaccttagctgtttaggacataactggcgaagatatcctgaatgtgtgatcatgattaaagcatcatctaccccatccatatgtactgtactcacaacanattgttgtctagctatactaatggacgtgtgcttatattgtagc

SEQ ID NO: 65216 - DNA, 452 bp, Triticum aestivum
  Clone ID: PAT_TA_65216
gttctgtacctaatactactggctactgtccgtcatgtttttttttatgtaggctactgtttgggatggttcctttcaaggaccaacatattactgagttggcttttatatcaagttgtatctcaaattatagattggtgttacgatctagatttagctgaatgtcttaactcgtcttttagaaatatcaggtggaaccttgcaaacttgatattttttttgttcttctgttggttaaaataaactagaccatacatttgttagcaccattgatgatttgagtatttctttaacccttgcatatcaaattcttgtttgagttattgttaataaggtacagactgtctagagattgcaaataactaagctcttttcgtcttgtaagagaagtagtgctcatatgggggggattttggatccaattatcgtttcatgaaaatatacactctgaa

SEQ ID NO: 65217 - DNA, 166 bp, Triticum aestivum
  Clone ID: PAT_TA_65217
tgcttgctactattgggctttagtttcttacatccattacgcaaaggatattatctggcacgtgccagtttgacaccaagatcctcgctgtcattgtggagccttgcatatttggcatgatttgtttctcatgttgccttcaaacaaatgttgatttttcttgtct

SEQ ID NO: 65218 - DNA, 512 bp, Triticum aestivum
  Clone ID: PAT_TA_65218
acccctcttataacagacaaaaaaaacttgcgtaatgtgatgaacccatttgttgcatgcagtgttcactgtctgtatttactggcaccctccatgcaggtagtagcaattagctgttgtataacggagcattatcatgcttctttttgtgtatataactatatatagatctccatttttaaccgtatcattttccagtcggcatttatttgccttccaggctcttctctctgaggagtgtgttgggctattggccaaaatttccaggttggaaaatgggaatcgtatacctgaatggctgaaagcaatggctggggtttatctcacaaaatttcaatgcaaattaactcctaatgtttttcaaaattttagaagcttgcgggcagtggagcactagaattttcatgcagcattacatattagtactatgcaagtatctacggagatcttggtgtcatccaagtttctttcattgtttcaggacttattagtgagatcagagaagacattcg

SEQ ID NO: 65219 - DNA, 149 bp, Triticum aestivum
  Clone ID: PAT_TA_65219
tccactactgctcatctgaatgagactaacattgtttctgttttctcttctgcagcaacccaagggcgggaatgggcggtccaaccagtcgggcctcctgctcaagcaccagcactgcgacaagaacaacagcagctggagctggctgg

SEQ ID NO: 65220 - DNA, 589 bp, Triticum aestivum
  unsure (1)..(589): unsure at all n locations
  Clone ID: PAT_TA_65220
accaaacccgtccgcggcgaccggtggggacattgattccgagggcgaggtatccggtgacggctgtcactggctgagaggaactggatgcagttgacaggttcccacttcttgaggagttcgcggatagccgggagcaaccagatcgggttcctctggtggtggtggcgaacaacggggcaacggttgatgtacctgcaggttccaatgctgattctggttgtgggcagcagattggatgcgagggcagcactcctgcgcttgctggcgttcgacgacgatcggattcatccccgacaaggcctgcacagtgaactgacagagtcaacccccaggtgccttgttggatgaaaagattaaggttggggagtatgccaccanaccggacaccgtgtccatcccgaattagtgctatggagcagttgattcgcaaatacgcagaggaaccaactaaaagtgtgataagacctgaatttggctttagccaatccggagctgtttgaaggcatgtttgagcatacaaaggcgtcactgaccctcgtgccgaattcggcacgaggcgaatccctcccttctctctctgtgaagc

SEQ ID NO: 65221 - DNA, 493 bp, Triticum aestivum
  Clone ID: PAT_TA_65221
cgcgccgccgccgcctcctccttccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgattgggcaacaaggatgtcactgcacaaattgtgtatgctaccattgctggtgatattgtgatggccgctgcctactcccatgagttgcctcgctatggtcttgaagttggcctcaccaactatgctgcagcctactgcactggtctgcttttggctcgtcgtgtgctcaagaaccgtgatcttgatgaggagtatgaaggcaatgttgaggccactggtgaggacttctctgttgagccttctgatgagaggaggcctttccgtgcgcttttggatgttg

SEQ ID NO: 65222 - DNA, 180 bp, Triticum aestivum
  Clone ID: PAT_TA_65222
attcgtgtttgggaagtataccctcttgggcctaccatacatcaattcatgaacgctttcactgaccatcgcgattctgagattctaattattagtcatttctcactcttactgggctgcgcacttcctaagtggatgtcatctggattcaatgatcgacccctagccccttttgctgga

SEQ ID NO: 65223 - DNA, 394 bp, Triticum aestivum
  Clone ID: PAT_TA_65223
ggctttgcatcgccaggatgggtatgccgctaccggggccgccgatgaacggcacgccgttcccgcaggacgcctacttcgagatcaccatcatatatctgaacacacggcgtccggagtggtcagcgtcccggacgagcaggcgtgggcacgacggctccggcgacagcgaacgcagcaagctcatcaactttgcaccgggcgcgcccgacccgatccaggaaaccagggccgcgaaagatgaccagggagacaagcagaggcacctggtcatgtcgctgggcctcgccgccgggcctgccgcaccggcacggccgtcgttagctggaacgtacgcgtcgtccatcggcttccactccaacggcgcggtctacctcgacgggatgaagctggc

SEQ ID NO: 65224 - DNA, 179 bp, Triticum aestivum
  Clone ID: PAT_TA_65224
ttctcgccaattacgggccgctagtgccgggggcgcgatcggcggtgagattcgtcgccgggcggaaatggttgccgtggcggccgatggcccgatccgcgccgatgccgtgccggcggcggctggggcgggcgcggagagggccgatgcggcgggcgcgggcggggcggcggcggcca

SEQ ID NO: 65225 - DNA, 416 bp, Triticum aestivum
  unsure (1)..(416): unsure at all n locations
  Clone ID: PAT_TA_65225
cttatccgtcagaaagggctataccatatcatgctattatgaattgcctgagatgtttatcccttatgatgcacccttcttgattgcgcggtagtcgcttttattagggtgatctctcacttaaaataccaagtagttagtgttctcccaagtgtagcaccgtcacggcgcgctgtctttttggggtgcgccgtgtcacacgggtacgaacgattanagaagtgtgaggcgggtgagttgagacctcgcagcgagatcacttggttgtcttgacgttcaggcatgaccgtcatgagctcggaacacacgcctcgaaagatgaacaagagtcacatagagatgtgattggcaagttggcctaccggttgagatttttcatcatcagtggtgttacaccaatggcgaacaattgaaat

SEQ ID NO: 65226 - DNA, 459 bp, Triticum aestivum
  Clone ID: PAT_TA_65226
tgctgattttggtctggctaggatatatcaagctccactaaaaccactaagtgacaatggggttgttgtaactatctggtatcgtgcacctgagctgttacttggagctaaacactacacaagtgctgttgacatgtgggcagttggttgcatttttgccgaattgcttacactgaaaccactgttccaaggggttgaagggggggctactccaaacccttttcaactcgatcaactagacaagatttttaaggtcttaggtcatcctacggtcgagaagtggcctacccttgcaaatcttccatgctggcaaaatgaccagcaacacattcaggggcataagtatgagaacacaggtcttcatactattgttcacttgccgcagaagggtcctgcatttgaccttctctcaagaatgctcgagtatgaccctcgaaagcgtattacagctgcacaagc

SEQ ID NO: 65227 - DNA, 167 bp, Triticum aestivum
  Clone ID: PAT_TA_65227
gcgaccctctcctggtgctccggccccgtagccacctcgtccctccccctttccacccgccgccgcgcctcctccgtctccttccccgcccccaaaaaggcggcattggccatggtggcctgcggatcgagtgcatccgtatcggtggtgttgagatcccaaaccac

SEQ ID NO: 65228 - DNA, 332 bp, Triticum aestivum
  unsure (1)..(332): unsure at all n locations
  Clone ID: PAT_TA_65228
ttccttcctcctcccctcccaaacggctgcgcgctaccccagtcgcctgctaaaaccttctccactgtccgcgcgcgagcgctcataaacaccaaaccggcccagcccaagagcacgcgcgccagccgggcttggggtgcagaaggattcgggaggaggaggaggcggcggcggcggcggcggcggattgaccagagatgccgggcgagatgaagtacgtgctggtcaccggtggtgttgtgagcggcctcggcaagggcgtcacggccagcancatcggcgtcgtcctcaaggcgtgcggtctccgcattacgtccatcaagatcgatcct

SEQ ID NO: 65229 - DNA, 361 bp, Triticum aestivum
  Clone ID: PAT_TA_65229
atactgtctgtctgaaacccaaaggaaagaaggcaaccaattctcgagacttgagatcgagcttgtccactataccacaacagtagccggcaatggcttcctctttgctccactgctccgacaagctcccgttcatggacgtggagaccatcctccacatgaaagaaggcctcgacgagagcagctacgcgcagaactcctcgctccagaagaggggcatggacacccttaagagcctcatcgtcaactcggcgacggacgtgtacatctcccagatgccggagaggttcacagtggccgacctcgggtgctcctcgggccccaacgcgctctgcctggtggaggacatcatcgggggcgt

SEQ ID NO: 65230 - DNA, 130 bp, Triticum aestivum
  Clone ID: PAT_TA_65230
gagcaaccacattggtggtgcgtcttgcaacttgtgtacacgttttatgttctttatccactctgtaacttacgaatttggtagttcgtccttttagaggataaggagagagtacattaatccggtttac

SEQ ID NO: 65231 - DNA, 250 bp, Triticum aestivum
  Clone ID: PAT_TA_65231
cttgtcatattatatataatttgtgatcaaagacaaacaaataatcagtatcaaataatcccgcactacaacctcgtaaaaggggaaaaaatgccttttggttactgccagttcgttacagaatgatttacatatcgggggggggggtgttgtcatctctacttccctaaaacaaccttctaaggaaacttcttcttgggcttcttgattttacatcttttattctcccagcctttaacaaagcttcctc

SEQ ID NO: 65232 - DNA, 191 bp, Triticum aestivum
  unsure (1)..(191): unsure at all n locations
  Clone ID: PAT_TA_65232
ggcagcctgccggacacctgtgcgactccccggcgatgagcatcatcaacatctccaacaacgccatctccggctcgatccctgacttcaacaactgcaagaggctggtatcgctgtccctgtccagcaacggcctcaccgggacgataccancctctctcggggacttgccggtgctgacctacatcgac

SEQ ID NO: 65233 - DNA, 545 bp, Triticum aestivum
  unsure (1)..(545): unsure at all n locations
  Clone ID: PAT_TA_65233
cttggggtgccaccaaaaacttgggtctcaacattgaggccctcaagatggagctgcttctcgtgaaggccaccctcaaacttgcagccagcaaacagatctgtggccaggccatggaggagctgctggggaagctgcgggactcggcgcactgtgccgaggacttgttggatgagttggactacttccgcgtggcgggacgagctccatggcacgtgtgacgccgccgaccaccatgccaagggtggtgtccacgactttgccttcaatgctcgtcacaccgccaaagctgttggtaaacgggtcanctgttgcgcttggccaagggccangcagaggtcaaatgtcaattcctccttaaacccaaaagccaatccggagaggtcgcatgtcanttcctcctcaaaaccaaaagccaatcaggaggtcagcggatgcattcccaagctcggtaaaatcctcccatgctcatcttccccaaatgtccgtggtgaacattctggtcaaccaactctaactctttgtgatgcgccccaacgagaaac

SEQ ID NO: 65234 - DNA, 332 bp, Triticum aestivum
  Clone ID: PAT_TA_65234
ctggttcggtatctgtgtctttactcctggcctctggagcaccgaagcagtgaagagtgggggatattgtcgtggtaggccacgtacctattaatagaccgctgtaaacgtagtgcatagtggacactgaaagcactattcggctttctaaagatagattgctataatggaggataggaggacaattctgatggaccgtggggggagcgggaggcaattagggcaagggaactttgccaaggtatattatggtcggaatctcgcaggtggacaggctgttgcgataaagatgatcgataaggagaaggtttcgaggattggcctaattgtgc

SEQ ID NO: 65235 - DNA, 204 bp, Triticum aestivum
  Clone ID: PAT_TA_65235
cgtcgtcgtcggggtcgaaccgggggatgggccggagagcgccgagcccccggccggtcgcctctctgtcctttcccgaggacgacgacgaggtggtccccgaggcgtggctggtcggaccggaggccagtgaccccgacttcgcctacgtggcagaagtcgtctgtttgtcggaccggatgaggagcccggatgacgtgtccc

SEQ ID NO: 65236 - DNA, 246 bp, Triticum aestivum
  Clone ID: PAT_TA_65236
ggcgtagcaagcgacgaaatgcttcggggagtactactttgtgtatttttctgtgtttgcacttgacaaaattcacttattctgcccaagattcggtatttcaggttgtgaacttgcagatcgtagcagtgcaacttgattctgcatgcggtgttcaacataattatttggctgtttgctttcactgtacttctgcgacctgtaatattgtggaaacagttttgaatatggctgtagcatgctctc

SEQ ID NO: 65237 - DNA, 156 bp, Triticum aestivum
  Clone ID: PAT_TA_65237
ctttcattttgttctgcgtatggtgcgccgcaactccatcagcatgatctctgtggacaatgagtagctgtcctcgctcgcaagtgtccaccccctgtggttgcattcctatactggatcatggcgaaactcgcagctgtcagtcgcagcgtgttt

SEQ ID NO: 65238 - DNA, 271 bp, Triticum aestivum
  unsure (1)..(271): unsure at all n locations
  Clone ID: PAT_TA_65238
atctggtgtgggatgatgaagcaatgtcaatggaggaaagaaggttggcgctgcccatgtaccaggtgcatgacgaaactagccaggtaagttctggctttttatgtttccattaccaatgatctctcaaaaatcattggagtgcgggggggggggagcaagttatacgagctttgaaagagagaagtncatgttgaaggtccatggaaatatgagatgttggcttgttgcatacttccaagtttttggaaacggatggagtatgtgagat

SEQ ID NO: 65239 - DNA, 208 bp, Triticum aestivum
  Clone ID: PAT_TA_65239
tacggcgggtacgggatggcgacgcccgggtacgcggcgccggtgccgtacggcatgtcgcaggtgaacatcgacggcaactacggcgggaggccgatgccgccgcagcccacggtgaagatctactgccgcgccaaccccaactacgccatgtccgtccgcaacggcaaggtggtgctggcgccggccaaccccaaggacgactacc

SEQ ID NO: 65240 - DNA, 343 bp, Triticum aestivum
  Clone ID: PAT_TA_65240
gcacacatgtgatatctttaatctctgttttccatcagctagcagaagcgcagtagccatcaggttgatcacctccaccatgacaaaaaggacaccttgtcccagcagggtcggcacactccgctccactgaaattacaggaccggacgccgtgtccggggagaatgggtgcactggagcaaacggttcgggtatatacagataagttgggtgagcatgctgctattgggctaacatcggactctgtgggagaaaccaaatatttttacaatctttattcacggaagcatggtttcggcctcaaatatgggaaaagtaggcttaacatcgagaagacaaagtg

SEQ ID NO: 65241 - DNA, 440 bp, Triticum aestivum
  Clone ID: PAT_TA_65241
gtccactataggtggtggttcggcatccacattacagcaagctgtcctcatgtaccttcacagctgtagcggtgccaacgagggtggaaggactacaggtggacataggagtaatgcatgccagctgacctcctcggatgcaattgcagcacctcctacatctgccagagatgttgcccatacagagcagccagagccagctcgagcacatgtgttggatgtccaaacaaactgccatcctggtccttctttccgtcgggatgatggagatggcggtgacggccaggggagagcaaaaggtttcgaaacaggaagtcatgttcggctgacgcagttccaacaagttgtcctggaatatctgtggaagtgcggcatcaaacacacggttagtaacagggggaagacactgaatccatcgcatatcgatggacacaaaactg

SEQ ID NO: 65242 - DNA, 376 bp, Triticum aestivum
  Clone ID: PAT_TA_65242
ttgttgctgcatgcttatgctactgattcaatgcttaggattgattgaattgaacctgctgtaatccttcctgttctacttgtatttaatttttgggtttctatttgattttttagtctgttatatacggttcatcttcagtttcttctgtaacttgcttggagcttagaatacacagcccaactagtctcatatgcaactaagaccaatgattcatgctgaattctgtatatatatgtatgtgttggattggagaaccactcgaggagggagggaggaagcacggaaggtcaccatggacctcgcccaactcccacccatcttcctgcctgcagctgtaggccaaataaaggatgttgttctcggtggagttgcg

SEQ ID NO: 65243 - DNA, 151 bp, Triticum aestivum
  Clone ID: PAT_TA_65243
ttggtgagggggatgttggctgagtgcgctcttgcagcgtgaatgttggctgagtcaactgattctaggtgcgggtgcgccctctccctgggcgccgcgtgcacatcgcgctgtctgcaggagcgtgcggcaggctgtggacgggtgcctc

SEQ ID NO: 65244 - DNA, 227 bp, Triticum aestivum
  Clone ID: PAT_TA_65244
aacacgatggccacttcatcattcctcctccctgtgctcctcctggtggccgtcgccggcgcggaggcggcgaccttcacggtgatcaacaagtgccagtacacggtgtgggcggcggcggtgccggccggcgggggcaggaagctggacgcggggcagacgtggagcatagacgtgccggcgggcacgacgagcgggcgggtgtgggcgcgcacggggtgcagctt

SEQ ID NO: 65245 - DNA, 252 bp, Triticum aestivum
  Clone ID: PAT_TA_65245
cgctccgcgggctggtgaagctgcaggcgctggtccgcggcaacatcctccggcggcaggcggccgagacgctccggtgcatgcaggcgctcgtcagcgtgcagtcccgcgcgcgcgccagccgcgcaacccgatcccgccaggccgcggcacacccgggcgcgacgacgccggagaagtacgagcaggcggcgtacgatggcgcgctcaggcacggccgttcaggctcactcaagggaggctcgtcaaaga

SEQ ID NO: 65246 - DNA, 309 bp, Triticum aestivum
  unsure (1)..(309): unsure at all n locations
  Clone ID: PAT_TA_65246
tgtattggctgttgctgattaccagtcatgtcctaactgactcaggcgaaggagaaacactgcttattcctgaagctttgcaggcgggattcaccaatgtagttgaagtagctcaacatcctgtagttacgttgtcatggtctataataaatttttcaaggcaatgtctanacccaggagtgagagggaggtacttcagtccccggctcatggaggcggtgatttggttcctggccagatgggttgcaacctatttagtaccacttgatgtgagtagagaaattgacagtgtgggtagacatggatccc

SEQ ID NO: 65247 - DNA, 178 bp, Triticum aestivum
  Clone ID: PAT_TA_65247
tggaaatactgcgggggcctgcctttggccatagtcaccatggctggccttgtggcttgcaacccaacaaaaaacaatgatcattggagtaaagtttgcaagtcattatttccggagcaggtggctccgcttacattggagggggtcacaaggatacttgattactgctataatgatt

SEQ ID NO: 65248 - DNA, 144 bp, Triticum aestivum
  Clone ID: PAT_TA_65248
cagcagctaaacacgctaagctacctcgctgcttaattactccacagtcgacaggctcccggcgacactgcgatcgttcgatggacgccgccgacgccgcctccccgtgtgatggccacaggacggtgtggtcggagccgccga

SEQ ID NO: 65249 - DNA, 141 bp, Triticum aestivum
  Clone ID: PAT_TA_65249
ctcgcacgtcctgcccgccctcatccgccgcttccacgaggccaaggccaccgatgcccccgaggtcgtcgtgtggggatctggctccccgctgcgtgaattcttgcatgtctatgaccttgccgacgcggtgatcttctt

SEQ ID NO: 65250 - DNA, 393 bp, Triticum aestivum
  unsure (1)..(393): unsure at all n locations
  Clone ID: PAT_TA_65250
gccgccgccagccatggccctctttgccgccgcccgccgcgcggtctcctcctcccttcccctcctccgcgcctccgcctcccgcggcgcggcctcccgtggcgcggcccttctccgcccccttgccgccgccgcggcccggccgatgcccttctcctcggcgaccgcgctgaagccgagctccgacgacgagctcctgcggggggggaaggccgaaatcaagttcnccgaggactgcgacgaccacgaccgggttgaggagatcccanatagcttccctttcaaaatcaccgacaacaaggggcttaatgacatcactcttacaagaacttaccagggtgagaagatcgaggttctggtttccatgcccaacctagtcactggagacgagcc

SEQ ID NO: 65251 - DNA, 315 bp, Triticum aestivum
  unsure (1)..(315): unsure at all n locations
  Clone ID: PAT_TA_65251
gcgagcagcagggacgcgtcgctggcggcgaggccccggagcatagcgtgccactcgtgcgaggtgcgacggcacggcgtattaggacgcggcgaggcggcgctcgggggctggaacagagggcggaggagacggcgaggtgagcgaggcgatggaggaggggtcngagaggggggggagcancggctcgaagtcatancggctgccggggccggcggcggagacggagaccgaggaggtgccgcagctaggtacggggaggcgctggcgctggtggctgtccgccgccgccagtcctctccggcctccttcggc

SEQ ID NO: 65252 - DNA, 453 bp, Triticum aestivum
  Clone ID: PAT_TA_65252
agccgagctctacctatgttgtaaaattactgatttgcgctatctgatccaaattactatccaaatactttatattttctattttattttgcctaggagatgatgaatatcagaggctgtttctgaggatgagcctagagctctccatatgttgcaaaataactgatttgcctatctgatccaaagcaccactagggggaggtgtttttttttggggctactggtgagaagctgtatgtaggctatgcttgctatcttggctgttttgtcaaaatttgttttaccttcatttgggaaatgatgattaattcttcagatatgtcctaaacgggcttttaaaagaatggtgacaaattgcacgtcagtctgatcccctatggttttaaactaattttttagtagtattcacttttatttgggaaatgatgattatttcatctcagatgtccttta

SEQ ID NO: 65253 - DNA, 159 bp, Triticum aestivum
  Clone ID: PAT_TA_65253
tgtagaagcgaccatgaagagtagcacgctcgtggcgatcctgattctccaggccgtcctggtcatgggaatcctctcacaggcgaacgccgagttcccgaaatgctgcgacaactgcaggttcttctcgggggccgtggtctgcgacgacgccggccc

SEQ ID NO: 65254 - DNA, 187 bp, Triticum aestivum
  Clone ID: PAT_TA_65254
ggcgcgttggtgcttgtggatgaggtgaaggggagatgccttgagccacatattgtgttgtacaatgtgtgtattgattgttttggaaaggctgggaatgtggacatggcctggaagttctttcatgagctgagagcccagggtctgcagccagatgatgtatcatacacaagcatgatctgggtgc

SEQ ID NO: 65255 - DNA, 192 bp, Triticum aestivum
  Clone ID: PAT_TA_65255
cactgctctctcctctccaacttcaatcatccaagctcgcaagctacgacgggaggctctcacctgtgcggatctggatagcaaaaccgggaagcaatcaatggagcaactagccaagtgcaggggcatcccagcttgggcggcggcgtacgccagcgatccatcctcgtcctcatgggaggagcgggcctt

SEQ ID NO: 65256 - DNA, 369 bp, Triticum aestivum
  Clone ID: PAT_TA_65256
tggaactactctcatgaaagcacatcatttcataaaagcatcccagattgtggacaatccttcaggtgacttcgccagaaagtaccgtcacatctctaaaggaggatgggccttccaggttgcagaccagggctggcaggtttcagattgcacagcagaagctctcaaggctctgttactgctctcgaagtttccgtcagatatcgtgggtgatcagatggaaacatgccgcttccatgatgcggtgaacgtattactatctttacagaatcctaatggtggctatggaacttgggagctagctcgtacatatccatggatggagaatttaaacatgacagagatatatgcggacatcatggtggagca

SEQ ID NO: 65257 - DNA, 636 bp, Triticum aestivum
  Clone ID: PAT_TA_65257
tgacaagcctgcagacgttacaagcattagaagcacaaaatgagtctattaaacatttaggggagctgaggcaactaagaagcttgaggttattgaatgtgaagggaatctactgtggacggatcaatgagtcactagttgagatgcagtatttgtcatacctacatgtgagtgcaagtgatgagaacgaggttctcctgttgaatgtctccttgccaaacctaaaaaagttaagtttgagaggccgactagcggaaggggcattggacgagtcccctctcttccaagctgttggggggcataacttgcatatgttgtctctccgttggtcacaactgagtaaagaccccctgccaccgctttctcggttgtcaaacttgacggatcttcaattcagcagagcatacaatggagagcagctgacgtttcttacagggtggtttcccaagctaaaggttctcgaactaagagacttgcctaatctgaatcggctagatatacagcaaggtgccatggtgagcctgaagcaattaaccttagtcaacctcaaaagcatgacggaggtcccagctggcatcgagttcctcttgcccctccaatatctaagcttcctggaaatcaccaatgacttcttga

SEQ ID NO: 65258 - DNA, 497 bp, Triticum aestivum
  unsure (1)..(497): unsure at all n locations
  Clone ID: PAT_TA_65258
ctcactgactcgcagcagccccgccaccagcgaatggccgcgtcggcgctgcaccagacgaccagcttcctcggcaccgccccgcggcgcgatgacctcgtccgcagcgtcggcgactttggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccanatcttctccgagggcggcctcgactacctgggcaaccccaacctggtgcacgcgcagagcat

SEQ ID NO: 65259 - DNA, 272 bp, Triticum aestivum
  Clone ID: PAT_TA_65259
cctcctcgctttgccatcgccggagggcttgccggtgaagctgtgccgagccccaggatggcggcggcggcacagatccgttcatcccgttttgcccctccccctccactctgagatccactccggtgcggcttgggatgatcctctctgacgactgcttcccgccccgctagtccggttgttcatcggcgctggcatggcccctgctccggccacttcgtctgccatcctctggtcggccagttccccttcaactccgggtcaccgtccct

SEQ ID NO: 65260 - DNA, 375 bp, Triticum aestivum
  Clone ID: PAT_TA_65260
tgctgctggaggaagcggtccgccggcactcgtgtctcctaaccagcgtttcttcccccggcgcccaaggtgaatccacgacctaggacatggtgccgtgctgttcttcctccccttcgattgttccatggccaccagcagcaacaggaggaaagtcaagccccgacgttgaccagattcgtgcccctgtatttagttgatctggtttgttcttctggatgtatagctttctttcacagcttggttgaagagcacattcggtgtgcctgccatgactgcttgttctgcttgttgtttccttcgattgttgtcatggccctcggtccttcggttgctccgatctacaaagttgctgctggtttttgggttcttggc

SEQ ID NO: 65261 - DNA, 334 bp, Triticum aestivum
  Clone ID: PAT_TA_65261
ctctcaacctcgacgcctcctacgacctttgctccaacgacttcgggcgcttctccctcgtctccaggatcctctgcgatcaccctggcccggcccgccgcttcgctttcgaccgcatccacctccacagagaggaaaaaagtacgccgaggaagccgctcagctcgagagctggttcaactccccgctcctggacaacctccaggaactcgatatcgtcttctcgctcttggaatattcgtgtgggcagtctgagaaggagaagcgctatccgctgccaccgtcggtgttgcgcttagcaccaaccctccaattggccaggattggctcctgt

SEQ ID NO: 65262 - DNA, 256 bp, Triticum aestivum
  Clone ID: PAT_TA_65262
catcgctgacgcacctcccacctcggcgacgccgcggccccagccgcgcgcgcctcctatccagcaacagccccgcgctctccgtccccgcccgccgcgcagaccgccagcagcccaccaccagtccaattcgagaaggactaggtcgtctccgagcacaacaccgcagcccgcgggactccggatcgccgacgaaatcccgatcgatcccgcagcatgtgcgtttccaaatagagccagggggggatacttgact

SEQ ID NO: 65263 - DNA, 155 bp, Triticum aestivum
  Clone ID: PAT_TA_65263
gaactatcaaatagttcatctctttatatcctgtcaccatgcagcaggggcacaatttgcctctcggcattgctgttcttgtgctaatcctagcatccatctccccggcttcttcgcagaaccagcaagccaccttcaacatcggtggcggtggc

SEQ ID NO: 65264 - DNA, 282 bp, Triticum aestivum
  Clone ID: PAT_TA_65264
ccttgttttgtcacactcatctgccaacacaaatcgtttggctctccggcagggtgatcacggcgccgccgccaaaccccagcgtcacctatgggaaaagattcgcccatgccttggtctcgccggccacgtcgtagcacagatccactagcttctccggcgactgcttccgcgggagcttgatgctccgggcgacctccgccacgacctggtccagcagccccttgtcgaggtacatcagcaccgggacggagtcgccgatgacaggggaccgcttccgtg

SEQ ID NO: 65265 - DNA, 353 bp, Triticum aestivum
  Clone ID: PAT_TA_65265
cggcggtcggctatgccttctaaaagggggctccccctcttacagacaaggtgctcctgccgatcatgcgatgggaggcgacatctttcgggcgcccggtgctggcccttgtgctggtcatgtccatgtccgtcttccctaccgtgttcctgccttctttcccgtccatgtggttgacagggataatattcggctacggcctgggcctcttgatcatcctggttggcaccggcataggcatgtccataccgtactggatcggctcgctgttcctccatcacattcatggatggttagagaagaaatggcctcagcagatggctctgatcaaactggctgggagagggggctgg

SEQ ID NO: 65266 - DNA, 268 bp, Triticum aestivum
  Clone ID: PAT_TA_65266
taatcgccgtcaactcggtcttcgagatgcaccggctgctcgcgcagcccggcgccctggagaaggtcctgggcaccgtgcgcgccgtgcggccgaggatcgtcaccgtggtggagcaggaggcgaaccacaactccggcacattcctggaccgcttcaccgagtccctgcactactactccaccatgttcgattctctggagggcggcagctccggcggcccatccgaagtctcatctggggcggctgctgctcctgccgccgccgg

SEQ ID NO: 65267 - DNA, 433 bp, Triticum aestivum
  Clone ID: PAT_TA_65267
ccttcgccgcgcgcgttccgcctcacccgcgacatggtgcgcgcccgcgcccgcgacggggtcatcgtcgtcacctttggcaactacgccttcatggactttatcctcacctgggtgcgccacctcacaggcctcggggtagacaatctccttgtcggcgccatggacaccaagttactccggcaactctacctcacgggcgtgcccgtcttcgacatgggcagcaggatggtcacggaggatgttggctgggggtcccccaccttccacaagatgggcagggagaaggtgctgctcatcaacgagctcctgcccttcgggtacgaactgctcatgtgcgacacggacatggtgtggctcaagaacccgttgccatatctcgcccgctaccccattgcggatctcctcacctccagcgaccaggtcataccca

SEQ ID NO: 65268 - DNA, 371 bp, Triticum aestivum
  unsure (1)..(371): unsure at all n locations
  Clone ID: PAT_TA_65268
gcctctctctcgcgcttccgagctttgtccttcgtcctcctcccccgacctctccagcagcgtagcgtagcgcccgcttccgccgttccgacccgccgccatgagggagtgcatctcgatccacatcggccaggctggtatccaggtcgggaacgcgtgctgggagctctactgcctcgagcatggcattcagcctgatggacagatgcccggtgacaagactgttgggggaggtgatgatgctttcaacaccttcttcantgagactggtgctgggaagcatgtcccccgtgctgtctttgttgatcttgagcccactgtgattgatgaggtgaggactggcacttatcgccagctcttccaccctgagc

SEQ ID NO: 65269 - DNA, 360 bp, Triticum aestivum
  unsure (1)..(360): unsure at all n locations
  Clone ID: PAT_TA_65269
attgcctctgcggagcgtggatcgatcgatgggcgcgtcggggaagtggatcaagacgctggtcgggctcaagacggcggcggcggagaaggagaggcacgccggggggaagggccggaagtggagccgcctctggcggagctcgtcgggcgggcagaggggcgccgcgtcngcggccgcctcngaggtctccgagacgtcctccgccgccgccgacgcgctcagctccgtcgtcgcggccgtggtgcgcgcgccgcccagggacttccgcgtcatcaggcaggagtgggcggccgtccgcatccagaccgccttccgcggcttcctggccaggagggcgctgagggcgctgcggggcat

SEQ ID NO: 65270 - DNA, 381 bp, Triticum aestivum
  Clone ID: PAT_TA_65270
ctcatatggaccaaatcactctgctatgtctgggtgggttcgtggaagagacccaacaaggctcatccattatgaaggaggtggctccagaacatcatccacagatattatatgccccatgtacatgcgtgtctgggatattctcaagattgcaaatgacccatctgaaaacaggcccctcattctttgcgaatattcacatgctatggggaacagtaatggaaatattgacgcatattggaaggcgatagacaacacgatggggctccaaggaggttttatatgggactgggtcgatcagggtttactgaaggaggatgccgatggatctaaatcttgggcatatggtggtgactttggagacattccaaatgacttaaa

SEQ ID NO: 65271 - DNA, 449 bp, Triticum aestivum
  unsure (1)..(449): unsure at all n locations
  Clone ID: PAT_TA_65271
ctagccacaccacgccgtcgccctgcccaccatgctccggccgagctcgtgctcgagctcggggtagtctctctgaccgcgtccagcctctccagctaccgtgggagggttcgccgagtacctcttcgtctcctaccacgacgcacgcaacgccacggcccctggattgacctcatcgtcccatcttcttcctcttcttcacggacatcaagtcttccagagttcttcgtctcccgccgtcgatctaccgcatccccggccgtatattcttgccataggtatactagatacaatcggccattaatgacagacgattgaattttgctgagatgcaagttgataaacaacccttcccgataaacaccatggacttggagggaaagaaaatgttgattcggcctancatagccgaatttgctaataaagataatgttgttattggtgaaccc

SEQ ID NO: 65272 - DNA, 276 bp, Triticum aestivum
  Clone ID: PAT_TA_65272
cctcgcgctcgtgccgcggccgtcctggcgctcgcgcttctgccgacgctggccgccgccggcatcgatttccgccgcgaggccccgccgcccggtcacacgtgcggcgcgcagggcacgtacgctcccggcagcgcctacgaggccaacctgcggcgtctcggcgccacccttccctcccaggcaaacgcgtcctcctgcaagtgctctcccggcaacaacgccggcgagcgtcccgatagggtcatcgcgtcggcctactgctactggctcccc

SEQ ID NO: 65273 - DNA, 477 bp, Triticum aestivum
  Clone ID: PAT_TA_65273
gcccacttatcacatggagcgaatggtatctgaatcttgaggaaatggtcagaaagtacagtggaaagagacctgacgtcattgtagttgcttcagagaacactacagtaggtttctcagaagaggtaataaataggcatatgagtcttgtagactatgagaaaacacggccagagaacccagagcgtgaggctgaagagagcatccctgaggtcatgagaacaacacctgacgatgcaacgactagctccaatggtgaatcattcttctctcctgatttacatcagcctaaaacattggatcatttttgggagtcgttcaagtcccctacagcagtaaaaattgcaagaattgtcaatgcttcagctcaagggaacaaaccaaagctcggcaagatcagcataattgataaggattccagcacgtcagctcctgctccagccaaatcttcaagaaagaacaagtgggaagcccgag

SEQ ID NO: 65274 - DNA, 152 bp, Triticum aestivum
  Clone ID: PAT_TA_65274
cggcacggggccgtgtctacagctgtccacctatcgatttgttaagtccggctgtggatgctctaaaccatggtcccagccgggtaacacaaagtcttgcttcagtctgtgtctagtcctaggtggtcagaatttcgccagttctattgttg

SEQ ID NO: 65275 - DNA, 432 bp, Triticum aestivum
  Clone ID: PAT_TA_65275
aaaaccctcctctcatgcggcgctgcccccatctctcgctccgccgccaccgctgctgcctccctcccgctcagccacctccaccgctcccacccttctccccattgttggatccgcttgcatatcgtcaaggttaggcggcgaagctccacgtccgcgatgcgcacatgctcatcaaggaagcggctcccagatctgaggtcgcggggccgtgacggaaggagctcgaggtggccgctgaagaccaagcccccaccatgtggcgtcgagaacggccggcggcatggtaggatggaggagaacggcctggagttcgtgctcgatctggtggtcaggtaagctctttttgtccgccgcccctctgttgatttttgcaaacctttcgttgtactccggcgcccgcaggttcccacttcgggaagagttcgccga

SEQ ID NO: 65276 - DNA, 415 bp, Triticum aestivum
  Clone ID: PAT_TA_65276
agtcacgtcaggctcggtgggacacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgc

SEQ ID NO: 65277 - DNA, 338 bp, Triticum aestivum
  Clone ID: PAT_TA_65277
tggcgcccaacagctccctaccgtcctcctcgccgtctgctccaccctcctgggcctggccgcgccattgctcgccggcgaccccgacatgctccaggatttctgcgtcgccgactacaaatccctcgatggcccgctgcgtctgaacgggttcccgtgcaagaggccggagaacgtgacggcggacgacttcttctccgccgcgctggcattcccgggaaacaccggcaacccagtcggctcagccgtgacggcggcgaacgtggagaagctcccggggctgaacacgttcggggtctccatgtcccgcgtggactacgcgccgtggggcgtgaacc

SEQ ID NO: 65278 - DNA, 332 bp, Triticum aestivum
  Clone ID: PAT_TA_65278
cccgccatcgataatcccttagatcccagtatcccgcgggctgccctctcgctgcggcccgtagcactgctgcctttgagagaaacccacctgtgttttagaggggatccattactctggaatcacagatcggtggcaccggaggacatgccagggttgcatttcaggtggtgggcagcaagggcaaatcaaatcgaggaagtgtcacatcgattggagagaagttccaaggagctgtgcctggcgcagcacaaggcagaggcgcaagttgatctcagtggagagatgctgagggatgtcagcagctagcaatgtcgcattgatttcgagct

SEQ ID NO: 65279 - DNA, 387 bp, Triticum aestivum
  Clone ID: PAT_TA_65279
ggcggcaaatcgctccgtcaggtgtacgacgtggtgctctacatagggatcatcgacatcctgcaggagtacagcatgaggaagaaagtggagcacgcctacaagtccatcaaatacaacccccagtcgatatcggtcgtggagccccgcttctactcggagcgcttcctcagcggggggcgcaccgtcttcccagaaaactcacccaaccaataaattcattcatctttccttccttccttccttgtccccagcaagaaaaaatgcaacagaaagatccaaggaaatgtgctctgcttgctacattgctgtccatgtgtgtggtttgagatggttggaagcaaaagcaatgtgtgtattttgtcaaaaagcagcattgacaaaact

SEQ ID NO: 65280 - DNA, 381 bp, Triticum aestivum
  Clone ID: PAT_TA_65280
atacagtgaccgtctcagaagatcaagaacttgaaggagcttggggggccttgaagaatcaacgcgtgaattcacagcaggtatggagatgctggcgggcgtgcaagatggcctgaacatagagcaagagtatatcaacgcgatgcgcacgcagtctaacgtgcgcttcttatcaaacaaggaagagatggaagcccttcttcagcctcagcaagatctcatccttccgatgcttcacaaaatggggcagaaaaaatctgctgaaatcaagctcgcaatgtccggttactttgatgccagtgctgaggcctcggagatctgcaagcagctactgaggaatatcaagaacaccgaaagcaactaccaatcaatggacagctt

SEQ ID NO: 65281 - DNA, 321 bp, Triticum aestivum
  unsure (1)..(321): unsure at all n locations
  Clone ID: PAT_TA_65281
tcctgaaacaacaaaatgtccaaaagcaagcatcacagtttatgaacccgacatgggtgtctattttacttctgatatgacgagttcttgcgaggggccatattcttccgcaacagagtcactacagaggagcaaatcatcttgcaaatatagtgggcgaggaaatgcgatttatatgaagcctccttatccaccaggtaaggtggtttcatcacaaaaaacacaggaggtgttggcctcatatcaatacaatgtccatcaaaagaacacttcctgcanaaatgagcaaagatctgcaaaatcaagtgtttcaacgaacaa

SEQ ID NO: 65282 - DNA, 256 bp, Triticum aestivum
  Clone ID: PAT_TA_65282
ggctcggcagttctccccagagcgctcggtggccggcggctgcttcaccgcaagccggaggcagtgacgggcgggcgggcggccaggcggtgacgaaggatccagtcggcaggccggaggtactgacgggagaagcggcaaggcgacgactgacaagtccacgatgccatctccaactcctagtacgcgtacagggtatggtggacgaccagttccggcagctgcagtcgctgcaggaggatggcggcagcacgtc

SEQ ID NO: 65283 - DNA, 389 bp, Triticum aestivum
  Clone ID: PAT_TA_65283
ggtgcatcacttaagtggttgcagtctatttcctcacctccccctctcctgaagaagctgaatttgcgtggtgatcttggggagatgcctgactggtttggggatctggaacatttggtgaagattgatttaatgttgaacaatttgaaagatggagataaaagcatgaaactactaggcgcactgcccaagctcatgctccttcgtctttcttgggattcttatgtcgaggagaaactagttttcagagcagaaacattcacaaatctgaagagacttaatatttcatacatggagaaattgacagagttggtatttgaggagggcacctcgctcctgttggaaaagatagaaatcagagggtgcagtttgccatcggggattagtgg

SEQ ID NO: 65284 - DNA, 376 bp, Triticum aestivum
  Clone ID: PAT_TA_65284
ccatcaagtccaagcgcgcccagctgttcttgcatatagatacaccgaagtgagtaacaggctaacagcatcgtccgtctacgtacatggctttcgcgctcaaggcatccctctcgccgtcttcctcgcctccgtcgagcctcacagcggccacagtggccacaccgccggtaaagcctgtattcgtcagagccccgctcaaggcatccctctcgccgtcttcctcgcctccgtcgaccctcacagcggccacaatggccacaccgccggtaaagcctgtattcgtcagagccctcgccgcggcctcagtcgacccggcaatggccacgccagccgcgccggggaggcatgcggtcagggcgcgcgcaaccgcgct

SEQ ID NO: 65285 - DNA, 239 bp, Triticum aestivum
  Clone ID: PAT_TA_65285
cgtgctgctccccgggtgcgtgccgttacacggcgccgatctcctcgagcccctccagaaccgctccgaccccgtgtaccggctcatgatcgagctcgggcggaactacctcctcgcggaaggcttcatcatcaacaccatggacgcgttggagcacgagacgctgctggcgttcaaagagctttctgacaagggcgtctacccgccagcgtatgctgtgggtccattcacccggcggc

SEQ ID NO: 65286 - DNA, 199 bp, Triticum aestivum
  Clone ID: PAT_TA_65286
tcaggtggaccaggatctgcgggctttgttctattcgtcggtcacccttgccttggcactagccgtgcaatggaagaggagtgtggttagggtttggttgtgctttcaagatccgttgatgtcgtacatgctgtggaactttgtcttgtttgttgtctgttgccgttgttggggtctgctcttctctggactacggttc

SEQ ID NO: 65287 - DNA, 500 bp, Triticum aestivum
  Clone ID: PAT_TA_65287
tgcggttccaacacgttccacctagtggaccttttcccatcatctctgttggtacggctgctgagcggtgccacgagtcatctccggtcgtgccactcccggatccagagaatcctgggagacatcctagttgagcggaaggagaaggaagctgcctctgacagcgccggcaggagagatgacgaggacctgctagacgtgctccttaggctgcagaaagaagacaccctcaatttccctttaacatctgagatcatcggcgcagtcatcttcgatatatttgcagctgcaaccgacacctccgctaccacgctagaatgggccatgtcagaattaatccgcaacccagaggtgatgactaggacgaaactcgaagttcgacagatcagtctagcaccagggcaatccatgataacgagcgcagacctcggcaatctccactacctccgaagggtgatcaaggaaacactaaggctacacccacccgcggcggtgatacg

SEQ ID NO: 65288 - DNA, 514 bp, Triticum aestivum
  Clone ID: PAT_TA_65288
gcacaacaaatcttttctttcgagagcactcaaagcacgtgccttacttttatagaagagagcaaaacaatttacaagaggtctagcgagtgcggaacactccaagactaacacccaccaccactcctacaaggaacccaaaactaatctctcacaaagcgttagacatcatgccgtgcaaatgaccagggtgtcgaacccacgtttgtcttccttcgcaaagcacaacaaatcttgaagcatgtgctgtcaagagaggaggaagtgaagaaaaagattattgtttagaaaaccatttatgacgatcctacggtttggttttactcgagagatggtaactgctctatacctaatttgtggagtaatcaactacatttttttgtactccccatttcattatatgaatctgtgtcctacatatgcatattatgaattatcggacttctaaattaacagaatttcatcttgaattcctcaatggggcatcattttggactacacttaactaagacca

SEQ ID NO: 65289 - DNA, 393 bp, Triticum aestivum
  Clone ID: PAT_TA_65289
ccccgcccccccgaaaactttcccgctcgaaccccccaaaccctagccggatctcccgccggcgacgcccccggcggccggcgagatgcacatcaaggaggtctgcctggagggcttcaagtcgtacgcggggcggacggtggtgccggggttcgacccgctgttcaacgccatcaccgggctcaacggctccggcaagtccaacatcctcgactccatctgcttcgtgctcggcatcaccgacctccgcgccgtgcgcgccgcctcgctccaggagctcgtctacaagcagggccaggccggcgtcaccaaggccaccgtctccatcgtcttcgacaactccgaccgcgcccgctccccgctcggctacgaggactcggccgagatcaccgt

SEQ ID NO: 65290 - DNA, 486 bp, Triticum aestivum
  Clone ID: PAT_TA_65290
tcgaaaagtcgaagtaccaggaacactgaacatattcttgaatgaaaaacttaacgtcgctgccagtgaaagttctttcaagatcattgaagctgttctccatagaaccgactctactaaggacaaggattctctggactgcagatctttttcccaacacatggcatttaacatcatcggtgcagctctttttggtgatgtcttgtttgattggtctgatgctgcagcatatgaggagcttctgatggttgttgcaaaggacggctgcttctgggcttcgtatgcggttcccccattttggaaacctggttataggaggtaccggaccctatgcgctaagctgaagatcttaacagaaagcatcatcagaaaatccatagaccaaaatggtgcacttagacataacaatctgagctcctctaagataagtgaaggggtggtaaaagatccagttagatgtacttctctgctagatgggatgatatc

SEQ ID NO: 65291 - DNA, 336 bp, Triticum aestivum
  unsure (1)..(336): unsure at all n locations
  Clone ID: PAT_TA_65291
ccagcggctgggcctctctcccgaccgacatcgcaggcctcgtctccgggcgattgctgggcgaggacgtggtggactacctcaccttccgcgccgtctgctcgggctggcgcgccagcacgtccgacctgggcatcctcgccctgagcaaaccgcagctccgcccgcgcggctggatcgcgctctgcgacggagacggggcgcccctggacggtgccggcgagatcaccttgttcaacacgcgcacggcgcggcgcctgcgcgtccgcctccccgacctccggtgcnccagggtcgtcggcttcaccgacggcctcggcatcctgctgcgcaagc

SEQ ID NO: 65292 - DNA, 356 bp, Triticum aestivum
  Clone ID: PAT_TA_65292
tttttttttttttttttttttttttttttttttcaaacaacagtcttttgcattcaaccttcgtactttacatcatgcatgggggtagtacaaacaaaacccagctgcatgcatgcatgcccacacttgatcgcgtacgtacccacgtgcacgggcggtttccaaacacaacacctaacagcttacttgccgggcacaaagttgggggcaaaggcccaggcgttgttgttgacggggtcggaaaggtggtcggcaaggttctcaagggggcccttgccggtgacaatggcctgcacaaaaaacccgaacatggaaaacatggcgaggcggccgttcttgatctccttcaccttgag

SEQ ID NO: 65293 - DNA, 227 bp, Triticum aestivum
  Clone ID: PAT_TA_65293
cgctagggttctaccgcggtgccgccgcatcgtcgcccgcgaccgtccccgccgctagagatggacgccgcggcggcggtcgcggcgaaggtatgcgtcctcgaggccgagctcgccgccacgtccccccgcattgccgacctggaggcccgggtctcgctcctcgaagcagagaacgcgcgctggtggaaggccatgccccgtggggaggtctctggtccattggt

SEQ ID NO: 65294 - DNA, 378 bp, Triticum aestivum
  Clone ID: PAT_TA_65294
cgccgccgcctggccacctccgccgccgccgccgcctcgtcacctccccccgaccaacctctcgcgaacaagcggtccgcgtggtggtcaagggccgggtccagggcgtgggcttccgcgactggacggccgagacggcggagtccctcggcctcgccggctgggtccgcaacaaccgccgcgacggcaccgtggaggccctcctctccggagaccctgccaaggtcgacgagatggtcacccgccgcctccccgtcggccctcctgccgccgcggtcaccgccgtcgtcacatccccagccgaccacatccacccctccctcggcttcgaaatcaagctcaccgtctgattgggtaaccctgggcgtccgatcgacc

SEQ ID NO: 65295 - DNA, 462 bp, Triticum aestivum
  Clone ID: PAT_TA_65295
tacagcaagtggtcagaaggcgacaacggcggcagaaccttctcttggtacagagcagaagaaaacctcctcaataaaatggagttgcaatacctgccaggcaactggctcgggtcaatcggggttggaagcgcacctcaagggcaaaagacaccagcagaacatctcagccacatccatgccgaagaacggcgcggcgggggaagcaaaatcgcttggcatcaatgtgccgaagcgttcagagaagccaccatcagcctggagctgcagcatttgccaagctatatgtaccagcgaatcagacttgaacagccacctgaggggcataagacaccaagcaaaggttcagtccttgcttgaaggcaagaacatggcaaggaaagaaaaactgaatccagattcaagatgggcctgcagaatttgccaagctcactgtacttgtgaatcagacttggagaacca

SEQ ID NO: 65296 - DNA, 442 bp, Triticum aestivum
  Clone ID: PAT_TA_65296
gtggacttgtgtcagtttggccccaaaggagtggtatgaccggatattggcaaatgtgaccaatattgtggctgagatgacagatatattggccgatgtacaatatcggcagccaaccgatactgcaatattgaccgatgcacacaatatttagaaccatgacaaggagagtcaaaggctgctgttttgtttatgttttgagacaagcaagaagaatcaacctgttctctcctagttattctctcaactctcacttaaatctatatgtacccaatcccacacacaggtcatctggcagatttgtcttatcattcctctattgttctacgcatcggcatatgattgtttcgacctttgtctgttaccgttgttgaatgcatctaactcattctgtgtaagcttattctaattcatgtagcggcctgctgatccctacctgggt

SEQ ID NO: 65297 - DNA, 171 bp, Triticum aestivum
  Clone ID: PAT_TA_65297
agctgctccccatccacagcactgaaggaggaccgcaaattgcggcggctgggcagcaccaggaggcgcgtttccaccagcagcaaggcctcctcgagcagcgatcgtgtcgacaggcggcacagcttctcggccgaaatggaggcgcggcgatcgagcttctcgagcttg

SEQ ID NO: 65298 - DNA, 364 bp, Triticum aestivum
  Clone ID: PAT_TA_65298
tgctcttcctcagacggcggcggcggccagatcgagcaggacagggcaccacacggcgctccccgatccgccacggtcgcaagaggaatcgcgccggacgggagaggaccgtctgctacgactgcttcgtgcgtcgttgttggagatgctcgcgcgccgggagcttcctccgctctcccactgccccgaccgtaggtactcgatctctcgccctcccttccgttctcctctttgatcttctcttctattctccccaccctgatgcgccatcccttttcccttccatacgcacacgcaaacgcagcagcagcgcacaccgccattggttgtggctagctgtacctcggagctccttccttcctgc

SEQ ID NO: 65299 - DNA, 477 bp, Triticum aestivum
  Clone ID: PAT_TA_65299
ggccgatccatggaggtggacgcagccgaggagatgagatgctcgatcggccatctcatctcatccatccttctaattccctagatccttcttcagctggatcatggacgagtgaaactagaagctggtgtgttcttgatggactattggtgctggctacaaagtttctctctatatatgatgttattatatgagaaccaccatatcatgttcaaaccacttcgaaaagtcaatgcttactcattgtgagaggatgctacatatgaaggagaagagcctagaggtgctgttagataatggtggaataaaccagtgttactctgtgaaaatcataattgatgaatatggtcaatagagaccctttcacttgcctaacaagttttcatggccataatccatttggattgcaaatggtcttttgttatagtaagccttcaactttattgtctccaactaattagtttgttcttggataat

SEQ ID NO: 65300 - DNA, 487 bp, Triticum aestivum
  Clone ID: PAT_TA_65300
cttcgggcgccgtcaccgccaccgccatcaccgaggacatcctgttcccactcgccatgtcgctgcgctcggtgtgcctcaaggatctgtacagcgccctctgctttgtgccgctggtctcgtcctcaccgaatctccgctcgctcaagatcctgcggtgctctggtgcctgggacttaccattggaggtcattgcggcccgtgctcctggcctcgttgagattcaccttgagaagctccaggtcggtgaccgtgggctgactgctgtctcggcctgtgcgaatctggaggtgctgttccttgtcaagacccctgaatgcaccgatggaggcataatcagtgttgcacagaactgccacaagctgcgaaagctacatattgatggctggcgcacaaaccggatcggtgattgcggcctcatggctgttgctcgaggatgcccggaccttcaggagcttgtcttgataggggtcaaccccaccgtgca

SEQ ID NO: 65301 - DNA, 440 bp, Triticum aestivum
  Clone ID: PAT_TA_65301
ggttgtattgggctgaacaggacagagagccatccttttccatatctagtttttgtggtgttaaggatctgaaattatataatgttgaaagccttgggtttggtggaaagcttcacataaatgatggggattcatggatcaattgttctgctggtgtctctgtctcatccctgtggtgcaaccttggccttacatttaagcaaccaggcctcttcacagcaacttgttccagccgtatgggcaatcgtaacactgttcttgggggttatatcagttatagctatgaggaggaccggaccaagtttgctgctggagttcagcattcagttgatagctctatgtatctgaagagctgcattggaagtgacaaagtcctcagaagttttgtctccaagagcttcggcaaatcccgtctcattcttgtaactgaagttaatttc

SEQ ID NO: 65302 - DNA, 378 bp, Triticum aestivum
  Clone ID: PAT_TA_65302
catccacacacacccgccgacacgaagcaacgatcttgtgatccatccagcttgaacaaggcaatcgatttgggatcgattcacggcgaccttgcagactgggtggatcgatggccggcaagccgacacctcccgattacggctgccccgacgacggcggcgagcggccgccctttgtcctcatcgatccaaaggcctacttcgccgaccgcaagaacgccaccaccgccttctgcgatatgaaggcccccaagctcaagggccaactccaggtcaccttctgcgccgtcgccccgccgctcgtctcctagttctgcgtccacgccacccacatggaccacaccgagttcgccgtatcgcccttcatcgtggccaccg

SEQ ID NO: 65303 - DNA, 323 bp, Triticum aestivum
  Clone ID: PAT_TA_65303
gtggtggcggtcatggtggacgccaccatgtgagcttcagctcattgtggtgtagccggagcgatttccttcgctgttgaagtccgggaagatttttatgtgaatgcaatcctgttttgctaggtccctagcattattaattttatttttctgccaataacaaccaagtaatgtgtgcatgtccacgccttggagtaattctcggttagttagatctgaccgctgcatgtgcttcgtgggatgccacgaatccagtgcaagcaacgttattgtcgttgggttcaggtggacatgggatggttcatttgatatacctactcact

SEQ ID NO: 65304 - DNA, 359 bp, Triticum aestivum
  unsure (1)..(359): unsure at all n locations
  Clone ID: PAT_TA_65304
ttcgctcgcgtgggtttaagcaggagaccgggcggggtcagttgggcagttaggttggatccgatccggctgcggcggcagcgacgagatggcgtcgccggcattcgcagtttccgcggcggggctcgcccggccgtcgactcctcgatccggcggggcanagcggagggggcgcggggtggagctgcagtcgccatcgctgctcttcggccgcaacaagggcacccgttcaccccgtgccgtcagcgtcggaggttctggatggcgcgtggtcatgcgcgcgggtgggccgtccggggaggtgatgatccctgacggcggtagtggcggaacaccgccttccatcgacggtcccgttc

SEQ ID NO: 65305 - DNA, 441 bp, Triticum aestivum
  Clone ID: PAT_TA_65305
ccatggcggccgccgccggcggaaccagcagcgagggcgcggcgcgcgtgctgctgcagcgttaccagccgttcgggtcgccgcctggcgagtaccaccatttcggcccggccgacggcggcggcagcgccgacatgacggaggccgtcgtcctcaggacgccattaaagcggaaacacaacagagaagacaatgaggtagctgaatcaaatgattggatgatgagccctggatatgctaacgcagcaaacagtccaattcctacaccaccttcgggaaaaggttctaaaatgtccgccaagcctaaagctgcaaaaggccagaaatcttgtcctcaaacccctttgttttccggttctccgggcaatccagctactcctgttggtggctgccgttatgatagctccctagggttattgacaaaaaagttcctgaacttgc

SEQ ID NO: 65306 - DNA, 437 bp, Triticum aestivum
  Clone ID: PAT_TA_65306
ggcacaaatccttggtccgtctcgacgccgtggaaccatccctcatgaatgtggtccatcattttaagctcaagcctgctttcaaaagcatctggactgcgttggcacgtgttaaccactacaaataccaagcttggccggagttcaaagtcaagttcaagaggcgcgtgtccgcttatgtggctgattggaaagatccaatcaacctcgactcaaaggaccgggctcctggcttaggagttgatgacaccgaaccaaaaggctgggcccaaagatactgcgaggttaaagacaatatccttcagctgttaaccgcaagatggttcggtgtcggatttgggaaccctcattagctccagtcagatcaggtaacacacactggtaagatctaccacctctccccctcttttacatagtaatttctgtttatttacact

SEQ ID NO: 65307 - DNA, 461 bp, Triticum aestivum
  Clone ID: PAT_TA_65307
ccccaaacatctcaaaatgcattcgggctgctcgatttatcaaatctaagtcttattgatatatgagtcatgtttgttgtcatatagattaaatgatataataccttcttaggcaatgtgtacttaattggttgatgtaaaacaccaggcaatacaaattgtatttacattcgtcatttgtttggactattagttaacatgttaaaacttgcataatacatggtgtaataattgaaaatcatataaacatcgattttatccatttctctatttatatgttagcaaaagcaaaaaaatcacccttcatagcacaaaggtgaaaagacaaaaggagacataccattattaagtttgtgcattctccctagggaaacaatcaacatccactgactgtttttcttgctcatgtccgcctcctacattgcatgacacatgccctatcggcccccatcgctcctcct

SEQ ID NO: 65308 - DNA, 316 bp, Triticum aestivum
  unsure (1)..(316): unsure at all n locations
  Clone ID: PAT_TA_65308
gatgtgtttgtttattgggtggaccttgaatggttagccttgttgatgtggggaaacactangcgcttgccgtgacacgacacagcaaggagcgttggattgttggctggtggtcctgcacccagtttccactctggccacatatgctgcttatcttggttagctgttgtgccagtgggcggcttattgtctgagttgagtttcatactctgctctccgactagcgcacaatctgttcgtcgaatcatatatgaagcagtaactgagtcaacgtgccacttagtgacaatttgatagcagctatgcaaaaggatac

SEQ ID NO: 65309 - DNA, 306 bp, Triticum aestivum
  unsure (1)..(306): unsure at all n locations
  Clone ID: PAT_TA_65309
acacttttacaccgttgcacggagcagaccggtcaccggaagcttgtgctcgttccacctttgccgcagctaatcgacaatggcgtcgccttcaccttcgttcctcctccagctggtccggtacgtgtggtccctcccgagccagttcatgggggcgacggcgagggcgcttccagcctcnagggaaggcgccggtggggcgatccgtccgtcattcgccgcccccgcgccgcagcggccaggcgcgccggcagagggcgccggcggccagggtgggatcatccatgaggcttctcccgtcccgct

SEQ ID NO: 65310 - DNA, 439 bp, Triticum aestivum
  Clone ID: PAT_TA_65310
ttctttgtgcttgactggcccgtctcgtgcaattctagccgtagacccagtcgactttgaagtcgaactaaaaatacatgatggaggtgatgagcgcaaagatagagaattgatctgggctatcaaccattacgacatagcatacaacggtgagcagccatctttaaccttccatagcccattgtgtagagcagagttgaggcttgagcgacttcctacaacagtccaagccactatcttgtctgttcatgttgttggaggggggtctctttttaaatctggaggccaagttttttgttcatcgtctagtgcagatagtagtgctgccagacgtgagaagattgtgttgcttgattatgttgaaacaaattcagcagcaaaaaatgaacgacatctagatggctaccttcccctgtcaaggaatgttgtttcggtagaa

SEQ ID NO: 65311 - DNA, 293 bp, Triticum aestivum
  Clone ID: PAT_TA_65311
cccctggggcccagccacgtcgtcaccggtacaccctctggcggcgcggtccaaggcgcgcgccgcggcggcgctggcgcatgtcatggcgcgcccaggagcgcgagtcgccgccgcggactccgactccgacgagaacgggcacggagacgacgacggcggcactgacgggcgttacggcggcggccggagccccctgcacgggtacgttgcaaagagcgccggcggcgtcaaggacaagttcttcgggatggcgttgcccaagttaggtcggaacggtgtggactctggtg

SEQ ID NO: 65312 - DNA, 249 bp, Triticum aestivum
  Clone ID: PAT_TA_65312
acaactcctctcctttgccttctccatcaccgcccgccgcccgccacacgcctccccgcgtccctccttcatccccgtccccgattgggccgccgccgccaccgcaccatcaggggacaccgtcggagtgcaaccacagtgccgccagggtacgccgcgtgtaccggccggcaatgcatgagacgccgcggctgcagggcaacgccggacgagcagcgcacgaagcaggtgcaggtggcggttctggtc

SEQ ID NO: 65313 - DNA, 475 bp, Triticum aestivum
  Clone ID: PAT_TA_65313
tcacttcaccaccgctcgcgtcgtcccccgctggcgatttcgtctgcccgttgccccctccgagttcgtcgccgtcgccgtcgccccctgctggcgagttagtcgccgtcgccacctccaaacttgtctccatcgccgtcgctccttcagcgcgcctgccgctgccacttgatctggctatggagcatcttcaggacatggcttctgtcatgtatgatgatataccaccagactgctttaatgccaaagtcccactacatgtttttaagtaccctgacaacgaggttatcccgttctcatggagcgtgagaactcaggaaggaggctctactaaatggatcagggcttcaaaatttgacccttttgtcgctagttgcagaacttatggacggacagaagctgcccctatattgccttcttctcttcatgtcacggtgatggtgtatatgcctcttcgtgatgcctatcaactgca

SEQ ID NO: 65314 - DNA, 418 bp, Triticum aestivum
  Clone ID: PAT_TA_65314
acgcgccgccccgccgtgctgtgctccgccgagggcgtctacttcgtcgaggccaccgcgaactgcacgctcgccgacgtcaacttcctggagcggcccctgctgctcggcaaggaccagctcgtgccgtacccgacgccggagctctgggccgtcgagccgcaaaacagccttgccatgatacaggtcacggcgtttacctgcggcggcttcgtgatcggcctgcgcaccaaccacgcggtggccgacggcacgggcgcggcccagttcctgaacgccatcggcgaccttgcccgcggcctcccggagccccgcgtcaagccggtctgggggcgcgaccgcttccccgacccggacatcaagcccggcccgctcccggagctgctggcgctggccctcgagtacatcgcgttcgact

SEQ ID NO: 65315 - DNA, 426 bp, Triticum aestivum
  Clone ID: PAT_TA_65315
attatgtgggatggaaagggaactggctaaaagattcagttatcataattcttccgttcaatgcataaaggcactcggagaaaagtgtgggtgggctatgccagtggtgctgttcaagtcatggatgttgaaggtaaccctctgggaggatggaccggacatagctgtccagtcattcagatggccattggtggttcttacatctttacgctagcccatcatggtggtattcgaggatggcctctaacttctcctggacctctggatgatattctgcggacggaattggcgaagagggagttgtcctatacaagggtagagaacattaagatgctggttggaacttggaatgttgcgcaggagaaagcatcacctgaatccctttggtcatggttgggtactgcatcatctgatgttggattggtg

SEQ ID NO: 65316 - DNA, 330 bp, Triticum aestivum
  Clone ID: PAT_TA_65316
ccgcctctcgtctcgtctctcgtcccaatcccaccgcccggcacccccccggctccgtctcctccccgcacgcatcaccctctctcccctcgcccctggcccgagagaacccacacgcaaacccaacgaacacgcggcgccgcgttgagaaacccccgaggaacgatgaccccaggagcaggcccccattgcggcatggctgcggccgccggcgtctggcagctcgttggcgtcgccgtggccacgctcctcgcggcggtcctcgtagccgtcgcgctggggcgccagcgccagcgccgccgcagggccccgctcgaagggatccccgcg

SEQ ID NO: 65317 - DNA, 465 bp, Triticum aestivum
  Clone ID: PAT_TA_65317
ggcaaatacacgagtttgtgaatggcggcagttcacatcctgataaggatgaaatttacatgatgctgtggaatttatctaacatggtagcatctgcttgattgctctgttgcaccgaaattgtgttgaatcccttggtgtgatgcctgttagttgattgaacattctcggcatgaaatgctacatgctggatgaagctcttgaaaactcattgtcccagggcttctttctgaagctgcttgtcatgacaaatatctgcaaatgaaaacaaagtgtttggttggagctgtggcttatttcccagaggactttggagatattaacatgatcgaaaattgcacctggtagttaattacgctattggaagagctacctcccaagttctattgatgatatagcagccaaatgggtgcttagttacttgcacactggtccatgcctttctttgtattcattttactggac

SEQ ID NO: 65318 - DNA, 387 bp, Triticum aestivum
  Clone ID: PAT_TA_65318
ggtgcggccgatctgggacgccgtcgactcgcgacagtacaagtccgcgctcaagctctgcaccgcgctcctcgccaagcaccctacctaaccctacgccctcgctctcaaggctcttactttggaaaggatgggaaagcctgatgaaagcactgagtgtctgtttggaagccaaggagctattgtactcaaataacattttccattttgacgatctcacccttagcacacttcagatagtgtttcaaaggcttgagagattggaccttgcaacttcatgctatgagtatgcttgtacaaaataccctaataacttggaattaatgatgggactctttaattgctatgtcagagagtactcatatgtgaagcaacaacagacagcgc

SEQ ID NO: 65319 - DNA, 420 bp, Triticum aestivum
  Clone ID: PAT_TA_65319
gccatgggtggcggttgcctttccaagagccagcgcctctcgcccccgttgggcccgcaccgacgcgaacttcatccctgcccccgccgcaccggtgccgtgcagttcgggatgggctccatcccggatgcccccgggatcccgttccgcgccgtggagacccggcccaccccgtgctcgcccggatggcgctgaaggacgccggtgagatgaatatggggaacccccgcggtggaccacgacggcttcttcttcgccaccgagctccaggccatcgtccgctgccaccctcgctgccgcgggcctcgatacaggggattctgccgaagtatttcagctcaaagtggtcatttgcttggatcgatttaccaaaagtcttacatcttaacttttggtgctcagaacattgtactgattctt

SEQ ID NO: 65320 - DNA, 409 bp, Triticum aestivum
  Clone ID: PAT_TA_65320
tactatgatcgtaaagcggctctgcgcacctacggccgtcacatgaccgggcaagcagtcggaccagttgtcggccgtgatgacgagatcgaccgcgttatttctatcctctgccgcaagaccaagaactgcgccgcgctggtcggccccgcgggggtcggctttacggccatcgccgagggcctcgtgcagcgcatcgctaccggcaaggtacctgccgcgctcgccggggcacgcgtcgtggaggtcgacctcggggccatggttgccggaaccaggtaccgcggtatgtttgaagagcggatgaagagcgtgatcaaccaggcggagaaagcgatcggcaagataattctcttcatcgatgagatgcacatgcttcttggtgctggggctggtcgtggagttactg

SEQ ID NO: 65321 - DNA, 253 bp, Triticum aestivum
  Clone ID: PAT_TA_65321
ttgtttacaacaaccgtgcagttttcgcttggaggcagatgatttgcccatcaggggtgacatccggcctgtgattgcggtcaaaagcactgcacatgcaatggtaggatttgtcaatgatgcctttgcaggtaacatgtccaactctgtaataatcttgtttatccaaaagcagataccaattgcaagctctaacaattgtactaaaaagagacctcataaccaccatcaatgcagggaatggtcatggaag

SEQ ID NO: 65322 - DNA, 406 bp, Triticum aestivum
  Clone ID: PAT_TA_65322
acagctcatggcgacgggcggagagggcggcaatggactggagttcctatcagatccggtggacaggttccccttgccggatcttgcatccagcgatttgacgcccaccggtgagccagatactggtctcacccaatcagctgctgaatcgagtatgggatatgttggcgacttgccgcttacaatccaattgcccatgaacaacggctgcgaagaactgagcttgtcggcggccgattcacagcaatcaacaggaaaggatgaccctcaagcccccgggtggacaaaaagggaaaagaaggcaaccgttaacagttagaaataattcattcttactgatgcaaggtttgtattgggcgagcccctatcgagcatgcaccttgtgctggaagagtatgtgcccttc

SEQ ID NO: 65323 - DNA, 366 bp, Triticum aestivum
  unsure (1)..(366): unsure at all n locations
  Clone ID: PAT_TA_65323
ttggtgcagaatgtgcagacccaaaccaacgtcgggtttatctgtcatatcttgactctgtcaaattctttagacctgacgtaaaaacagtgtctggggaggccttgcggacatatgtctatcatgaaattctgatcggttatcttgagtattgtaagcagcgcggattcactagctgttacatatgggcttgcccacctttgaagggtgaagattacattctatattgccatccagagattcanaagacaccaaaatctgataagctgcgcgaatggtacttatctatgcttcgaaaagctgtcaaggagcgtattgttgtcgagttgacaaatctctatgatcacttttttatcactacaaaag

SEQ ID NO: 65324 - DNA, 254 bp, Triticum aestivum
  Clone ID: PAT_TA_65324
gcggccgccgcccgccgccacagcaccgcaggccccgtcgcccccgcgcaccccgccgggtttgatcccatggcgtccaagaagatcctcaaggagctcaaggacctgcagaaggaccctcccacctcatgcagcgcaggtcctgtatgtgaggacatgttccactggcaggcaactatcatgggaccctctgacagtccgttcaccggtggtctatttttggtgaacattcatttcccaccggattacccctt

SEQ ID NO: 65325 - DNA, 231 bp, Triticum aestivum
  Clone ID: PAT_TA_65325
caaccaatcccgcaattcccttcgagttgtttctccgctcgcttgtcgacgagatcatggccggaaaaggagacgggccggcgatcggcatcgacctcggcacgacctactcctgcgtcggcgtctggcagcatgaccgggtggagatcatcgccaacgaccagggcaaccgcaccacgccgtcctatgtcgccttcaccgacaccgagcggctcatcggcgacgccgcca

SEQ ID NO: 65326 - DNA, 400 bp, Triticum aestivum
  Clone ID: PAT_TA_65326
ccgcctccacgcccctccttgtctcctcctccgacgccctccgcctctggcacgcccccctcgacgacctctccgcctccgcccccgcccccgagctccgctccgtcctcgacaaccgcaaggcctccgcctccgacttctgcgcgcccctcacctccttcgactggaacgagatcgagccccgccgcatcgggaccgcctgcggcgacaccacctgcaccgtctgggacatcgagcgcggcgtcgtcgagacgcagctcatcgcgcacgacaaggccgtgcacgacatcgcctggggggaggccggcgtctttgcctccgtctccgccgatggctccgtccgcgtctttgatctccgggacaaggagcactccaccatcgtctacgagagcccccgccc

SEQ ID NO: 65327 - DNA, 320 bp, Triticum aestivum
  Clone ID: PAT_TA_65327
cactccagctctcgtgcaaggaggcacatgagccagcagaaggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaag

SEQ ID NO: 65328 - DNA, 450 bp, Triticum aestivum
  Clone ID: PAT_TA_65328
ttgctggtttggctttttggggaagaatggagacgacgtgtgaagtcttggcaatggcttgctctgctctctctccttttaatatcagaaaaccctcttccttggctggtatggctgcccatcccttctttaccgtgttgcctttgtggagcctttctattggctaggagttgcagcccatgcctagaccaactgttggtcaattgactactgatatacatattatgcacgtgatggtggtggtcaaatgtgtatctcaaatgtgtcttgctgtcctggttgactcagagatatttttttgttggtctaagtttgatgtggcattgttgtatagcttagcatagtctggtctccctatattttttttgtttccaaagatttgtaatataactgtacaactatactgtttgagatgtgtgaatataaatatatatttgagtggttaaaaaa

SEQ ID NO: 65329 - DNA, 332 bp, Triticum aestivum
  Clone ID: PAT_TA_65329
gtcctttttggattgcaatcagaacaggccctgtttcgaattcattatccgagtttccattggtggtgggaacccagcagctatatatatatctggccgggcggacaccgcggtacccgccaatcttccgaggagaccaattcttgtggcgacaactcgtgagccttcagctgccaaattcacggtgaccaattcttctcgggcctcggcggatctacgctgcagccatggggaagggcagtcaagacgatcggttgagcaagttgcccgatgacattttgctcaacatcgttgaccggcttggaattgtcgacatcgcaagaaccagcttc

SEQ ID NO: 65330 - DNA, 425 bp, Triticum aestivum
  Clone ID: PAT_TA_65330
cccaatcccgacctaccgtcctctctcgcacgccatggacgccacggccaccggcgccaagggggaagaagggtgcggccgggcgcaaggccggcggccccacgaagaagtcggtgacgcggtccgtgaaggccgggctccagttccctgtcggccgcatcgggcgctacctcaagaacggccgctacgcccagcgcgtgggcaccggtgcccccgtctacctcgccgccgtcctcgagtacctcgccgcctagctgctggagctcgccgggaacgccgcgaaggacaactataatagccggatcattccccgccacctgctgctctccgtcaggaacgacgaagagctcggcaagctgctggccggcgtcaccatcgcgcacggaggcgtgatccccaatatcaacccggtgcttctccccaag

SEQ ID NO: 65331 - DNA, 137 bp, Triticum aestivum
  Clone ID: PAT_TA_65331
tcatttttccagacacagaattccagttctatagtttcgatgcgaattacccagcgccatcccttccccagttctccagcctcgtcagagtagccgatggagatagatctgaaccgggacgcccgcgacggcgacgc

SEQ ID NO: 65332 - DNA, 500 bp, Triticum aestivum
  unsure (1)..(500): unsure at all n locations
  Clone ID: PAT_TA_65332
tccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgcaacaaccttcactaagttatctaccagcatcatcatcacaccangctagctagcccactcggtgtctactggtgctgctctctgcgtgtgttcgttgttgttttctccatgtgtt

SEQ ID NO: 65333 - DNA, 471 bp, Triticum aestivum
  Clone ID: PAT_TA_65333
cttgcctgctacatcggttcagctgcctgtcagtgtttcattgcaagtctctggaagtgatagagaatagagctccaaatctttgctttgttcgcattgatggtgctgtagagaaacttccggttggagatttattgcaaatgaagagactacacatgttggattactacgaatctgaccttgtggatgatgctcgttccaagcttccattcattatgccaaatcttgaaaccctcaacctatcttcggctggagagatgtttaatacaccaatcttaactgtcagattcctcttcctgaagaacctgctgattgatcttaatgcagataggggggcttttccccatcctatgattatttttctctagcttatttcctggatgcttgtcctgttctggagaagtttgtcttgggtgtatcacagactcgagtaaagcatgaactgatttctgatggatacatgaacatgag

SEQ ID NO: 65334 - DNA, 479 bp, Triticum aestivum
  Clone ID: PAT_TA_65334
tcgacgcggggcacggcgatggcgcccagccgcgcctccggcttctccgaggcgtcgttggcttggaagtcgagcgtgccgagagagtcgacgttggactggaagaagaagaacctcccattgacggcggcaacgtggaagaagtttctctttgtggggggacagcccaggatgtccaagcagccaatgtcgtagccgtggcgcgagcaccggagatcctggccgacgcggcagaaccacatcaccgggctcgcatggtcgaagactatgacgctgcagccaggcgctaccacgacgttggacaagacgcacctgcacgtcaacgggacctcgtcgtcattgagagtcggaagctcgattattgatccgtccttagggttcagcagatgggtccctgcgtcttctaacgaggaaccggaggagctcaggaccaggacccagccctgtggcgtcggcaaggataccttcttgctcgacac

SEQ ID NO: 65335 - DNA, 500 bp, Triticum aestivum
  unsure (1)..(500): unsure at all n locations
  Clone ID: PAT_TA_65335
cacacacacctgaacaacattctttctctcctctgcacacaaaggaacgagcaatattcagtatggagtgcatcgtggagctgcagcaggagcgggagcactgcgtcacggaggtaccggaggtcgatggcgccgagctgctcctcgagctcctggacgcgtcgctcgccgccgaggatgaggaggaggcggcggcactcggcggcaagcaccaccagctcggcttcccggccgaggacgtcggcgaaggctgggtcgacgacggcctacaggagctgaactcgatccacccgcaccangaggcgggctgcgaggactgcgggctcgacggcatcgtagtgtccggcttcaacggctgcgggtgctcgccggggccgtacgtcctggacgacgtcggcaacgccgtggggtactgggcggaggagatggagggcgccggctttggcttcttcaacggcgactgcgtgggggagtggtactcggaccgcatggccgtggag

SEQ ID NO: 65336 - DNA, 516 bp, Triticum aestivum
  Clone ID: PAT_TA_65336
cttccgcttctcctctgttcctcgtgcacgagctgccgtcaacgcgtcatcgccgccgtcgcggccactgtcatcacctacgcacggaaggacgtccaggaggtccagtggggccgtcttcgtccgtcccgagcatcaactcgagcggggccgccccgtacgctcgccatcgagcccgtccccaccgcgtacatcgccggcgtgcgccggcgtcgcctcgactccactccgcctccggcctccccgacctcgcctatgtgctcgctatggtggagcccaggagccagatgatgccacccccgcagactactactactacccagagggtgccttctactatgtggagcccgccgacgaccaggagtagttaggaggtcccaggcaggaggccttgcctcttcgatcgttgttgcttttgtgctagacttcttaaggcatccttgtttaacttatgtctgtactcagatattgttgcttccgctgactcttgtgtatcgagctatgtattcgagccct

SEQ ID NO: 65337 - DNA, 231 bp, Triticum aestivum
  Clone ID: PAT_TA_65337
caccccacatgtggccactccccacctatcccagcccgaaccccccagtcaaccccacgccatgcccatctccattcatatcgccccatcgagctatggcaacccaatcctacccctcgatctgaggcggcagtggtggcggctggaccaactgccggatttggatgtgcgtgaggttgctggcggcgggcactgcccaactccatctggcggtgagcggtggtgaggtac

SEQ ID NO: 65338 - DNA, 250 bp, Triticum aestivum
  Clone ID: PAT_TA_65338
acctattacgcttgatctaaagtcatcagcttttgacccaaaggagaaagtatggacaaggttccctccagaaagctcaaaatacacccctccacacagttcttgcgattttagatggaaagattactgcccgcaagtattccggacattgcgcaagttgttcaaggttgatgcagcagattatatgttatccctttgtggcgaccaggctctccgggagttatcatcccctggtaagagtggaagcttc

SEQ ID NO: 65339 - DNA, 393 bp, Triticum aestivum
  Clone ID: PAT_TA_65339
gcagccggtgtgcttcctcctccccctggatctgctcatgccgttccccggagcaactacctcggcagcgttggcctctggatctatcttggctgctaggggtgcaggtgcgcacgacgcgccgtgcgttatgggcggcggcgccgacgttgtgcccgattcggccattggctcgtcggatccggccgtcggcccggtctcgccggacgtgcctgagttggatcaaggggtgggcttggctgatggcgaattttccggggcatcctgcaagaccttcagctctggaggcggggatgtggcgtcgggattggcgactccagccggcgtctcgcacaactccgcccagtccagcggctgcagtggcccggcggattcgtgcacgacattcagttc

SEQ ID NO: 65340 - DNA, 528 bp, Triticum aestivum
  Clone ID: PAT_TA_65340
aacggtttcggaagatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctgaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagcaaagatcattaatgacaacttcggtattattgagggtttgatgaccactgttcatgccatcactg

SEQ ID NO: 65341 - DNA, 411 bp, Triticum aestivum
  Clone ID: PAT_TA_65341
gaccacggcttcccaccaccagatcgaccgacgaatcctcttcctcctcctccgcgccctcgcctcctgtcgccaccgcaagcaaggcaaggcaatgccggcggcggcggcctcgttgttgcgggcggcaaaccgcgggtagacaggcgccaaatcttggggaagcccgcccgcgcgctcctaacattcttcaccgtttcttctttataaaaatcctctcttggctcttcctccccgattctgtatatattcgctgctgctgtgcggggttgctctcggcctgtccttgctcttctcgctgttgccgctcttgttcgttcttggcgccggtgccgctggattggtctgcgttccgtgccggccgccggagatggagaacgggcacgcgggcaagcaccgggtggccgtcat

SEQ ID NO: 65342 - DNA, 420 bp, Triticum aestivum
  Clone ID: PAT_TA_65342
tccacctcttcgccgtcttcgtacgccacggcgcctgcggggccgcctgctccgggttcgcgcgcgacgcgctcccgcgcctcctcctcctcgcggccgaggacgacggcgccggcgccggcgggagcctcctcgcgacggaccccgcgggcgcgttccgggcggcgatgattggggtcaacgaggagatgcacgcggcggcggccgtcgacgactccatgagcgggaccacggccgtggccgcgctcgtggccggcggcgcgctccacgtggccaacgtcggggactcgcgcgccgtcgccggggtctggcgcgacggccgcgtcgccgccgaggagctgtcgtgggaccagacgccgttccgcgccgacgagcgcgcgcgcgtcaaggcctgcggcgcgcgggtcatgtcggtcgagc

SEQ ID NO: 65343 - DNA, 411 bp, Triticum aestivum
  Clone ID: PAT_TA_65343
gctggtccggcaccgaccgcttccacttcaacgccatcgtcacgccgcaggacctcgaggacaccttcaacgtccccttccgctcctgcgtcgtcgacggccgcgctgccagcgtcatgtgctcctacaaccaggtcaacggcgtgcccacctgcgccgacgagtccttcctccgcggcaccatcaggggcaagtggcacctcgagggggacatcgtctccgactgcgactccgtcaacgtcttctaccgcgaccagcactacaccaagacccacgaggacgccggcgccgccacgctccgggctggcctcgacctaaactgcggccccttgctggctgtgtacaccgacggcgccgtctcgcagcggaaggtgaccgactccgacattgacgccgctgtcaccaacaccg

SEQ ID NO: 65344 - DNA, 441 bp, Triticum aestivum
  Clone ID: PAT_TA_65344
attgatcaaacgtttcgaatctccttcccgccctcataaatgtcgactaccaccatccaagcaccagagtcaagtaccgagactgtgtaagcctaacagctcacagcacaaagagccgctgcaccttcaaggtgctctcgatcagtttgaatcgttcgatgtgactccaattatcggaaaagaatttcccaccgccaatctgaaggattggctggagggccctaactctgacgagctgttgaaagaccttgccatcactgtgtcccagcgtggcgtcgtcttcttccgcagacaagatgacctcgacaatgatctccataagagattggcacagcgcctgggcgagctctccggcaagcccagtacttgcaagcttcacattcatcctgtctccaacagtggtcgcactcttggcggcgaagatgatgagatctctgtgat

SEQ ID NO: 65345 - DNA, 415 bp, Triticum aestivum
  Clone ID: PAT_TA_65345
gtgggggtggggcaccgtcgtctggcagaccggccgctgtggcttgccggcgtggccgcgtggggggtggccgctggtcgctggcgggtggtcggctagggctagccgctgttccatccactcctccactccggcctctgctgcggacatcaggcgaccacatcggcgccctgtagtgagccggtgagcagctgctctcgctggatcttgcttttgcccctgtacgttgcctagtctgctagtcaatctctcccatctgggcgtcctagcaagctagctagctaactctgtcaaaagtgtcaatagtatagtgctctgtcaaagttatttggaccctgtcaacactgctcgttggatctgtgtctatctctcccctacggaaattgtagaaacttcaattattttgattctgaat

SEQ ID NO: 65346 - DNA, 389 bp, Triticum aestivum
  Clone ID: PAT_TA_65346
tgccggttgatgcggaccgtgctccgttcgaggtaatcaccctgccggagaccttcagcctggatgacttgagccttgatgatgcgattcgtcagatggatacgccggatcgtcatcggcggacctctgatcagatcaccttgtctggagaagggtatgtgatgatcacccttgatgaggatggtggagcagagggacgtctcctgctggtcgatcttcaggatttgagcctgtacagcatgagcaggagacattccctccgtttctagaggatattatttctgtagatcctcctccccatggcagtttttcagtgacccaccaagatacaccagaaatattgcgtcgagcttctgagagtgcgtcaaggtttgaagatgttattgatg

SEQ ID NO: 65347 - DNA, 326 bp, Triticum aestivum
  unsure (1)..(326): unsure at all n locations
  Clone ID: PAT_TA_65347
aggcggccaacccccgcgccgcctacctctttaagctaccattcctctcctctgcttttttcagcactgctacacggatactgtcagtcaacacaacactctgctaaactgtactgccttcttctatcgtgaaagttagcctgtgttacgagatggctttttctgtaaaatgaacctaaccatattttgtgcctacttatgtcatgcctcaatagtcaatactagtcatgtgcatcancttataggactacaattgctcattttttatataaagctctatgaatcgcacgcagcttttgccaaaattattgctagaaacccacact

SEQ ID NO: 65348 - DNA, 250 bp, Triticum aestivum
  Clone ID: PAT_TA_65348
aacctagacacggcgaccgcctccagccgctgaacgccgtcccggatcttctcgccacaaggaatcgaccgccatcagcccagcaccttcagccgccggatttgaccagaccctcaccgctttcggccaagccaatcgcccgacgacttgcggcttctaatggcggatccggtgtccgctgctgtcgctgtaggatgggccaagaaagccgctgggtgggtggcctcgcccatcatttccgagctgtaca

SEQ ID NO: 65349 - DNA, 381 bp, Triticum aestivum
  Clone ID: PAT_TA_65349
aaccccgcgccgtcagtcgaggaggagatggacgtcgacgggcagccgcgctgggcggagaggtggatggcgtcgcgcgcgtcgtttgatacaaacaggagcagcgcccgaactgccgcggcggcggctgccgcggcaccagggcgcgcgtccacggaccaccgcgaccaggtcaagacgttggagatcgacactgggcggccattctcctactccacgcctcgccggcacgccccaccgtcgcagcacgggaacggctcgccgatgcaccgtgcgcacaaccaggcttctgccacgccgtcaccggggaaggcgaggccaccgatacaggtgcgctccgcgagcccgcgagtggagcgcggcacaagtggtggaggagga

SEQ ID NO: 65350 - DNA, 379 bp, Triticum aestivum
  Clone ID: PAT_TA_65350
cagccccggccaccgtggacgactcggccacgcgggagctccggcggctgctgggcctggagcggccggcgaattaaccgcgcgcgagaaatcaaacaggcaggccacggactcagcgaacgaaggaagggtttgtcaagatgtacgtgtgggtctcttccattgattcttttcggtcaatctccgactccgtctctccgacggcgcgcgttcccggggcctcccccgtccggtgtttttgtcaaggaccgagggaggcggggagcgacgctgcggcttatctcccattgcgcggaacccgttgtaggggaggaggagctaaactataggaaggataaatgatgaaatggcgggaagatttgatgtggataactgaatc

SEQ ID NO: 65351 - DNA, 486 bp, Triticum aestivum
  Clone ID: PAT_TA_65351
tcctgggcgcgctccgggacgagttcccgcgcgtgtacaccatcgggccgctcgcggccgccatgcaccgccgcgtcgaccacggcgcgtccgggctgagcctgtgggaggaggacgcggcgtgcatggcgtggctggacgcgcaaccggtggcggggtcggtgctgtacgtcagcttcgggagcctggcggtgctgtcgctggaccagctggcggagttcgcgtggggcctcgccgccagcaaccgcccgttcctctgggtcgtgcggcccggcctcgtcgccggcgaccgcggcatggaagccctgcccgccgacttcctcgcggagaccaaagggcggcgcttcatcgccgagtggtgcgcgcaggagcaggtgctgcggcaccgcgccgtggggggcttcctgacgcacagcgggtggaactcgacgacggagagcatctgggccggcgtgccgatgatctgcgcgccggggttcgcggacc

SEQ ID NO: 65352 - DNA, 504 bp, Triticum aestivum
  Clone ID: PAT_TA_65352
acacataatagaatctggatagctttagatcacaaccaaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgcccctcagcaggttccttcttggcagctgcagcagctttcttcttcctaccgatttcgactccataatgag

SEQ ID NO: 65353 - DNA, 355 bp, Triticum aestivum
  Clone ID: PAT_TA_65353
cagcgtagcgggggcccgtcgtcgcgcggggccagtggcgagagccgcggaggtggtccggagccgggtgtgcccgaggtctcacacctggggtggggccactggtacactctcaaggagctcgaggcagcgacggcaatgttcgccgacgagaaggtgattggcgagggcggctacggcatcgtgtaccacggcattctcgaggacggcacacaggtcgccgtcaagaatttgctgaataacaggctgagagggaattcaaggttgaggtcgaagcaatcgggcgggtgcgacacaagaacctcgtgcggctgcttggatactgtgctgagggcaaccaaaggatgcttgtgta

SEQ ID NO: 65354 - DNA, 365 bp, Triticum aestivum
  unsure (1)..(365): unsure at all n locations
  Clone ID: PAT_TA_65354
gcaggcgggaggactgggaggccgaccccgccaggctcgtcgtccggggcgtcatcgcccgcggcaccttcggcaccgtccaccgcggcgtctacgacggcctcgacgtcgcagtgaaactgcttgattggggggaggatggtcataggtcanagcaagaaataacatcactaagagcaggggtttcacaagaagtctccgtctggcataagcttgatcatccaaatgtaaccaagtttatagacgctataatgggtgctggggatctgaatattcagacagaagatggaaacatcggcatgccaagcaatgtttgctgtgtcattgtggagtaccttgctggaggtgcactgaaaacatttctg

SEQ ID NO: 65355 - DNA, 384 bp, Triticum aestivum
  Clone ID: PAT_TA_65355
ctcgcgccgcagtcgccgcatccccggctcctcaccacaagctccagcaagcccgccctccccgcggcagcggccgccgcgccctgcggctcgcgaggcgacgagctccgcagcgcctccgacgaccgcgcccggagcgcgacggcggcgccattccaagcacttgacgccacgctccgccgcggctccttcaccgtccgccgctcctccgggctctgtacctcgccgaattcccccttagtcacggcctctcgtccgggctctgcacctcgtccacggcttctgcacctcgatggttgctgctggactctacccctccaagttgcccggacgcctccacaactcttccttctccccaacaaggccgctgccgtcctggcggcg

SEQ ID NO: 65356 - DNA, 501 bp, Triticum aestivum
  Clone ID: PAT_TA_65356
aacaacagcagcaccatgctccgcctcacactcgtcgcggctttggccgtcgtcgccctctccgggagcgcgttcgctggttttgaaggacaaacccagaacaagttcatcgtgacctacaatgtcgtccccgacgtgttcggtctcttcgccttctacaccatgccccgcaccctccgagaggccaaggatctccacttcgactgggcttctgagcgcaaccccgccgacaacaacaccgacctctactgccgcaagggagaccaccgcgtctgcgtgctcttcgacaaggctggcagcgtggccggcatccagctgtccgtcgaggccaaggagctggacaactctggcgcccccgtcgacgtcctggccatccccgagtggcgcaggaacatgattaagagcaaggaggtgtactccaacaccgccttcttcgtgtccaaggcgatcatcgacgccggcggccgcgacatcgaagaggacaccctgaccgcccctgac

SEQ ID NO: 65357 - DNA, 256 bp, Triticum aestivum
  Clone ID: PAT_TA_65357
atacgctggcacttgatatagcatataccatttacatgaaccttgaagatcttgcaagtgcattgcgcattgcattgcttcttgacaacaagtccatacagtatgtgaagcaggtctacacagcaactgatgatcttgtactcaagaagcaattctcatacatcattgcacgccatggtttggccatggagattgatgatgagatagctgcagatgaaaatgacaaggaaatgttgcaagaaatagttaataacac

SEQ ID NO: 65358 - DNA, 316 bp, Triticum aestivum
  Clone ID: PAT_TA_65358
tctttgggcataatttagttattgtggtgaacataaggccatcccaaaagtaaatgggcaatggaataggtaggacatatacatgagatcgtatgctgcatagtttaaacacacttctttgtttcgggatatggaacagaagaacagatacatgacatagaacacatataaagcttcagcatgggattctaaagcaactaatttttttgttcgatgtactgtcgtcctgtcaatggcattttcaagtccatattgactgttgaatcaaatatgtagctaggacttctgacgttttattgacctggtggagtttgag

SEQ ID NO: 65359 - DNA, 161 bp, Triticum aestivum
  Clone ID: PAT_TA_65359
agcgctgtcgacctcgcgcggccgccgcaacaatggcgtcccttttcaaggacccgagcaagctgtcggtgtacagggaccggcggttccctgggacgcaggaggagtttgaggcggcgctgctggcgtcgctgacggtgtacgtggggaacatgtccttc

SEQ ID NO: 65360 - DNA, 246 bp, Triticum aestivum
  Clone ID: PAT_TA_65360
gcggcggcgcaggcgtggcgccgcccgcgcgggctgctctgctggggcgccctggtcgccttcttcttcctcatgaactggtggatgttctcccacctccaggaccccgccacgcgcccgcgcttccgcctccgccgcaacccgccccgcgcgaccaactcctcgctctccactctgtaagaggtgaatgctactgaaaaggggaagaggcctcacccggtcatgctcacacacctgctcactttg

SEQ ID NO: 65361 - DNA, 243 bp, Triticum aestivum
  Clone ID: PAT_TA_65361
ttttttttttttttttaagaggtaagataaaatcatataaactatactccaataaatccacatacagtgtgaaaaaggttaaaccaaaccgaaaaaatccctcctctccctacccgcagatgcatcaaaacgtccaaatccagatcttgacgcggagcttacactttgcgtccgtcttctccgacccgccgccttcgggggaagacgacgactgcctgattgttgaccgggtcggcgcaggcg

SEQ ID NO: 65362 - DNA, 260 bp, Triticum aestivum
  Clone ID: PAT_TA_65362
ctccccgcctcgtctcctcccggctcccccatctcttctcccacgtcctcgcctcccctcaccccgctcgcctcagccacctcctatgctcccccgcaccgccggctccctccctctcggctgaccccatggcggcggccgggtcggggtggaggcaaaacaccatggagaatccggtgtctttgggcgcggcatgggttgatggagcggcggatttgggcatgatcccacccttaggcgctccacgacgacggccaact

SEQ ID NO: 65363 - DNA, 511 bp, Triticum aestivum
  Clone ID: PAT_TA_65363
ttgtctcactgttcccagctgccaagttattctaaaaaactcatttctgcagagagatccacgggctgttattgaattccttataagtgcccttccatggctggaaagtggcattatatcagggattgataaaggattgctggaagacatcaggcgtatctgcagtgagttcgaaaatggttctgacagggcgaagagaaatgcgtgtcttgctgtggagaagctgttgcaaagtacgaacaaactgccgctgatcttccgcctgctgactgctgcgaggctatgcatgcttacaaagcaaatgaatgacaggaggaacgatgctgcagcggctgctgtccagcctcatgccgaagccgacagatggtcagatgacgatgaagctgacacgggagaagccgcctcaacttccaaaaaggcggtgcagaagcacaagggcaagaagaaatcgaaaaagtccaagggccgcggcaagaagtgagctgctgtatccgtaacgcgtaagtgctgc

SEQ ID NO: 65364 - DNA, 351 bp, Triticum aestivum
  Clone ID: PAT_TA_65364
ctttctaaccaacggccgatggtgggtgcaggtggacggcctgacgctgcgcggcgccggcaccatcgagggcaacggcgaggagtggtggaacctcccctgcaagccccacggggtccgaacgggtccacgctgcacgggccttgcgacagccccacgctgatcaggttcttcgagagcagcaacctggtggtgcggggcctgagggtggaaaacagccccgagttccacttccggttcgacggctgcagcgacgtgctcgtcgacgggctattcatcaggtccccggccaacagccccaacaccgacggcatccacgtcgagaacacggagcgtgtcggcatctacaac

SEQ ID NO: 65365 - DNA, 257 bp, Triticum aestivum
  Clone ID: PAT_TA_65365
ccactctttctgaaaaatcaaagccctcacatgtgcatcgttggtgaggcagcctaagcattacagtttgcaagtaaccttccatatcgaaattaacttctgtatgatctgacctgttgagctcatcacaaagaccataaaatcggctctatccctgatgtccgataaaaaaggtgaattataccctcagatcaagaaaggatcttttcttctgagattatgcaccgggacttgcttatggagacattcgcctctac

SEQ ID NO: 65366 - DNA, 129 bp, Triticum aestivum
  Clone ID: PAT_TA_65366
gccgcccaccatgatcatctccaagaagaaccgcaatgagatctgcaagtacctcttccaagagggagtgctttatgccaagaaagactacaacctggcgaagcacccgcagattgacgtgccgaacct

SEQ ID NO: 65367 - DNA, 183 bp, Triticum aestivum
  Clone ID: PAT_TA_65367
ctccgctccaccacccgcaccaaaggcgaagctgctgccggccggcctcgcgttcctcctggccctcgccgcggcggcggcgctggccccgtccccggcctcggccttgaagggcgccggcgggctgggactcggaggcgcggcggccgtggtgatgcgccggggcgggcggtcttgccgggg

SEQ ID NO: 65368 - DNA, 227 bp, Triticum aestivum
  Clone ID: PAT_TA_65368
gctgtcgtcgtcatcgtctcgtccctcgccgtcgctctctctcatgaggtggcgggccgagcttcggctacacgccggggacccccgacggcccggagaattggggcaagctgagcccgacgtacaaggcatgcggcgacggcaaggcacagtcccccatcgacatcgtcatcgccaacgctgtccctaaccccaacctcgacaccctcacccgcgtgtacgccccc

SEQ ID NO: 65369 - DNA, 250 bp, Triticum aestivum
  Clone ID: PAT_TA_65369
ctctccctcctcaaccccgcaatgcaccaccacggcatcgcggccaagacggcctcccacctccctgttctccccgcgcgccggggcgccgtccgcttccgcgtgagggccgccgccgcggcgccgcctgcacccgccgcgaagcccggctcgcccaagaagcggggcaagacggaggtcaacgagtgggggctgacgccgcgcttctacaccacggacttcgacgagatggatcagctgttcaacgccg

SEQ ID NO: 65370 - DNA, 278 bp, Triticum aestivum
  Clone ID: PAT_TA_65370
cgcacgcactcatcatttacaaccgtttctgcatggcttcctacgcggctttcctcctcctcgtcgctgctttgtttgtgtgctgctgccacgcgcaaggcggcgacgacggcgccgtggcggcgatctacagcctcggcgactccatcacggacacggggaacctggccaaggaggcgccgcccggcgcgttcgagagggtcgagcacctcccctacggcgtcaccttcggccgccccaccggccgatgctccgacggcctcctcgtgatcgacttg

SEQ ID NO: 65371 - DNA, 343 bp, Triticum aestivum
  Clone ID: PAT_TA_65371
tcctctcccccacgatctcgtcgtcgccgccaccacccacgccggccggttccggcgatctccggccgcatgcaacatgcccccaagctccgccctaccctcccctccatccagatccatgcctcaaggtctgcacccttgcccacggctagggattcgggcgcccccatgttcttgccgccgagtacccaggtcagcccgctggccaacgagcagcaccccgcacttacgcgtgcccaggccgacgagtagtacggggattggccgcggacggagacgagtgcaggcgcggcagcaggagaagctatggcagtggcggatctggtgaccgccgggttggctc

SEQ ID NO: 65372 - DNA, 399 bp, Triticum aestivum
  Clone ID: PAT_TA_65372
tcctgcacccctccattccttcaacctcctcctccgcgccggtccaccccaaaccaccctccctcgtcggttccccttgctccggcacgccacacccccttactcaccttctccccgcaccccctccccccggcggctatacttcaacggatctggctggatccagacccgccgtcccccccgccgccgcacgggtgcgggggcgcccaacccaccccacgccgctgtgcgggacgaccgcaacagcaccggaggcgagccgccctcacctctctcatttccttcttcttcctcctaacttctccggccaccgatcccgtccccatccccacggtgccgccaccctcccccacggccaccgtggcacccctctcggtgcccgatccggcgggatccaca

SEQ ID NO: 65373 - DNA, 448 bp, Triticum aestivum
  Clone ID: PAT_TA_65373
tcccacccaccgccgacctcgccgtgctcctcacccaacgcccacctcgtccctccctcccctaaccatctctccctaccctccgcctcgatcccccagatccaatcgacacaacccagccgcccccgcacccagtactgtccaccatggccgcctcctcctcgctccggatccccgcaccaacccaccaccccgccgtgggggtgcgtccgcggcggctgcccttccacgccgtctccgtccgcccccgccgctccgcagtctcctccctctccgcctcctgccggtctccgtctactttgaatgaattgattgatcgtgcgtgtggtgtggtgtggcagttacatgacgagcccggagctggacgacggcgcggtcgagaaggagccggcggcagcatcgcgcgatggcgcgatgacgagtcctcttttccttggtcctctctgct

SEQ ID NO: 65374 - DNA, 361 bp, Triticum aestivum
  unsure (1)..(361): unsure at all n locations
  Clone ID: PAT_TA_65374
cctcaccgccgccgccactccgcctctgccgccgccgagagggtcgcgtgatccgcgctcaacgtaagggtgcgggctccgtcttcaagtcccacacccaccaccgcaagggccccgcccggttcaagtcgctcgacttctgcgagcgcaacgggtacctcaagggcgtcgtcaccgatgtcatccacaacccngggcgtggtgcgccgctggccaaagtgaccttccgccacccgttcatgtacaagcaccagaaagagctcttcttcgccgccgagggtatgtacaccggccagttcgtctactgcggacgccgcgccacgctctccgtcggcaacgtccttccgctccgctccgtgcc

SEQ ID NO: 65375 - DNA, 499 bp, Triticum aestivum
  Clone ID: PAT_TA_65375
gttttttttttttcccacgtcacaaaatgacacaacttgcttacacagcggcagtaagttgcttaaaagatacccatcaagttgctctttgtcatccatatacaaggttccttcgtttttattttcccacgtcacaaaatgttcacaacttccttacacagtggcagtatgttgcctaaaagattccagacaagttgcttagatccatatacaagggtccttagtttttatttctccccacgtcacacaaatgacacaacttgcttacacaacaacagtaagttgccaaaaagatacccatcgagttgctctttgtcatccatatacaaggttccttagtttttatttccccatgtcacaaaatgttcacaacttccttacatagtggcagtatgttgcctaaaagattccagacaagttgcttaaatccatatacaaggttccttaatttttatttctccccacgtcacacaaatgacacaacttgcttacacaacaa

SEQ ID NO: 65376 - DNA, 579 bp, Triticum aestivum
  Clone ID: PAT_TA_65376
ctattatattttctcaattcctatgtcatctctcacatggccatgtggtctccccggttttgtctttacgttatatctatgttgtactactgctacccccgcgctacagaaagtattttttatatcagctttgctctcgtgtgtgcaaggattccattcaggtatgaaaaacaccacccctcatgaagttacttcttttcagagagagaatgatcattggtttttatatggattcagtgcacataaataattagctcgcattttaagtttggatttagaattagctttccagttctgtacatgttttccttgctgatgatggatttcttcttctaagatgaattggtaactttagcaccaaatatgaagttatttggacaaagaaaagcttccttcctctttgctattttctctcttcagtgttgcttttttttagaacactctttagcgttgctttgatgttcctttgtcactgtttgatattctgccttgtgtgcctctgtcttggtttacagctccatatggctacctatgtatatatatatatatatatatatatatatatatatatatatatat

SEQ ID NO: 65377 - DNA, 392 bp, Triticum aestivum
  Clone ID: PAT_TA_65377
ctcccccggcctcgcccctgccaactgactgctgttgttggccttcctctgctcctcacccgtggacatttttggggtgggatcgtggggggctctttatctatctagtacagtacagttgctgatctcatccaacctccatggacatttgggggtggcagtttccagtcactattcagagcaccatgcatccaaggcactgacccggctagcggcctgatcgagtgaagcgacctccgccgccgcattgtcccctatgacgccgctgtgttctgctctgtcgtgaagtatcaaaggtttccagttattatttagagcaacacgctcacggatctggcctctggtgccgccgcttccgcttcattgtccgccgaccatccgacgaggacgcc

SEQ ID NO: 65378 - DNA, 497 bp, Triticum aestivum
  Clone ID: PAT_TA_65378
cgtatcggcggcggcttctgacctgaagccgaagccgaagccgaagccgcgtctccgacgacggaggcggcggatctggtgttccagtgattgcatcggcggagtagcggaggcgttgaggtggctgctgctgcggatgccctccctggagttggatccgtgtcttttaattggtatgagcggtgacttccaagaatgatatgtagcggtggacggagcggatacggtttctaatccgaagtattccaggattggagcagtagccggactatattatactgtatatagcagtaataaaaaggcagtcagcctttgttcgatttcttggattttcaccgtttcatcaagatcgaaccgcgtccacaacgatccaaggcagaattagatctgttttgttccccctgcctgacaccccaacccctttggggccaacgacgatggaggcataggagggtgaccgcattatccttctccctgactgcctgctgggcaacatc

SEQ ID NO: 65379 - DNA, 329 bp, Triticum aestivum
  Clone ID: PAT_TA_65379
gccaccgatcccgaaccaggaggaacccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcggggg

SEQ ID NO: 65380 - DNA, 364 bp, Triticum aestivum
  Clone ID: PAT_TA_65380
cctcctccgccgccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctcgacttccagctgcaggagggcgggcgcaagctcaaggtggacgcctggttcggcacccgcaagaccatggccgccatccgcaccgccatctcccacgtccagaacctcatcaccggggtcaccaagggcttccgctacaagatgcgcttcgtgtttgctcacttccccatcaacgcc

SEQ ID NO: 65381 - DNA, 392 bp, Triticum aestivum
  Clone ID: PAT_TA_65381
aactcaaaccattcaaaactattaaactgagcgccaccatttctactgttgcttaggggaaaaaatttattttgctctggcccttttctgtttttgaccttaccctgtttctgatctaagttttggtgatgtgtttctcgttaacctcacctttttgctctgttgcctccctgttttctgatctaaatttgttacaaaatctggtggccgcggtgatgtttttctcgttaacctgagatttgcttaccaatgaagacaaactcaaaccattcaaaactattaaactgagcgccaccatttctactgttgcttagggaaaaagaattgttttgttttctgtttttttatcttagtttgttactaaatttggaggctgcggtgatgtttttctc

SEQ ID NO: 65382 - DNA, 434 bp, Triticum aestivum
  unsure (1)..(434): unsure at all n locations
  Clone ID: PAT_TA_65382
tgctaccaccacggggagggggcggtgacgtacggcggcttcaccgtcgcgccgggccgcgcgcccgacttctgcgtgccgtggaagggggcgcgcgaggtgccgttcaggctgtcgtgggactggaacgacggcgttggtctgccggagaacctgcgtggccgcatcgcggcggcggagaaggtcggcgccgtggaggtcgaggtccaggtgcggctcctccggggaggcgacgcccgctccggcacgggcacgccgacgtggatgtggtgcaaggcggggacgggtggagcgcctggagccgtcaccccctgcaccgtgttcgctccgcanaactggttttcgcccctggcctagccgcctccgatgttggagtccaggagccagacgccaccgtcgacgacgacccctacggcactggaggtgcctacttc

SEQ ID NO: 65383 - DNA, 228 bp, Triticum aestivum
  Clone ID: PAT_TA_65383
gccgtccccgcgggcatcatcaccctcggctccctcttcctccccgacacccccaacttcctcatcgagcgtggccacccggaggcggcgcgccgcatgctcaaccgcatccgcggcagcgacgtggacatcagcgacgagtacgcggacctggtggtggcgagcgaagcagtccaagctggtgcgacacccgtggcgcggcatcctgcaccgcaagtaccggcccca

SEQ ID NO: 65384 - DNA, 438 bp, Triticum aestivum
  unsure (1)..(438): unsure at all n locations
  Clone ID: PAT_TA_65384
gcgtgtccccgcgcgccgcccggccggctgaccccatcacgtcgcgtcccccgggcgtccccgcgcgccggccggcagaacgacatgttctcgcaggatcctgtgaccatgctgtacacgtccacgtcgagcgccacgaacgacgactccaagctttcaccagtgaagaaagacgaggcgaagcaagggctgtgggggcttctggcgcancaagccaaggcaatgctcgacgaaagtgcccccacagaggacgcccggagccagcctctggtcacatcagccggcagtccgcaagctcaatcgcggtggtcctacgacccggtccggaagtcggagagccccacgttccagaacggatcggaagggcccaagttcgacatgggagggcacatcaagaatgcgctggaggagggcctgcacgcggcgacgatggcggag

SEQ ID NO: 65385 - DNA, 397 bp, Triticum aestivum
  Clone ID: PAT_TA_65385
gctactcccctctcggatccctctgctcctcggcgcgcaggcaactccgatcggtgagcaatggataaatattctgccttatttgaccatgagcaaggtttaaccgatggaagggccgctaccaaaagacatgaacagaaggtcctatcgctggatgtttactgtccaaatcacaaggatctgggagtacaggagcaaagactttgctgaactttatgagctggacttcgtcgtccttccactacttcctgctcctcataatacagtcctatcgctgctgtggtcgcgcaccaacggacaagtgattccaaaggagaggagcattgcatggtttatatattggagaaaaaggcatacatgcagcactacggattctaaaggagtgttcggttcctct

SEQ ID NO: 65386 - DNA, 251 bp, Triticum aestivum
  Clone ID: PAT_TA_65386
tggtgcggtgaccgcttcctcaccgtcgttaccatggccaccgtcgtcgccgtcgcttcggagcacgtctacgaggtccaccacggtcatcttcgtccgtcccgggctctagctcaagtcggggcggcctgtaccctcgccatcgccatcatctgcatcgtgtacatcgctggtgtttgtcgtcgattctcatcgttcaagtccaccccgaccctctccgacctcgtcctcggctccgcggtgagcctctc

SEQ ID NO: 65387 - DNA, 519 bp, Triticum aestivum
  Clone ID: PAT_TA_65387
aaaagttgctactgtcaccgctgcttgttgaattttaggttgtgaccaatgacttcactgctgctttgttgagtttctagattgtaatttaagaccatatattgaattcatcacgtatttcatgccttgaaacatgctgctcctgatatcaccagaagcttgtgaaaggattttctcctactgtacaatgttgtccttttgccttgtactctgtacagtagtcatgtagtaacgggtgtcaatcaactgaacttccacgagctgaatcggcttgcaaatctgaatactgccactaataattgaaagagatattctgacagttcggttccactcatcgtgcatggatctgtacatttcacatgcaagcacggggatcactctccaactttcacctcctaaagtataccagttccaactagcatcagatgaagtttgaggcttatggttcattattccattgataggcagcattgctgtaagtttataatcagcagcactgtcataagataatcatctgta

SEQ ID NO: 65388 - DNA, 465 bp, Triticum aestivum
  Clone ID: PAT_TA_65388
actatatacatatgtggtcttggacacttaaactgttgtgctaaatagcaagtcgcattcttcaataggcgagagaccgtctcaaggattcagcctttgtccagtccccagatcattttggtgtatccttccatagttccatacttaaattttgttatatttgaagtacacaaagccaatacattcattccgtgtataccttgatggggtgcacgttacttagacgtttacttgctcaagattgatcctgatgatctcgccatcttctgcattttcctggatgatgtccatcagcttgggcctactgatccttagaacctgagatagcttggtcgtccggaaagtgaacggctgtggcttgttgcacagtactccgatctcccctagcagtcctccctcagtcgcctttccataaacctgctctgtcccatctaggaacgccacaatatccacttctccggtcac

SEQ ID NO: 65389 - DNA, 361 bp, Triticum aestivum
  Clone ID: PAT_TA_65389
tttggaattgctattttctccggtgaaaacttttcgctttcgtccgttgtgtgagccgtccgatctctgtctgtagctttcacctgtattttcttagtggttttactataattcttagtcggtttttacattgtaatctttagtggaagttcaatgtaattctcaggagatcttttcactgtaattctcagtgggtttacactgtaatacaactgatatgttgtaattctaattgtttttacagtgtaaatccaattacagtgatattatcagtgggtttacagtgtaattcctcagtggatttacactgtaattcttcgtgctattgtaatgtaattctttagtttttgaaatgtatctt

SEQ ID NO: 65390 - DNA, 278 bp, Triticum aestivum
  Clone ID: PAT_TA_65390
ccaagcacagcatccgtctgcttcttttgctcgcttgcttctctttctctgcgaccagatcctcccaccgtctcgtctcaatggccgccgtctccaccaagtccattgctctcctcgccgcggtggtgctcgtggcgctggttgcgtcggcggcagggaggattgtggagcgggaggaggagttcttcctgggcagcctcgccccctcgctcgccccggcgccggcgccggcggcggtggtcggcgcggcaggcgccgtcgcgcccggggcgtgggcc

SEQ ID NO: 65391 - DNA, 188 bp, Triticum aestivum
  Clone ID: PAT_TA_65391
tctcgctcgctgcgagatcccgcgtccatggtggtcggcatcgtgctcctgctcgaccttgcggcccgtgcgccccgctcctccgcctcgctccactcgcacgccgccttctccgccgctgtcttcgccgccgccgccgcggcagccttgtgcgcctccggcgtaccactctccgcgcggcccttctt

SEQ ID NO: 65392 - DNA, 512 bp, Triticum aestivum
  Clone ID: PAT_TA_65392
ccgcgtctcctgccctcctgtagctggtacacaggatgtcaacctcacctcttcagatatatgtctggtgcattctcctatttgccattgttggaatatccacatctttacctctggaaaaagatgcactcctcgacataaaaattcatttggaggatccacaaaattacctgagcaactgggatgaatctcactcaccgtgccagtttcacggtgtaacgtgtgatgaaatttctggtgtggtcacaggagtatcactctcaaatgcctcgctgtcaggcacaatatcaccatcattttctgttctccaccagttgcgtactttggacctcagtgcaaattccatctcaggcactatccctgctgcactgaccaactgcacaaatttgcaagttcttaatttgtcagtgaacagcttgacaggccaattgcctgatctttcatcattgctcaaactgcaagttcttgatttatcaacaaatagtttttctggtgcattccctgtgtggatc

SEQ ID NO: 65393 - DNA, 335 bp, Triticum aestivum
  Clone ID: PAT_TA_65393
ctcctcccaccttgcaactccatagctgccggatccgccgcatccccacccacccatccctctcgcgtcccatctctctctgcacgcagctcctcgctgcgccacatgcggcggctgaatcaggcgatgtccggcgaattctgttaccgcgaagcacagatcagggtcccctcacaccacagtgtcctctcagccggctagatccggtgctcatggccaccaaagcccacccgcgacctgtcctcccccatggctagggtttccggcatcagctccatcgctggtggccatgtcgtcctcctctcgtccgggagcaatggcatgtggacagcctt

SEQ ID NO: 65394 - DNA, 335 bp, Triticum aestivum
  Clone ID: PAT_TA_65394
cgcttcagcaccaccgtcaaggacgaggagggcatgccggccttcgcgctcgtcaacaaggccaccggcctcgccgtcaagcactccatcggccagtcccaccccgtgaagctggtgccgttcaacccggcgtacgaggacgcgtcggtgctgtggacggagagcaaggacgtgggcaagggcttccgctgcatccgcatggtcaacaacacccgcctcaacttcgacgccctcaacggcgacaaggaccacggcggcgtgcacgacggcaccaccgtcgtgctctgggagtggtgcaagggggacaaccagtgctggaagatctggccctgggc

SEQ ID NO: 65395 - DNA, 443 bp, Triticum aestivum
  unsure (1)..(443): unsure at all n locations
  Clone ID: PAT_TA_65395
gtcactccatgtgtcaaatctcaattcaaaaaggtcaaaaattgttctcaaaacagctggtgttgtactggagcaaatgcgtgataagggccttgctgcattgaaatataaggttattattcttgatgaaatacatgaaaggtctgtcgaatctgatcttgtacttgcttgtgttaagcagttcatgatgaaaaaaaatgacttaaggttggttttaatgtctgctactgctgatatcacaagatacaaggaatactttanagatcttggaaggggtgaaagggttgaagtgattgccattccaaccagtcctcgtacgcgcatttttcagagagaagtcctataccttgagcagattgctgatattctcaagatgaattctgaatcactttcaacaaagtactgctctggggaggatgctgacgctgatgctggtctaaact

SEQ ID NO: 65396 - DNA, 201 bp, Triticum aestivum
  Clone ID: PAT_TA_65396
ttttttttttttttttttttttttttcaaacatcgttggaaaattctgctgacatgctaaggcttggaggtcatacaaatattattattacaccaagcgtaatgtatccactgttgttacactaaggaactgctactttgcagctggccacaactagagcgcggctgcccctttttaaccaatgctttattacgatcatcc

SEQ ID NO: 65397 - DNA, 218 bp, Triticum aestivum
  Clone ID: PAT_TA_65397
ggggccggattggaaaccctatttccaattcctccgtcctcctcttcctccctccctccctcccaacctcaatccgtccgtctcccttgtccaggacaaggacaagcagtcggaaaagagtgattctttggccggcggcgggagggcgccgcgcgcaagaagcggcgattccccccgctgatgcgcgggcgtccggacaccgctgactgccttctcct

SEQ ID NO: 65398 - DNA, 348 bp, Triticum aestivum
  Clone ID: PAT_TA_65398
gatctgaattcgttttcccttgtgtcaaagcagctctactccattgaggcatcacaaaggggtgtcatccgtgtcggctctggccttcaccctgctagaaaagccttggcatcactgtgttcccggttcccaaatttgtggaaagtggaaattgattactctggttggaccagtggccatgggaatcaattgagcaataaaggcctccttgtgatctcatcatgttgcccctcactaactgatctaaccttaagcttctgttcacgcatcaaggattctggtcttggatatctcgtcaattgcaagaaattgatgtctctgaggctgaactccatctaaaaaataact

SEQ ID NO: 65399 - DNA, 372 bp, Triticum aestivum
  Clone ID: PAT_TA_65399
gagtgggctcggaaagccacggctcacgagttcatccaggagggcgcgtccgtggtcattgccgacgtcaactctgcgttgggcctagagacagcccaggagctcggcccacaggcccatttcgtccactgcgacgtcaccgtcgaggagagcgtcgccgccgccgtggacgccaccgtcacgaagcacggccggctcgacgtcatgttcaacaacgccggcatcgtgggcgcgctctccgggacgtcggaggtggccagcctggatctcggccagttcgaccgcgtcatgagcgtgaacgtgcgcggcaccctggcggggatcaagcacgcgatgcgcgtcatggcgccggcgggctccggctccatcctc

SEQ ID NO: 65400 - DNA, 310 bp, Triticum aestivum
  Clone ID: PAT_TA_65400
ccgccagcggcaaaagacacgtattacataatcagaatgcgaacccgagggattaaaaaaaccggccgtccgcgagtattttttgaatttttgtttaaagaccaagacaattatcttattgcgtggaggggcttgaccacccccgagcaatgtaaaaccgcccattggttattttttatagacaccgggatccatatgaatgatgaacctttcaaagatatgggacagaaatgcaattattccagtgcctacgcccatgagctgccagaagtggaaatacacacgacagtgttggaggacattgagatct

SEQ ID NO: 65401 - DNA, 472 bp, Triticum aestivum
  unsure (1)..(472): unsure at all n locations
  Clone ID: PAT_TA_65401
cgagccatggacgacgacatcgacagctcctgctccacccctttcgccagcgcgccgtccagccccggccgctccccttccatcttcngcggcggcggcggcggcggcggctattttttcagtgcaccggccagccccatccaccacctgttgttctcgtcctcctcggccgccgctggtgcccctaatggcggcgggtaccgtggactaagtgacgcggagttcgagttcggcggccctggcgagcacatgatctctgctgacgagctcttccagaacggccagatccggccgctcaccctgtccccgctcccggatctcgaccccgacagcgaagaagatgacagcgaacggcgccacggccccgcgcgcggccgcgagcccacgttccggagcggctccgtgcaccgccgcgcccggtcgatgtccccgatgcgcagcccgtccccgcggctcaagcttctcagtgcgc

SEQ ID NO: 65402 - DNA, 496 bp, Triticum aestivum
  Clone ID: PAT_TA_65402
gccttcccttccgtccctcgcttccaccaactcccaggcctgctgctgaaacctgcttcttcttcttcttcttcttcgtcgtcgtcttgtttgctgtggatatatccgacggggggagatcgaccagatgactggctgcaacggcaacggcaacggcaactcgtccgcatccaccatgggacagcagacggtcactgagaagaagttcggaggaattgcaccaaagaagcctctgatttcaaaggtacgcaacagcgcgaacgttcatcatcaagcttggcttccaacacactcaatcgccatggacttgtttcatcacagtcgtttcataaacaattatagaagaggctgtcgcactagtactaccactattgttttctgaaactaatacacgagttatggcaatgagcgttccatgagcctgaagaaatgtattcagaatgaggatctgggtatatttgtttgcattgattttctattctactactgctacttc

SEQ ID NO: 65403 - DNA, 310 bp, Triticum aestivum
  Clone ID: PAT_TA_65403
agcaccaggttgcgttttgcccttggagctgctacaaatgcgcaatccatcggcacgttccgttctggcacagcaacccgacgcagcatcaaccgaccaaccaggcgcagcgtcgccgatccagaccgacaaacgcgcgcgctaaccctccgtagcagcagcagcagcatggattccggtaccggcatgggctccggaaccggcgaagcagcgtggcgctcgcgcgcggtgtgcggcacggagtacagctggtgccgcgccgcgccgggcggaaccggcaccacgctcatcgcgctccgactctcgcgcg

SEQ ID NO: 65404 - DNA, 517 bp, Triticum aestivum
  Clone ID: PAT_TA_65404
gcgacgctcctcctcccctcccacacggccagccaccaccgcgccgtcttctccgggggcgcgcaccaccacctgcttctccagcgggaacttctcagggacgccctgctcgcgccgaggcgcaggccgatcgcggtcgcgtgccgggcggcgtcagcggcggccagggccaaggctcccccgagcgcatccccgccgccgcaggcgctagccaaggaggcgcacaagtacttcgaccacgcggtcgtcagcgtgcgcgcgggggacggcggccacggcgccgttctcaacatgccgccgggctcctccgcggacgcggccacctcgaagccccgcggcggcggcagggccgcggacaagggaaaggccaagaagggcagcgggaagaaggtgtcgttcaagcggaactacgacgggtccgtgtcgctgcccgtgggcgggcacggcggcgacgtggtgctgtacgccgacgaggcggaggagtcgctgctggggttccacgccaaggcccggcact

SEQ ID NO: 65405 - DNA, 397 bp, Triticum aestivum
  Clone ID: PAT_TA_65405
aggaaggtgagttcgtgggtccttgtgtgtatgttaactattttgtttgggccaagccgaaacaaccaactatctgtaaaagtcaccaaacaaaaatgcccaaaaattaaatacataaaaatagtttaaaagtgcccaaatttcaaaaaatggtaactattcttcaaaaggtgttacattttgaatgaaaacattaacttttattaaaaatatggaaaattccacattcaacattattatgatagtttatttattaaaattggatataaaaaatgacatgaagcaggttgtgccatttttatcacccggtgcgacccacgggcatttgtactactctctctattcatttttgcaggtcgtttcagataactcaaaatgcgttgttttgcatattgtt

SEQ ID NO: 65406 - DNA, 606 bp, Triticum aestivum
  Clone ID: PAT_TA_65406
atccgcacttccccatctacgtttcctccgcggaggacgacggcattacgttcctcggcgactcgttcgaccccgaggagatgcagatgcaggaggccatcctcctctccatcgagtcctcccgcgccccagccgacatcccgacctcctcctccgcctcctcctcggcgtccccgtccgggcccgacgtcgccggcacctccgagaaatccaccgaagagtcccctcgcgaccgcaaggggaagcgcaagttgttggaagatgagccgagcggttcggggaagcggcggaagcgcaaccgcttcaggtgcgccatctgcatggagaaggttcaggtttcagagcagtttatcgtgagccactgttcgcatgccttctgcaatggctgcgtcgggcggtacgtcgccaccaagatcggcgagaacgtggaatcgataggttgccctgaccctgaatgcacagagggcttcgttgagatcgagccatgccgagatatcattccccaggagcttttcgatcgctggagtgttactctgtgcgagcagtccctagggaatgagaagtactactgccctttcaaggattgctccgcgttgctgatcaaag

SEQ ID NO: 65407 - DNA, 426 bp, Triticum aestivum
  Clone ID: PAT_TA_65407
cttccaatcacagttgttgtccttttattaggaatcaacgagaaactctgtttcttaaacaattctgcagctactacttaaactttgcacactttggacaacacatcatggactaataaagggaccacaaaagtacatattcagtaaaccaacattcttttattttgagcagcctatattcatttcagcaaatgatttaagtgcctgcaaactctttttctttttgttggatcaacattttttctgaaaccaagcagcatattaattagagtactgttcagttggtatacattctcataactattgattctcactgtctagcactagtacacactacacagaacaaacatgtacaaaaaaacagaagacagtatgcattaccactggattgctagtgattaccttcaattttttaatgttctattt

SEQ ID NO: 65408 - DNA, 564 bp, Triticum aestivum
  Clone ID: PAT_TA_65408
gtccaccctcccactccctcgctcgcactccgcactccgcccgccgcgccgggacatggccgcgaccgccgacgacgcccgccgcgccgccgccgtcgccaagtaccgcgccagcctcctcgcctgccgggagcgccagtccctcctcaccacaggggaagagaacctgaagaaggctaggaaggagcgtgagataaccgatgagcatgtcaaggcgtttcagtgcgttgggcagatagtgggagaggtgctgcgcccgcttgctggcgaccgctttatcgtcaaggttaggagtggtcctcgataccttgtcaactgtcgcaataagttgaacacagagagcttgaaaacaggcacacgcgtgtgtcttgacccgagcacacttacaatcgtgcgcatgcttccgcgtgaggtggaccctttagtgttcaacatggttcatgaagatccagggaatgtcagcttctctgctgttggaggcctatctgaccagatcagggaaattcgggagaccatcgagcttccgctcatgaacccagaactgtttctcagagttggtattaa

SEQ ID NO: 65409 - DNA, 508 bp, Triticum aestivum
  Clone ID: PAT_TA_65409
tctctgcatggcggtacaactacaaacctgcttcacgacgtcgtccctgcactgaaaaaagcttcgagcttaggtggtcgaggccggcggtggtgagtgagtgcgggggctgcgagaatggcgggggtttgtgcgtccacaagcgggaggcgggaaagaagtcttggacgttcacgtgtgtgacaaatgctagtgccactgcattggtcgtcgcaaccaaatctccagttaacaaagagggtactgtactgaagattgcattaccaataatggctggtcttttgattctcacatgtgcatcttttgtatgggcatacaagttaagaggtgaacggagaatcagcaatattcagaacaatgctacgcgacaacccttggacatattcacgctcaatgaacttgagataaatatagagcttccgtcggttagttttgaagagatcagtactgcaacaaataatttctcaaacaacaacatgattggcagaggtggttttggagtagttta

SEQ ID NO: 65410 - DNA, 393 bp, Triticum aestivum
  Clone ID: PAT_TA_65410
gacatcagcaaaaactttctggttggtcaaatacctgccagtttcaaagacctcaagagcttgaaatttctctcgttagctgcaaacaatatcactggtcagataccgtcctctttggggcagttgaaatcactggaggttttagatctgtcatctaattctctctctgggaatatccctagtaatattgtgacactgagaggcctcaccacacttctgctgaacaataatgagctctctggaaacattgccgatcttaccccttcagtatcatcaccgtctgtttttaacatttcattcaataacttggctgggccgttgcattcgaatgtgcgagcactcagtgagaatgatggtagtccagaacctgagaatacacccagcgatggtgga

SEQ ID NO: 65411 - DNA, 188 bp, Triticum aestivum
  Clone ID: PAT_TA_65411
ccgcacccgccgccgccacatccccactccccaccaccccctcagcctggcggtcgtcgagccggtgcccgggggcgacgtgaagctattcaaccgctggaccttcgaggatgttcacgtgagcgacatctcgctgaacgactacctcgcggtgacgtcgatgaagcactacacctttctgccgcact

SEQ ID NO: 65412 - DNA, 350 bp, Triticum aestivum
  Clone ID: PAT_TA_65412
ccctcgcctccacctcctctcaatccagagcagcaatcgagtgcccgagctcctcctcttgcgcctctgtgctcgattcccttcgtcctcgccactccttcgtgcacggcaatccgccgcagcaccggagctccctccaccgctgagcaccaccagcagatgagcctcgcgccgccctttcttcctttccatcgctctttatctctggctcactggactccctctctttttcttgtaacagcgacgccgccatcttcttcccggaggaggacctcgacaagaacgccgcccgcggtgccccgatctttcccggcgcgaccccgttccgctgacaccccctgcgtcatgct

SEQ ID NO: 65413 - DNA, 393 bp, Triticum aestivum
  unsure (1)..(393): unsure at all n locations
  Clone ID: PAT_TA_65413
cgacatctggtagttccagttctgtgtctgggatgtgtngaccgaaccacaaattttacaaataacaacagatattccactggccaagtatcatcgtctctacagtacagagaatgcaaggaaatgttatatacttggagtcacccaatagagcaatcagatcagtcaaatattacagctggaggccatgacttgtactctggtaattgtgtcactgtaagagaggcagtggggagagctgaacagacatcaaatagcactgtatcaaagccaaattcacctgcttcagatgaatcttctggcaagcatcatccggcaaaacgattaaaggttaattaccccattcctgtccatgccgatgaaacagagtttccaaaggaacaacagcctgct

SEQ ID NO: 65414 - DNA, 288 bp, Triticum aestivum
  Clone ID: PAT_TA_65414
cgacggcatcccgctccccgtcgacgggcacggcggcacctccttcaacgtcatcaacgacgtcattccccgtgtcgtccagatgatcgaggacaccaccgagcacgtcctccgcttcgaggttcccgagatgcttgagagggaccgattttcgtggttcagagacgaggagttcgcaaggcagacgctcgccgggctcaaccctatctgcatccgccgcctcacggaattccccatcgtgagcaagctcgacccggcggtgtacgggccggcggagtcggcgctgac

SEQ ID NO: 65415 - DNA, 504 bp, Triticum aestivum
  Clone ID: PAT_TA_65415
ccctcccgaatctctctctcctcccctccctaccattgccccccgctccctccccctcccccacgacacgcacagatccacccgcggccatggcccccgcaatgaggccggagcaggaggcgagctgcaaggccaccgaggaccaccgctccgagttcgacgccgccaagccgccgcccttccgcatcggcgacgtccgcgccgccgtgccggcccactgctggcgcaagagccccctgcgctccctctcctacgtcgcccgcgacgtcgccgtcgtcgcggcgctcgccgccgccgcgtggcgggccgacagctgggccctctggccgctctactgggccgtccagggcaccatgttctgggcgctcttcgtcctcggacacgactgtggtcacgggagcttctcggacagcggcacgctcaacagcgtcgtcggccacctgctgcacaccttcatcctcgtcccgtacaatggctggaggatcacccaccgaacgcaccatc

SEQ ID NO: 65416 - DNA, 434 bp, Triticum aestivum
  Clone ID: PAT_TA_65416
ctcctgtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagattccagctggcattccaggtagccgggcgaacaactactaccgtgcagatggccagaacacgggcaacttccttacggaccgtccttcaaccaaggttcatgctgctcctggcggtggctcctccctgggctacttgtttggcggaaagtgatgttaatgatgctgcttaatgaacgaacgatgaattggcctgtatctctgttatccatgtggtgaaaactggaagtg

SEQ ID NO: 65417 - DNA, 502 bp, Triticum aestivum
  Clone ID: PAT_TA_65417
cacttctggactgctgcttcaagatgagtctgtggcgttcacaggcggttcagatggatctgtaataaggtatgacttgaattcaggggctcaagatacagtgggtctgcatgacgatgtggttgtcagcactgagttctcccagattactggtcaattggtaacttctagccttgacaaaaagttacttttctgggatacacacacaagaagtgtaaaccctaaccacactttcatgttagattcagtggtggtatcactttcagtctgtggcatgtatatattagtcacagttgagaatgatgtttactggtatgacatgaggaatttaacagcttcgattaaggcaaaagattcccccctgaggcatcatatacggtgtctttgtgcttctgcagagtggaacggttacgcggctggatctatggatggaactgttgcgttgaagtattttgaccataaagtagacaatgacatgggatatacatttcgatgtcaccca

SEQ ID NO: 65418 - DNA, 633 bp, Triticum aestivum
  Clone ID: PAT_TA_65418
aaaaaagctcgcacatacgggaacgcctgatccaaatcgaatcccctccttacggagaaacccaaaatccagagaaaagaccgcgcaaatccggccagatttggccctcgatctcgcgcgtggtccaccgggaggtttcgcgagatctcccgcgggttcctccagcgcttggtctggcgccgcagagggcaggatgagctcgcggataaaggagatggtgcgggtggccactgcacggctgggcggcgagccttcgccgcgggcggggccttctcagcccgggcgcgcggagtcgtccaggacggcacggctcggcggcggaggcgccagcctccggcggcagccccaaccgcaagcgcccaccgtgcgcaccatctactgcaacgaccgcgaggccaacgcgcccgtcgcatacaagggaaattctgtatcgactacaaagtacagcgtattgacatttctacctaaaggattgtttgaacagttcaggcgggtggcaaatctttacttcctcatgatttcaatcttgtcgactacaccaattagtccagtccaccctgtcaccaacgtggttccccttagtctagtacttttggtgtcactcatcaaggaagcttttgaggactggaaacg

SEQ ID NO: 65419 - DNA, 570 bp, Triticum aestivum
  Clone ID: PAT_TA_65419
aagaagaagcatgtcatcaacaccctcatccatgcatcatcccagcgagtcgaccaccgcctcccccctgctgcaacaacaacgggccgcgggcgcagcacaaccaggggacggtgccctgcccaatgacgagctggcccgcgaacgctagctgcgcgaccattgccatgccaacagcttctgcttcaaatgcggagatcgttactcgcgcgagcactggtgcaagcaggccacacagctgctcacgatccatgtcaggtactatggagaggtgctcagcgacgacgcagtccatgccctgggcttgcttgactcgccagcaccacaagacccggcgcatgaatgttgtgtgctttccacacatgtcgtcgcgggcacggagtcactactttcgtgcgctcgtcggtaatcagatcatgttgctgttgatggactccaacttcatatccatggctttcacagattgcatcaaggccaccactgtcgccatgccggcggttgaggtacggtagccaatgggaagcgcatgacctgtaacagcatggtccacaggctgcagtggtggattca

SEQ ID NO: 65420 - DNA, 349 bp, Triticum aestivum
  Clone ID: PAT_TA_65420
cagccagcggcgcatctcgccgccgaagaatccgcagttcatcaacgcagtccgcagttccatctctctgccacctcccacccgccttcgccttgtgcgctatcgagctgctacacttcggcacttcctctgataatggtgtccagcctgaatgggatgtctgttggatattcgcttgccgacaataccatggagtcccctacgagatgaagcaaatctgtagattattgcaactatcagaaatgggcaagcgcttgcggcagggcaaggacacctccaggacatattgaaaagccctggcagtacttcaagttgtgcaaatcacttcagccatgtgatgtactccctc

SEQ ID NO: 65421 - DNA, 161 bp, Triticum aestivum
  Clone ID: PAT_TA_65421
gggtgggtaagcaaaagtgttctttgttctattgcgagataataatccccttcaaaccaatggtttttgctgcttatcttttgctgcaagttgtgctctgcaattcattatagtaattctgactggcaggtgaaatgtttctgaccattgtgacataactg

SEQ ID NO: 65422 - DNA, 319 bp, Triticum aestivum
  Clone ID: PAT_TA_65422
cagtccaaggatgcatagcctgcggcagctgcctaaaccaatcgccaaattcgatccgtcaccgtccggcctgtggatcaatgacggcctggagtggttcgagctcctgggcccccgccgcagcgaaagcagggtcgtcaacgccaacgtggccggcgacaccgtgctatacgacgccgacgagggcatcatcctcaacttgccttcgctccacgagcccaagggaaccaaccccgtctgcctctcaatcacccaccccgacgctgaggaagacgctctctatgtcatggaccgctgtcccggccgggcccttgcgcgg

SEQ ID NO: 65423 - DNA, 183 bp, Triticum aestivum
  Clone ID: PAT_TA_65423
ccatcacttgtaatcattcttttggggtgtgcgccgcatgattatacatacaactacacgccttcgggatggcaactgacgaccagctaactcccgccagttcactaccaagtcacgacaacgatagtcctatcttcaaaccgccaattgcctcgaatcggccaggaggcacataatacatgt

SEQ ID NO: 65424 - DNA, 490 bp, Triticum aestivum
  Clone ID: PAT_TA_65424
ccaaatgtcctggatcaggacaactcctgggaaacaaggcgaacggtatgtgcgtgcaaaattgaaaattgtactagatatgtgtagtttgctccaggatcctatatcagtgtatttgcttcgtgcagttccctatgtcatccattatatttatatagggataaatttccacgggttgttgtaagcaaaactccctatgtaccggcacttgtctctttacagactgtccgggctttctagattagaatataattgttttagataattcgaaataagtttttacgccagcttgcacctttattatttgcagccgggaagtctatttcttttcttttttttgattcaaaactattggcatgaattggcccttgcatttggtctgagcacttacaataattccaacctgtcaattggggacagatatgtccatcacacctgtaccttttattcagtttgaggaggaataagtagtcaattggctgattaatta

SEQ ID NO: 65425 - DNA, 441 bp, Triticum aestivum
  Clone ID: PAT_TA_65425
gtcgtcacttcaagcaggagcgcgagaacgtctggaaggacaaccccaggcgccctcccgcctccgccggcgaaggaggcgaggggaacggctggcagccgttcgccacggagaacctggccttcgaggcctactacaaggggcagcaaattgttcctgaggaagagtgggatgccttcatgagcatgctccggaagccattgccagccgcttttaggattaatgcgagctctcagttttgtcaagacatttgttcacaattagaaaatgacttcaggaagtcgttagagactgaggtcaatgatgaccatgaaaaagaggctattcggcctttggcttggtaccctggcaatcttgcatggcatttgaacttctctcggatgcaactgaggagaaaccaggcgcttgagagtttccatgaattcttgaagcaagagaatg

SEQ ID NO: 65426 - DNA, 330 bp, Triticum aestivum
  Clone ID: PAT_TA_65426
caccaacaccgacgatgagctgagacagcgccctctcgccaggcacgcccttgacctggacggcaccgctgagcccgtggccctcctccccaggtcaccggatccagccaagatccacctcgtcctcccacatcggccaccatggtcgtcctcctctgcacccaaggtaatttggatggccccgtctctcacgaatacaatgagccgcgcgcgctaggcggagcgaacaaatccaaccacatgggtggcggtggcggcagtgggaccgaagaagtgacccgcgtccggcggtctggagcatgctgatggccgcgacggggacggccccct

SEQ ID NO: 65427 - DNA, 343 bp, Triticum aestivum
  unsure (1)..(343): unsure at all n locations
  Clone ID: PAT_TA_65427
gtgggtgaagaagtatgtctcattatcatcagaatatgaatatgctcgcatttagcgtctcaccaatgaatatatattatatgcgagcttatttatcccctcaaaaaaatatgaccttatttttattttaatattgtttatacatgtccacttttgagatcagagatgaaaactaatggcttccaatgatgctttgaaaatgccgattgacaaagctttatgaagaaccggactgaaaaattgtcttgttttaacaatcanaagagatgcatacacataattattctttatatatttcttgtgcatgataatacaaaaggggggtttctatatatattttgtt

SEQ ID NO: 65428 - DNA, 413 bp, Triticum aestivum
  Clone ID: PAT_TA_65428
cccctctttctctcccgatcccatctggatcggggcacctgagcccgccgccgtcgttcgaccccgcggcgttgcccgtcgccgtcgcccggggccacctcgtcggaccaccgcaccgccgcctccgccccgcaactcctccctccgtgctcgtgccaccgtcctcggccaggacctggccggatctcgcgcctccatgttctgcagcgctcatcccggacccccccctgcatggatccggtcggggccaaccgccactgcctcaacctcaacgccaatcgtcgtcgccagaccatgccgtcgccgccaccggactgcctcgccccatcgcctcgtcttcgtctcctccccggcgtcatcatcgcacctcgccgcccccctagttcattctacaacgggggaccccgagacca

SEQ ID NO: 65429 - DNA, 322 bp, Triticum aestivum
  Clone ID: PAT_TA_65429
tgggccaatgaagggtttcttaggggccaaaagcatcttctgaaaatcattaagagaaagaagagacctcaggaagcaggtcgtgagttagagaaggcacctgtcaaagctgcacctggtactgaaaatattgaaataggaagatatggcgggcttgtaaaggaggtggaaacccttaagaggggtgggggtgttctcatgcagcagcttgtggatctcacgcactaccaacaaagctctaaccttgaagtccagagtttgattcaacgccttcaagtaatggaacagaaccagaagcagatgatggcacttctatcaatcg

SEQ ID NO: 65430 - DNA, 266 bp, Triticum aestivum
  Clone ID: PAT_TA_65430
tgctggggtttggtgactggtacatactacatccatcgtcatatatcctttgcctcctttccagtgccaacctctcgctctcgctcctctgatcgtcgatcacatggcgtcctcctctgccgctctcctcgcgctgctcgtcgtcgtgagctgcgccggcatggccgcggccgtgtcatacaccgtcggcgacgagaagggctgggtgaggggggtggactactccggctggactagcggcaagtcgttcgccgccggcgacacgc

SEQ ID NO: 65431 - DNA, 191 bp, Triticum aestivum
  Clone ID: PAT_TA_65431
gaccctgccaggcaagtcgattgggacaacttccagcaatcttctgatatcgtggatgtcttgagcacaatacatgcacaagttcctaatggcatcgttctcggagactatgtcattgaatatggggatgatgatactggagatgactatgaagtgctccgcagggttaggaggaagtggtggtcttttat

SEQ ID NO: 65432 - DNA, 526 bp, Triticum aestivum
  Clone ID: PAT_TA_65432
cgccgccgcctcctcttcttccctagaccatgcctcctccccgctcctcgttctgccgcctcctgctgctcccgcacggcagccgtcttccatccggcgtatcgcctagcggagcaaatggcggatctgccacctctctcctcgccggtaaggagaagccagactggtgctggggagagccggagacggggacaagaagcagtagctagtggtcggctcctgctgtggtggagtggagctgcagggagaggaaggaggccggcgacaggggaaaagaacatgtcggctctggttcgtcatggagaacacaactgctcgccctcctctgcctcttcttctctggtccatggattcgttgtgggtctctattggcggtgttggggattgtaaggcttgttccatctggttttaggagcgtgtgttgctcctataaaattttctcaggtttggcagcaaatcaactactctgaatgaggccatccacagcttctcacgagtaacatgcttacgcgaacacgttgatcca

SEQ ID NO: 65433 - DNA, 254 bp, Triticum aestivum
  Clone ID: PAT_TA_65433
aactcttctccgatccacggcggaagcacaagcaccagcaacatcacagcaaaaagagaatttcaatatggcgctgccatcatcagccgtggtgccgccatggatggagatcatgtcgcggatgcctccggccatgctcagattcgagagatccggctcagacggcacgaagctcgatttcttgcccttctacgaacgaagcagcggtggtgctagcaagatcctctgcctggatgcatcgggtcgctccttct

SEQ ID NO: 65434 - DNA, 343 bp, Triticum aestivum
  Clone ID: PAT_TA_65434
aatgttgttcagttttaattaaaacagatggacaaccatgtaaaaggtaaagatgtttatggaagaataaacaccactcagactagcgagttccaacttgttttttctagggggcattagcaaaatataaatgtgaatatgacagtacatattttatgatatttgactgtatgtcatcacctaaatttatactaatccagcggaataacccaacaaccatttagattatgcttctttcaaccaaattacttattgacatgtatatttattaagatcaataatgtcgtgtattttactttgaagtataaacgaacatgaaaatatgagatagtggcctcctact

SEQ ID NO: 65435 - DNA, 180 bp, Triticum aestivum
  unsure (1)..(180): unsure at all n locations
  Clone ID: PAT_TA_65435
gcggcgtcggcgtcggcggcggcgggcgatcggcggggcaagtccacggcgtccgtgcaccggccgggcgcacgggcactgacggagcagctgccggaccgactggtcaagctgctcttangatgaggtcctccaagagtaatgggagcgtgcagaaggcggggagagttaaccatgccc

SEQ ID NO: 65436 - DNA, 280 bp, Triticum aestivum
  Clone ID: PAT_TA_65436
aagattgtgccgtgtaagtaccgctggccgtccacctacagcgcagtcggtcaggctcttgcctgaaagagacgtgctggacgggctgccatagcttcaggtgttgcccaatctccgtggatcccaagcatcccttggatgtgtcgtgcccatgtgttgcccattatgcccttccgcaccattcttgatttgcgtcatcgcttggggaagagaaggtcaattgttataatgacccactgacatgagtgcgtgacattggcatgaactattgaatttactt

SEQ ID NO: 65437 - DNA, 466 bp, Triticum aestivum
  Clone ID: PAT_TA_65437
tccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttggtgtgcgatttaccaacaaggatgtcactgcacaaattgtgtatgctaccattgctggtgatatcgtgatggccgctgcttactcccatgagttgcctcgctatggtcttgaagttggcctcaccaactatgctgcagcctactgcactggtctgcttttggcccgtcgtgtgctcaagaaccgtgatcttgatgaggagtatgaaggcaatgttgaggccactggcgaggacttctctgttgagccttctgatgagaggaggcctttccgtgcgcttttggatgttggtctta

SEQ ID NO: 65438 - DNA, 668 bp, Triticum aestivum
  Clone ID: PAT_TA_65438
tgacatcagaaactttagttgcaacggatcctgttttcggatccaggatggcatttgattcagagtttgccaatcagcaatcttctatgtactcacaacccactgatgaacctatctggagtggaatacttaagataaacaacgaagtatatatctcgttgactgcacacctgtcgaccacagcttgtgggtttgtgcgggaattctcaaggtcgttgcaaccagtagttaaagtaatcaagctccctcggttggaagcctggccagagagttggaggacatcaaggcctactgatggcgacattgcattgtatttctttccgcccagtgcgagcccaaatgaagaatcggatgggccagtggaggaaatcattgatagtggtgctgtcttacaagctgttattggtgtcgctgagctgctaatcttcccctccacaatgttgccagcgcaatatcatttgtgccagggcaaacgctacctgtgggggatgttcaagcgtagggaagatgagtccgacagtgatcatctagttgaagaacaagatggttcagcatgtgccaaagtaggggagatacaagaacacatttttatggaccggcaatatgaagtacaatgtgtttcaccagatcatgaaacttcggctgtgaagcatgtcgtgcatgttgag

SEQ ID NO: 65439 - DNA, 148 bp, Triticum aestivum
  Clone ID: PAT_TA_65439
caccggcgcggcgaggcggccaccgctgctgtctcccccctcttcctccctctccgcgcgatagggtctggtggagcggattcgtcccgaagtcgatcgaactgattcgttcgtaatggcgaacctgcagccttccgtccccgagccc

SEQ ID NO: 65440 - DNA, 348 bp, Triticum aestivum
  Clone ID: PAT_TA_65440
ggtctcggactggatggaggaggggccgggtctggaggcaatgtgcacgacgaaatgctgcaccagcatgcggacgggtcatggaagcggcgcaagggcgtatcggctcggctggctgactacgtggctgattcatttatcgacagtgatgatgactgtgtggtgccggcgaaagggggtgcgagcacgctggccgtatcggcggccgattacgtgcctgattcggagagcgacagggaggatttcgtgctgccgggggatcgtggcatgaaggtactggcaaacttgttcactccttttaatctgactgaaccgaatgtggtgcctatgggttcgcatatcaccggc

SEQ ID NO: 65441 - DNA, 341 bp, Triticum aestivum
  Clone ID: PAT_TA_65441
cgcggtgaggtggggcaatggcggttgtgccgcgaggcaaggcaagtgcttcatataccgtgcatggcgaagcgcgacagtggcgtctcgggcgaacattgaggacgccggagcagaagacgacagctcctgccgtcgcttctgttcgcgcacgcccgcgtgctcgcctccgtccgcgcccgcgccggagcgctgctttctacgcgcgctcgcgtgctcgcctccgttcgcgcccttcagctcgcctctgcccgccacgcccttcagctcgcctccgtccgcgttctgccgcgtcccaaccgcgccgggagaccgcctctacctgccgtgcttgcctttgc

SEQ ID NO: 65442 - DNA, 426 bp, Triticum aestivum
  unsure (1)..(426): unsure at all n locations
  Clone ID: PAT_TA_65442
tggcatcagcgtccatggcgacgccaccccgggaaccctcctgcacacctcggcatggttcgtctgtgccacatggtggccaagatgctggagtggatcaagagcggaccgtagcagcaggagcaaggatctggtggtggttcatgatattggactgcattactaaatgttctanggttggagagaacttaggtgagtgctcaagttctatgtggataacaataacaaaaaataaatagaaatccaaatctctaaaaaactgacggaatcatgtatatatatttttctagaatgtactctttctgattcctattgtgagatgttcgtttgtatgctattttcttccttttgtaatttcttttctttctttggtgctgcttgaagtgatattttgatattcatttttttctgaaattacaagtcagt

SEQ ID NO: 65443 - DNA, 415 bp, Triticum aestivum
  Clone ID: PAT_TA_65443
cctgtgttgcccgtctcgtctcccttgcacgatctgacacgaaattctcgtctctgccaaacacaaccatacatacgtttccatggcgatcagcagcagagcagcagcctgtgccgcgctcgccttcccgagcaccgccgccgccgccgcgccaccctcgagcgtctccgtgaaccggagagctcggccgaggaaggcgttggcagccgtggcgcgcgcgaccagcgctggcggcgcggtgctggacccgccggccttcgaccagtcccagctcgacaccctccccccagcacaagaaggaggagacacggggaggctcaaggaccgcaagggcaccggcagcggcgacagctacaaggtgctgctcctggacgacccgcgccacaccgagaagcacgtggagacggcgctgccg

SEQ ID NO: 65444 - DNA, 208 bp, Triticum aestivum
  Clone ID: PAT_TA_65444
tctggttccctccccgagagctgcactccccccaaaactcgctcaaataaaggagaagaaggcccccacacttaattctgaacctggtgagcaatctagtgatatccccgaacaaccccctggctgtcacacagttaaagctcgctcaaattgagaagagggctccaagagtcccccgtccaccacccacagcatcggccactgctgc

SEQ ID NO: 65445 - DNA, 417 bp, Triticum aestivum
  Clone ID: PAT_TA_65445
gccgcctcccacaccgtctactccttcccccatctcatcactagagaacacaagcaagtgggagggaaatcgaccgtgtaggtcagatccatccgccacgacctcggcggagatggccaagtggatggagcggacctgcaaatcttcatccaagtagcctcgaattgccgcgtgcgacgttctggcctaggtccgacgttccccatttttctggtttgggagtgatgcggagagccagcagcaggtgaggcagagatgcctggggctgggaggcgactggagctggaagagggtgctcaagctcgtgctcccctgccagagcagcaccggtcggccgtctacaaggtcaggaacacgaggtcgagatggcgacaacggcaaggaggatgccaaggcggccagggcgtggccggctgc

SEQ ID NO: 65446 - DNA, 487 bp, Triticum aestivum
  unsure (1)..(487): unsure at all n locations
  Clone ID: PAT_TA_65446
caacacccacatccaacaaaaacatttttaaactcatggggctgcagtacaaaatcttctacaagcctggcatcaccaacaaagctgcagatgcactatcaagaagagagcatgaccaggaggtttatgccatatctgctgttcaaccaaaatggctcgacaccgtgatagaaggctatcggctagacccaaaagcacaacaattgcttacagaactgagtttgagcaacacaaatgacaaggggttttccctggtgaatggcatcattaaatacaaaaacagggtttggctgggcactcacaaagcagctcatgcagcagtgctgttggccctgcacagcagtgcaatgggggggcactctggttttctggcaacatatcacagaatcanaaaactctttgcttggccacacatgaaggaggacatccagaaatttgtgcaaacctgtgaggtatgtcagcaggccaagaccgagcacaacaaatc

SEQ ID NO: 65447 - DNA, 236 bp, Triticum aestivum
  unsure (1)..(236): unsure at all n locations
  Clone ID: PAT_TA_65447
gcttggtgaagtcgctggtttcgtgtgatcaagagctcgggtatggagttggagatggtgagccagcacggggcgctgctgaaggtggggctgttcgtgctggtgcangcgctggtgtacctcatcctcgcccagtcctcctccgtcttctgccccaccnagaccctctgtctgcccccggcgcgctccctcagcgcccgccgcatggtcgcgctgctctccgacctgccgctgcc

SEQ ID NO: 65448 - DNA, 235 bp, Triticum aestivum
  Clone ID: PAT_TA_65448
atgtatgtgcgcccttcatgtttgattagtacatgcatgtttcacctgtcctgtatggatagattgctgcttgttaggcacgatggtgcatggacatggtttggtcacatggaaattgggatgggaattgggtaggcaggtcggcacgaatggttggctgttgctgccctgtttattttagtcagaggatcatgtctgatcagcggcggagccagctcggccggtgagccggggc

SEQ ID NO: 65449 - DNA, 382 bp, Triticum aestivum
  Clone ID: PAT_TA_65449
gtacaccgcgctgcatgtcgtcggcgacctcgtcgcgctcgtcgactccctcggccagaagcaggtcttcgtggtggcgcacgactggggcgccttgatagcctggagcctctgcctgttccggccggatagggtgaaggcactggtcgccttgagcgtcgccttcaaccctcggaacccggcggtgaagcccgtggacgccttcagggctctgtacggggatgactactacgtctgccgcttccaggagcctggagcagttgaagtggaatttacgcgccttggtacagagttggtgctaagaaagtttttcgcttatcgaactcctggcccacttttcatcccgaagagcggatggggctcaccagatgaggaggtgccc

SEQ ID NO: 65450 - DNA, 393 bp, Triticum aestivum
  Clone ID: PAT_TA_65450
acaaacagtgtctcaggcacacaagctaaaggcttcaccaagttctgggaaagaaaagtttccctagacatgtggcggtggctgtcaagacaagagcggcgctgtgagcgacagccctcgatcgtcttccttgtggaatcaggtacgcgtcgtccatcatgggtgttggcgggtggccggaggcggctacatcaggccagtgtccgtgatcaagactgacaccgggaaggctgccgttgtgcactcaattcaaatgattattctccgttctttgcctcagaactacatatgagaggtacaaagggttggccaagatactcaattaagctattcgatttaaggtcctttgctgatgttggttgtgtccttgctgcttggagagggggtgagggc

SEQ ID NO: 65451 - DNA, 377 bp, Triticum aestivum
  Clone ID: PAT_TA_65451
cctcctccgcccgccgggacctgctgcgacgagcttccaagctccccttgcgtcagctagccttctcctccgcttccaacaaagagcaatttacctctcttgcgcaccatcagttgcccttgagcaatcgccccgccggccgccggtccttgtgcgcccaccagatgcttgtgatatttccgtaatggccttcgcaatgagcctagcctcctgccccggcgcgtcgctgcaggcggcgacggacaggccgtccagcctcggctccccggcgccgcggccgcgacctgtaccgcgctggcggtggccacgcctccggccgtccgcgttcgcctccgaccagcaggcgcttctggccgccctgcgcgagcaggcggacc

SEQ ID NO: 65452 - DNA, 360 bp, Triticum aestivum
  Clone ID: PAT_TA_65452
ggcagccaccggcggtggcggcggccaggagcccctctcacaccctcaggcaggagcgttctacgtgcggagaggcgcccctccggcaggaccgccggctcagctcacctctgaacactccgacgcggcagcccggaccgcctctcacacccctcaggcaggaggagcctttgcgtgcggcgcgacggccttccggcagtcctgccggcccagctccctctgcgtgccgcgcgtcgtccctccggcaggaccgctggcctatctcccctctgattttctaacgactctctcgggctgtgtcccccttctcgtgcccagctcccctcccgttcccgacaagacgcatctgcctttcgtggg

SEQ ID NO: 65453 - DNA, 137 bp, Triticum aestivum
  Clone ID: PAT_TA_65453
ctgctgctgctccatcgtcttggccgccgacgagcaaccatctctgctgctgcatcatcgccttcctcaccttcgtccgttgtccaggtgccgcaacagttggtccatgttgcattccaatattatttccatttctc

SEQ ID NO: 65454 - DNA, 497 bp, Triticum aestivum
  Clone ID: PAT_TA_65454
tctgttttggtaaccgctcgagatattcggttaccgcgcggttaccacgtttatcgctcccccacgataaacactcataccgagcaaaaaatcccgatttttttgaaatatttgaattcaaacgatcgccttgtagttaaataagctgcatctgtgttttaaacagagaacttatcgtggcccagtggcaaaaggtgttttatcgccagacgttggtcgagggttcgactcgggctacgcactgcttttttaaacttttagagatgcaaaagtgtttacctatgaaaaattctggagaagacagggatcgaactcggggcgcctgagcaagggatagctgcgggttgagagccactacggtagaacaaccttactgactattaatagttaaaagctcatatatctaactcaaaaaaattgaattcaaaatttggttttaaatttcgtccgaatttttttcggtaattcgtggttaccgagaatctcggtgcccctcg

SEQ ID NO: 65455 - DNA, 413 bp, Triticum aestivum
  Clone ID: PAT_TA_65455
acatcctcataaccggtgccgcaggtttcatcgcgtcccacgtggcaaaccgtctggtcaggaattacccgcgctacaacatcgtcattctcgacagggtcgactattgctccagccttagaaacctcgacccttctcgtggatccccgaatttcaagtttgtcaggggcgacatcgccagtgccgacttggtgaaccacctcctggtcaccgagtcgatcgataccgtcatgcactttgctgcccagactcacgtcgacaactccttcagctgttcctttgagttcaccaaaaacaatgtgtacggtacccacatcctcctcgaggcatgcaagcaggttaagatcagaaggttcattcatgtcagcaccgatgaagtctacggagaaactgatgtcaatgctgttgttggt

SEQ ID NO: 65456 - DNA, 134 bp, Triticum aestivum
  Clone ID: PAT_TA_65456
tatctcctcggcgatccatccaacatgtatcatggtggcccggggatgtctcctgctgcggccggcggtcgtggcggcacggccaggaaagtcgcgccgtggatcctcgcctgcggcttcctgctctgctcgtc

SEQ ID NO: 65457 - DNA, 387 bp, Triticum aestivum
  Clone ID: PAT_TA_65457
gccgccgccgcgcgcgtcgtcctcgccgtcaacgccgtgtgcggcctcgccgcgacagccgcggccaccatcctcggcggcgccagcaccaccctcaactccaccttcccccaggtctccggcgacctcccgtgggcggaatccttcaacgcggtctccagccagctctccgccctcttctaatccgccaccagcaacgagagggacgccgcggacgatgccgtgggcaagctcgcggaggtcctcgacggcgtcagcgagggcgccgcccccgaggaggcggcgctgcgcgcggcgacgcatgaggtggagaagcggacggaggagctggcggcgcgactggagcgggtgtcggacgccgtcaacggcgtgttccgcgcggcgctg

SEQ ID NO: 65458 - DNA, 562 bp, Triticum aestivum
  Clone ID: PAT_TA_65458
tctgcgcggccacctgcgccggtagctcggccgcgaccgcggtccgctccgtgaacggccttacggccatcgccgcggcgtcgggcggcgtggcagcgatgggcaacccggccgcggcggccatcacccacgtcctgcacaacaagcaggagttccccctcgccgccggcgtcgacgacctcctcgtggtctccatcggctccgggtcctcctccggcggcaccgcctcaggctccgccaccccgtccgccgggtggcgcacgccgatccccccgcgctccccgtcccccgccgagatggtccgcctcaccgccgaaggcgtcgccgacatggtcgaccaggccgtggccatggcattcggccacacctgcggccgcaactacgtccgcatccatgcggcggcgccggcgcactcgatcaaggcgctccggtcgctggaggcgcggaaggtggtggcgatcgcggacgggatgctgacgcatcggaacgtggaggcggagctgttccgggggcgccggctgtccgagaagtccaaccgggagaagctggacgcgttcgcgac

SEQ ID NO: 65459 - DNA, 455 bp, Triticum aestivum
  Clone ID: PAT_TA_65459
tggtgcatgttgtgattaatcaagtcattggcttcccaacgatgtattattgggtcacttgtgtagtgtttaacatgcccatgggaatcaatcatgtgatcctgtggctttcgtgttgttcacctcaccacatttgatggatgtccaggagtggttctggctagataggtaatttattcacgcattgttcttgttcttatttgtttcttatggtgttgctaagtgtactcataattattcacaattacatgtaaacatattttgccatcctttaagtttatcatttttcccactgaaaactgtagggcaattataacgttgtcttttgtattagttatgcgcttatcctgctatgtaggtataggagttacatatttcgaattcgcgcgtgttagttacacaggtaagttttgccttacaagtaacatgctttctagaatcttgcttccttttta

SEQ ID NO: 65460 - DNA, 107 bp, Triticum aestivum
  Clone ID: PAT_TA_65460
tactcgtgggaattccagccaagcggcaatcattgaccaacccacagaacaccttctttggcacaaagcgtatgattgggcgtcgctttgatgacccacaaacacag

SEQ ID NO: 65461 - DNA, 511 bp, Triticum aestivum
  Clone ID: PAT_TA_65461
cccctcccaccgccgcccaacgcctcgatcttgcccctccggccgtggtgaagcactccccggaggcgctgctgctcgtggtgtccaaccccgtcgacgtcctcacctacctcgccttgaagcttccagggttgtgttcgaggtgagcggcgtcatctgctccggtaccaacctcgatgtctccaggatatggttcctcatcaacgagccctcctgggtgcaacgcgcaggacgtgcaggattcccagcccaccccagcatcccgttcaaccccgaaccggtttactgttgcgcctctgcaaccttacaggccgccgcagtcgatgcagcagctagcagcagggcccattgtcgtactcgcgcatcccaggttcatctgcttgctgctgtttcggccatcactgggtccatagttactgtacaccttctactcaatatttgacagagtaacaaaagatggttgataaatatgttgctctgaaccttggcttattaattggcggagctttga

SEQ ID NO: 65462 - DNA, 459 bp, Triticum aestivum
  Clone ID: PAT_TA_65462
caccaatccatcatgaagaccttcctcgtctttgcccttctagccgttgtggcgacatctgccattgcacagatggagactagctgcatccctggtttggagagaccatggcagcaacaaccattacaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgct

SEQ ID NO: 65463 - DNA, 633 bp, Triticum aestivum
  Clone ID: PAT_TA_65463
ccccttgtttgccactgccaacattgctgcgggcttcttcatctacatctacgcccatcgcctattggtttaacgtctatgaggcgtggaacttccccatcttttcagatggcctctttacggtgacaggtcagaagtacaacatctctagtattgtggattccgagttccacttcgatgcaaatgcctatgagaagaatgggccactatacataagcaccttctttgctgtcagctatggtcttggttttgcttgcctgaccgcaaccattgtccatgttctccttttccatggaagtgaaatttgggagttaagcaaatcagctttccaggatagaaaaatggatgtacacacaaagcttatgaggagatacaggcaggttcctgaatggtggttcatttgcatccttgtcgccagtgctgcaatcaccgtgttcacttgtgagtactacattgagcaacttcagttaccctggtgggggatactgcttgcatgtgccctttccattttctacacccttccaattggaatcatcacagcaacaaccaaccagactccaggtttgaatatcatcacggagtacatcatgggttacttatatcctggacgacctgttgcaaacatgtgtttca

SEQ ID NO: 65464 - DNA, 462 bp, Triticum aestivum
  unsure (1)..(462): unsure at all n locations
  Clone ID: PAT_TA_65464
acttgcattgttgcaaaatatgagactgtggatacctactaccgccggtgcagcagtgctagttttgttggtaatgtgtcagttcccttgctttgtataagtgctttggatgaccccctttgcacaagagaggcaattccttgggacgaatgcaggtgatttttttccttgtaaaaatcattctcctgaaatttatattttctataccaatgttaaagcatgagttcttttgagtttgatccaatcaatccagagcatacataaggaattgatccaatggatgagaaaataagctcaaacacatacgctaattatcctcttaattgcacatttagctctcttaacttcttaacaaatntctctgtatatatttctattccatcacattccttatgtttgatttcacataccctgctgcttctcttgctcgcatacattccttatgtttgattcacataccct

SEQ ID NO: 65465 - DNA, 404 bp, Triticum aestivum
  unsure (1)..(404): unsure at all n locations
  Clone ID: PAT_TA_65465
tggtgaagttaaatgtcagcaggaactttgctgatttaagagcactgccaagatcaataggaaatcttgagatgcttgaggagttagacatcagcagcaaccagataagaatgctgccagattcattcgagttccttgcaaagcttcgtgtatttcacgccgacgagactccactagaagtaccaccaagagaagttatcaagttaggggctcaggcggtggtccantatgtggctgatatggttgcttcaagaggagcaagccagaagaaaacagacgggacaagcttctgggcctggttccgctcactgtttggttgctgcaaaaaaagatgaagaactgggattggttccagcttagctgaagcatttcgtctgtatgtatcatcatgctttgttcatgtc

SEQ ID NO: 65466 - DNA, 399 bp, Triticum aestivum
  unsure (1)..(399): unsure at all n locations
  Clone ID: PAT_TA_65466
gcagtgcctcgttgtgagggcatactcaatctaccactaacgccgccggtggcactatccaactacagcagctcaaggatctagatctagatggggtgtcactccaaagtttggcttggctcattactatgttggaaggtcattatggagtcttattgcctggagctggtaaatctgttgaagatgtggaccgcgaacagggctgcaattcttcatgttcttatgcaaatcagaagctgcttttgacattgacaagctgcagtgaagaatgacatatcaagattacttacatacatattgtcangccacataagcctcttccgcgaccactcattgattcaggaccatctttcatgctccaacaatagttttcctttgatcttcaaatcgattagttga

SEQ ID NO: 65467 - DNA, 448 bp, Triticum aestivum
  Clone ID: PAT_TA_65467
gggcggattcatcaaggtcatcctgccgaggctcttctctctcatcgacgacaagtacaagctgcacaggggcgtcaagagcgacgtcaagttcctcgtgaaggagctccgcatgatcgtcggcgccatcgacgacgacgagctctcagacacggggggccgccgcgcgcctgtcgatccaggacctgcgcgagctggccggtggcatagaggactgcatcgacggcctcatgtatcgcgccacctgggagcagcaggcgtccttcctccgccggagcgttcggcttcggccccccaaggcgctcaagaccagtgcgcagctcgctcgggagatgcagcggctcaggcagatggcgagggaagcgcacgagcggaagcagaggtacgcggccgacttcccggccggcggccagccctcctcctctgccaccccgccggtggacgagtc

SEQ ID NO: 65468 - DNA, 169 bp, Triticum aestivum
  Clone ID: PAT_TA_65468
gcagggggcacagtggtgtgctgggaaataaggtctatgtcccctgtgtggagagtggcagtgtcgtggagtacaacacgcgtgagaacaagctatctgtgatcaaggcgccatttgaggtccagcaccacaagattgagctcatgggggtggaggatggaatgctgct

SEQ ID NO: 65469 - DNA, 218 bp, Triticum aestivum
  Clone ID: PAT_TA_65469
atgactgaacgcctctaagtcagaatccaagctagcatgcgacgcctgcgcccgccgcccgcccctgctacgccccttgcggagggcggccacccgtctcctacccgccagaaccctagttctccggggggggcgtctcccccgtggcgtctgtgcgtcccctgcacccgcgcgcgccgtcgccggcgccgtgtttgctgtgggcgggcttatggcgc

SEQ ID NO: 65470 - DNA, 549 bp, Triticum aestivum
  Clone ID: PAT_TA_65470
acgtagtagttaacgcaaatcgaccgtgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatggggggggagcccaacaaacatttccccatcaaccacaacaacaagtgggcggggctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttc

SEQ ID NO: 65471 - DNA, 349 bp, Triticum aestivum
  Clone ID: PAT_TA_65471
gaaaatatgctgtagatttggtcttaggtaaattagatgtagcagctgctatcgattctgtgttgcagtcccgtttttctcttatctatcatagaattttattattagtttattggcatggctgctctctgtttatactattctaaatgctgttattttttctcgttgtttgttctgcatggtgggggggtagatccttcagaatggagggctagaattaacttgggtggtggaaattatgctgcatatgaaaattagttctactatggtatactagattctcaagttttacatccatcagaaaagactacttgaaactatttctgctgctgctactgtcaaactactt

SEQ ID NO: 65472 - DNA, 351 bp, Triticum aestivum
  Clone ID: PAT_TA_65472
tagaatatctccgattttgtcatgtttggccctttctttccgttgctgccgcggcaactagcgttgcccgcgaaagcaaacaaactgctgcacacacactgctgtcactgtactctatgtaggactactatctcactgcctgcgctttaatggggggcagcagtgaaaaaggccctacgtaattaaactactgcgccctggggccttcaatgcgcagcggccccgaccgcaaccgttaccaccgcagtccaactctctctgacttctgctcactcgccactgcctcatcgccaaccgctctgggctgggcgtgcccccacttgccaatcacatgggctgcagccacgtcac

SEQ ID NO: 65473 - DNA, 446 bp, Triticum aestivum
  Clone ID: PAT_TA_65473
actccgtcgccgctgttgctcaacttccactcgggcagcggcggtcttgacgtgcagccctcggcgtcagctgctgccgctgccgcagccgctgacctttcgaggaagcggcgatgggagcaagaaatgcaacagcagcagcgacaacaacatcagcagcagcagcaacagtaccagcagcagatggcggggtgcacgcagagccaaatgccgggcaccgtctggatggtgccaaggaacaacacgcacagcggcggggcgccttccggcggtggaaacggcggcggtggaggaggaagtggtgagtcaatctggactttcccgcaagtgggcagcgccggcgccgctgctgccgtgtgtcgtgggagcgtgccaagcgggctacatttcatgaacttccctgcaccgatggcgctgctaaccgggcagcagctggggctcggccc

SEQ ID NO: 65474 - DNA, 445 bp, Triticum aestivum
  Clone ID: PAT_TA_65474
ctccttttacatcttggatgaagacggcgagatccaaagtcaaaggcttccgccattcacccttttccagcgcaccacatccattgccccacttttaggccatcatttacatcttggaacagagaagacgagatctaaagtcaaaggttttttctgtacaatatcctcagacaagtaaccgtggaaaagaaaggcatggcaaaaccattggtgaggaaggttgcagagtgagctgccaatgccattactgcgttaaggtggtttcgagttacaactgcctagagcaccatttagcaggcatcaggggcaatgtcagcacaagcttaaggagttcacttgtggatcgcaagaagagaaagcttggatgctcagaaaaatgaagaaacggaagcctgaacatgatgaggttcctcacacaagcccagcccttccatctgctctagtc

SEQ ID NO: 65475 - DNA, 120 bp, Triticum aestivum
  Clone ID: PAT_TA_65475
acaccgcggtacattcccatctccaccctctatactacgccatttgaaccgacagtgcccgtcgaagtttcacaactgatctacgcacaaccgacagtagtttctttttcctttggcaaa

SEQ ID NO: 65476 - DNA, 123 bp, Triticum aestivum
  Clone ID: PAT_TA_65476
ctctcagccagttgcggtgggctgatgaccatcgtcgccggggagtgatcgaccggttcgggcgtttcaagctgtggccatcggggggtcggtcctcgtcggcatctccttctcctcggtctt

SEQ ID NO: 65477 - DNA, 170 bp, Triticum aestivum
  Clone ID: PAT_TA_65477
ccggggtacgcggccaccgatcccccaccccccgcgccgcccgattcgcccccaaatcgcccaatccccgagcccccgcgcccgattagctgcgacgggaccgcgtctggttcgatccgcggcgccggctcgatcgtgcgggggggacgcgcgcgcgggggggttggatt

SEQ ID NO: 65478 - DNA, 473 bp, Triticum aestivum
  unsure (1)..(473): unsure at all n locations
  Clone ID: PAT_TA_65478
gactagggagcctgcgggcgaggcctgggtgtactcgtagtcaggacatccgcggaaaacatgccggcgtccatgacgacggacgtccaccgacaccggcgaagccttatttcatatgggctgccacacgcatccatcttcatcaatggcaatcatctcacaattacttctctttttacatctctcattgcagcgactcatgacgcagagcgcgccccgctggtgacgttcccacggaggcagcgtcgaggagatggaggcaggggagccacaaaagaagccctagcacttgagcacttgcacccaaggcagccttggacgacgcgctggcgactgcagcttcatggacgtaccaccacgacggcggcgagcctgccggtgagtagctcggcgccaacaccacctcaatgacgacatcanaaaggctgccggcgtgcggcccggcgccatttacaccaccacgatagcgtcgg

SEQ ID NO: 65479 - DNA, 470 bp, Triticum aestivum
  unsure (1)..(470): unsure at all n locations
  Clone ID: PAT_TA_65479
tggcagttgcactgccccgcactcctcttcctcctccgctcgcttgctactctccaagtacccatccattccatccatggtcgcaagcccccacgcagcagcagcaccgcttccatctccgcactcagcccgccggtagccctcctcccgcagacacatggcctggaggcggctcgcctcccgctcccgtcgctgccccaccatccccgccgccccgcggcccgcggcgccgcgtccgcgtccgccggcgggacccgccgcggccacgccgccgctgcgccgcctcctcctccccctctccccgcccggcttcgcagccgccgcagcctcctcgcccgcgcggctgctccacgccgctgcggtgcgcggggggagcangtggctcgcgagcgacgcctccgcctccgcggcgagggagccctccgccgagctggtggaggtgcccctggcgcagacgggggaggggatcg

SEQ ID NO: 65480 - DNA, 512 bp, Triticum aestivum
  unsure (1)..(512): unsure at all n locations
  Clone ID: PAT_TA_65480
tcgggccctataccgccggcgatcggcaagctctccaacctctcgagcctccgcatctcctggacggccgtgtcggggcccgttccatccttcctgggcgcgctcaagaagctcaccttcctcgagccctccttcaactcgctcaccggggccatcccggcgtcgctgggggccatccccaaccagtccggcatcaacctcagccgcaaccgcctcacgggcgccatcccgatgttcctcagcaagtctgcggaccaggtctacctctggctgtcgcacaacaacctcacgggccccctcccggccggcttcgccgccgtgaacttcacgcacttcgacctgtcgcgcaacgccctgaccggcgacgcgtcgggcctcttcngccgcgggaaggagttgcagtacatggacctgtcccgcaacgacttcaatttcgacctatcagccgtggtgctcccggagcagatctacaccgtcgacctgagccacactgccatccatggcatcatccc

SEQ ID NO: 65481 - DNA, 418 bp, Triticum aestivum
  Clone ID: PAT_TA_65481
agggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaacaatgaatgatctacctaattaactactcctaaatcgc

SEQ ID NO: 65482 - DNA, 402 bp, Triticum aestivum
  Clone ID: PAT_TA_65482
aattttcaaaaggactgtttcttctcaccttgatcttgtgatctaatgaaatttattcctgatttttatcagggacacaacagtgaagatgtttttgaatttcgtgttgtagctaaatggtgaagttttcatgaattcatgttatgaattggttctcactttttttatcataaccttttattatctcatgatttattgattttttttgttttttctattgatatttctgtttgcaaaacgattattagatattggagaattaacgaggtatggctactgccaagcatgctttcagaagtacacgattcaagagattttctattttggcagaagttggtgtgcctactgacaagtgtgctctgaaaattagtcaattactgcaccagctggacttatagatcg

SEQ ID NO: 65483 - DNA, 339 bp, Triticum aestivum
  Clone ID: PAT_TA_65483
acaaggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaatcggggtacttcccaacttctctgggggagcaggacaagggcagcatccaggacaaggacaacagtcgggacaagggcaacaacgtcagcaaccaggacaaggacaacaagcgtgctacccaacttcttcgcggcagtcaagacaaaggcaacacgcatgacaatggctacgaccgggacaagggc

SEQ ID NO: 65484 - DNA, 460 bp, Triticum aestivum
  Clone ID: PAT_TA_65484
cgcacacgtttcgcgctgcgcacacatcgacgcgtggttgagagaccttgtccctccggttcgtcgacatggcattcgctgaggaggagctggcgcttgcaatgaagctcagggcggacggcggcagcagcacggaggaagagtcgtccatcgccatgaagctgacggaggacggcggcagcgaagacgaggaggaggagcggtgccctccctgtgaacctgctcgagcaccgtggcggctcctgctcggagttggctgacggcggcctaggcggctgggcatcgaccggctcgagcacgctctcggtgcaccacgaccacgcgccgcctccgctctcggccacggcggaggacgtgccgtgcgcgcacaggcggaagccgagcggccggtacgtcctcgccgcgcaccgggcggacgagaaggacggcctatgccgggagatgccttgcgcgcccaagc

SEQ ID NO: 65485 - DNA, 398 bp, Triticum aestivum
  unsure (1)..(398): unsure at all n locations
  Clone ID: PAT_TA_65485
cggaggacccttgcgccgccggccctcgccccccttccaatcccctgtcctcgccgccgtcgggacacgtcgccaggcaaagccaggccgccagtggcggcggcggggcttcatcacctctcgctcggagtcgtcttgcgcggggagaccacagtggggggctgcgcgttgcntggggcgcggcggtgtcttggcaagcattgggcgacagtgacgcggtcgtcacgctcgggcgcagtgggctacgcagtagtggtctcccatgacgcagcggcggctagatcgatcagatcgggatgctatctggtggttgcggggggattcnatgccgccggcggggctcccttgtcgtccttctcaagcggtggtgctcatagcgaggagggctggcgttaatt

SEQ ID NO: 65486 - DNA, 436 bp, Triticum aestivum
  unsure (1)..(436): unsure at all n locations
  Clone ID: PAT_TA_65486
cccttctcgctcgcaggttgcaggcgattcgatccggtccgggtccatggcgtccacggccgtggcggcgctcgtggtgaccgacgagctggccctgccgctccgcgcggtgggggacggcggcggggaagcacgcaactgcgcagcgaccgcgggaggtttcagtgagcggccgcattgctgcggcaggaggaccagcgcgggcgtgcggcaacnaggctccgtcgcgtgaaccaagacgcggactctacaggatggctctgcgggacgctggcgtcaaaagcagcggccggggccacgcggtgaccctgggacgccgctgcccgattctggcgcgaaggcaacctcgcgcgaatcacggcggccttgaccaagaaggaggcgttcgtgccgcacggcggccggtggtgagcgtccgtgctggcgagtttgggtc

SEQ ID NO: 65487 - DNA, 566 bp, Triticum aestivum
  Clone ID: PAT_TA_65487
ttgtggtgctgacagtgatatttgtgacggttgttattattattatggggatcctggacatgggcctcattatgaccgcaacaactgcatctttctcaaaggcttgtcagaagccacagacttggagttgtcagctcattctgatgtgactgttttcaacagggatttgaagtggtgccctacatttaccaagttaaagactttgctactcaatgattggtgtttggctgctaaccataatgcactaatttgttttctccaacactcgccaattttggagaagcttactcttgaactttctaagggacctttatatgaaactgaagcagaaggaatatacaaaccattgggacagtcaattgcatccaactgtcttaagattgttgaaatcaaatgtgcaaatgttgatagcaaggttcacaaaattttggaaatactgactacgtacggcatacgccttgagcaaattagtgtccaacaaactagccagattcctggatctggatgtttcaattttgtttgcactgagttcagctaaaacacgaggtacaaatgacgtcgttctc

SEQ ID NO: 65488 - DNA, 406 bp, Triticum aestivum
  unsure (1)..(406): unsure at all n locations
  Clone ID: PAT_TA_65488
gtgcaggttttccaacttataaactggaaaaatcgtttctggagtattcaaacggagtatttcggcccacacgaaaactttttccgcgttttcgggacagatggactcattccacatactcaactatgaagacatcaattcgcagtaaaataaaatgatctccccgtctttatatttgatataataataggtgacacacttacacatacacaatatatttataaatactacctatatataggtacctattttatctatttacgattntgtttaagattttattttcaaagttttatgatattatattcacttattatacttttctagtaggcacttagtgctttataacatcggtacaaggtacctacctatacctaatcttacccaatacacccgtatataatat

SEQ ID NO: 65489 - DNA, 450 bp, Triticum aestivum
  Clone ID: PAT_TA_65489
tgcaccgatcgatctcgatcatggaggatgagaggagcacccagtcataccagggaggtgaggccgccgagcaggtggaggtgacagacaggggcctcctcggcaacctcctcggcaagaagaaggcggaggaggacaaggagaagcaggaggagctggtcaccggcatggagaaggtctccgtggagagagcccgagttaaaaaggaggagcacgaggatggcgagaagaaggagaccctcttctccaagctgcaccgatccagctccagctccagctcgtctagtgacgaggaagaggaggaggtgatcgatgacaacggtgaggtgatcaagaggaagaagaagaagggtctcaaggagaagctcaaggagaagctgcccggccacaaggacaccgagggtgagcacgtgacgggcctacccgcaccggcggcccccgcgtctgtgc

SEQ ID NO: 65490 - DNA, 300 bp, Triticum aestivum
  Clone ID: PAT_TA_65490
ccgaacttgcggcttgaaggtttggccagtagtttatttatgtgctattgctcttgtttagatctgtaatgcttaattggttgtcgttgtctgttttgttgtttggtcttgtaatttaagctgcagacagcagcagctactatatttatctgcaatataacttgctttagtaaaaaaattatctgccttataacttgctttagtaaaatttgtgcggggagttattcctttgcaattcatgacagaatgtttgcaaccttgtttctactagtttcagcgaatgacacatctttggtttat

SEQ ID NO: 65491 - DNA, 366 bp, Triticum aestivum
  Clone ID: PAT_TA_65491
aaacctcccatctccgtctagcgtcggcggcagttccactccctcgcgctgggcgagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgtgcacggccgctggaagcacagcgacatcaagctcaaggacgacaagactctgctctttggcgagaagccagttaccgtctttggcgtcaggaaccctgaggagatcccgtggggtgaggctggtgccgattacgttgtggagtacaccggtgtcttaactgac

SEQ ID NO: 65492 - DNA, 189 bp, Triticum aestivum
  Clone ID: PAT_TA_65492
tttatatggagcagagtgttacattgaggtttacttacagcagagaaacagaaatattgagtggaagctatgatcggctaggcaaaaagaaaagaaagaagagaacgaaaggagaacgaaactttgtatttggtaactctcctgtaattatgtttaaccttgaatgcaatttatagatttgacagcaat

SEQ ID NO: 65493 - DNA, 122 bp, Triticum aestivum
  Clone ID: PAT_TA_65493
ctcatccttaaccctccttgctattgtagcaaccaccgccacaattgcagttagagttccagtgccacaattgcatccacaaaatccatctgagcgacaaccacaagcagcaagtaccattg

SEQ ID NO: 65494 - DNA, 556 bp, Triticum aestivum
  Clone ID: PAT_TA_65494
caggtgaggtgactgcttctctgcaatctgcattgcttttactctcttccactgcatcgatctgcatcgttgtttttactcttttccagctcataaaaagcctcgacagttgcttatgatacttactagaaacacatttagaatgccataatgagctcactggttgtttggcacaagtcctaacgactaatgggcgtatccacatgcactcatgcttactagaatagccctactctgaaacacatctgcaaacggaagcaccgtgaggagtaagcaaccgcgattaggagagaacaaattcgtgttagtgacgacgcggacaggctgttgttcagaaaaaccgccgtccttgagagaaccttccattttttaagctgaatgacaaccactcccgcgggtccatgccaaaagaactccaaaagttcagaatagtatacagtttgtcgcgcaagtgacaactctgtctttccccagattgtattggtcggaacagatcgtcagatgctcagatcgcatcagcgatcggccatcgatctactcgtctcacatgtacatg

SEQ ID NO: 65495 - DNA, 552 bp, Triticum aestivum
  Clone ID: PAT_TA_65495
actgcgcgtgcgcggaaaggggcttccatagaaggatttacaagcaaaagggagtcaccaggtgctatgaaaacagtacggcgcttccatgcactggatttgtcgaaattgtggctcccgtgttctcaagagcagcatggcattgtgtgtggcatatgatccataactatctgattcatgcatggggcttggacttcaaattcggctgttgcgctcaggggggtcggagtaagaacgttggagtagtcgacagcgagtacctccttcatttgggcatccccacactcggctcctcttcttctcctccttctaaagacaacaagagtagctccgatgcagcaccaggagatgaatcggaggcgcctatagaatcaatgatggcgcctcctcctgaagcatcgcccagcttcggtgacagatcattgattaggcatcgggctcaagaagaacaggtccgttttcaagaaagatggaagtatgctactcaatctgatgcatgttgggttgatccatatgttaactaaacaaacatgttaaagggtacccacttct

SEQ ID NO: 65496 - DNA, 501 bp, Triticum aestivum
  Clone ID: PAT_TA_65496
cggcggtggtttgcttctaaggtaagcatatgtgtggtatgccatctaccattagtcagctcctgctccagctgctcatgttatcataacctccttcctgctcatcttatcataacaggtgcagatttgtctttcatccattgattagcgcaggctgtatttgtttctgggagctgcgcagatttgttcatacagtagacggtcattctcatatgttgtccagcatgaagccatgaccaggcatacagtaaacttgcaatccatgcgcataaatgcactaggctagctaggtagcatgttcatgtgagaaacgatgtagaagagctagcagcaaagatgaactgtgtgtggacgtgtggtgtgaatttcttctcccatttcatcttccacatatgcacggatgcaccccatgcttccagtcaacttgcatttgtgcattggcgtcaaacaaatcttagccatgcatgtgtacatcagtggtacaagaaaacgacacaccta

SEQ ID NO: 65497 - DNA, 567 bp, Triticum aestivum
  unsure (1)..(567): unsure at all n locations
  Clone ID: PAT_TA_65497
cacgccggcgaccgcccgagcacttctccctcgtcgccggcgacgatttcgcggaccatatgcgcatacggccgccggttgcgagccatctgaggaacttgatcaccgagttcgacaagatccaacttgaagctcctaatggccgcagctaccctgttaaaatcggttgggagtttggtgacattgttctcaggtctggatggcacgactttgtcgaggcgcatcacatagagcaaaactactccatccggttcgtgtaccgtgggaactccagcttcgaggttcacatatccggttcatccggtcacgacaactcttctccaccacctcctcgtgatcgtcatgtgctgaatgaacaagtggtgcctgatcctgcacatgttcagacatcaatcaacattgactataccgcattccccgggaccaggctaagccatgaacaagagaagaaagtgctagaactagctcagagcagcatgaggtctgaatntcgtctgcatgtggcagctgtgaacaaaggaatgccaacggggactgccatgtttacatacccttgatgcttttgga

SEQ ID NO: 65498 - DNA, 482 bp, Triticum aestivum
  Clone ID: PAT_TA_65498
caaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaac

SEQ ID NO: 65499 - DNA, 399 bp, Triticum aestivum
  Clone ID: PAT_TA_65499
atgccaatgtgaagatgtaaaactggctgatagccgcgcggctgtgtacgaccactgtacaaccgcacaatttgaaataaaaatatcctgaattaaaacttaaaattttcacctgtccacaatatcaaattattacataattcatcaaatcaacaacatcaaatgcaacagaaatacaacaaagttcttgcacaataagacaaataaataatgaaactaggcaattctttcgctatgccatttccagtacaccccatcaagtctttctgaagttcattgtgtctattgatacgtctccaacgtatctataatttttgattgttccacgctattatattacctgttttggatgtttatgagctttattatacacttttatattatttttgggactaacct

SEQ ID NO: 65500 - DNA, 432 bp, Triticum aestivum
  Clone ID: PAT_TA_65500
actgaagagctgtacgagcgagtggtcggtcagctagctcgatcgccatgagcagcttcgcgggtcagcagtcaaggccgtggatgggggacgccgccgccgccaccccgtcgggcgacgcgcgggacgacggcgcctcctccatgaaggacctcggctcctccaccaacgccagcgccatctccttcggcttcgccgccaccgccatcctcatcgccatgttcctcctcatggccatattcgagcacctcatcaagcccggctgggcggcctcccggggctcccgcggcggcagcgacaacggcgacggcgacgtccacgggcgccacgcccagccgccgcaccccggccggcacccgcgcgaccacggctcgccggagaagctcgcgcctccgcccaatatggatgcggtggtggcggcggcggacctga

SEQ ID NO: 65501 - DNA, 645 bp, Triticum aestivum
  Clone ID: PAT_TA_65501
gtggatctgcttgaattaagtctaactgaacctagcaatagacccttgcatctaattattaattgtcagtaaaagaaggtggtttacctgcacttttactgagctatgtagcaaaagcatcagcttaatgtgagacatgcatgcggttagctgcagtttaagttttgtagttcagttatttaggtgcggctagttttcttgtcagcttcttgcgtcttaattaccacatagaggcagtgctacatggtgaacatacacaatgttatatggtgcacacacaaatgcaaggtgtgtgaattagttacagatatggtttcttatcttgcttatgggatcttgtcgtctaataagatttctgataatcatgtttgtcagagtggttattattccaaatttgtaataagatttttaaacttttcctcatgtagaaagtaagctacatgtacacacttgttaacatctctaagcatgaaagcagtgtatggcaataataatatgcattttcatgttcttatttccttcttacgaaataataagaaatccaatctataacatactttttatacagtatttcgggccatatatgtaagacatggacgtcatgcttttgaaccatacattgtatttttttaatcatggtgattt

SEQ ID NO: 65502 - DNA, 635 bp, Triticum aestivum
  Clone ID: PAT_TA_65502
taataaatactgtttgccatgcttactcagatgcagttgtcatattcaatagaaattctgtttgtcatgcttacccggatgcagttttaatgttcaatgaaatgcagttgccatgtttaatgcaatgtactttcactggacatgttggtgtgcaaatgctagtgtcaaatggaaaatgttatgttgttgccatgtctattgaaatgcaattgccatgtttactaaaatgcaactgccatgtttgctgaaatgcaattgtcatgtttaataaactctagttgccatgtttaacaaaatgcagttgccatgtttaaataagatgcatctgccatgtttgttgaaaatgcagttgccatgtctattgtactgcatttgccatgtatagcgtactgcatttgccatgttcaacatactatatttgccatgttcaatgaattacgtttgccatgttcaaacaaaatgtatatctattttccatgacaacataaggtgctacaagaaaaaagcccataatagtttaacagaaaacacacaaaaaatgcagattccaggaagaaataaagcgtgccagtatgttcacggctttccaggtggacgaacgtacgttcaaggtgtgttctattttgggcatgtca

SEQ ID NO: 65503 - DNA, 590 bp, Triticum aestivum
  Clone ID: PAT_TA_65503
agtgagggaaggaaaattaacagtacagcaagactcctccagaagcaagcacaccaagccatccgaccactcacgacagaaaactagaagcttggatccaccgtcaccatggacggcaacaagaagcttgtgaccgcggccgagaagaccattccagctaccgtccagcgggccagcagatgggcgctctacaacgcctgcttcaccgtgggccacgcggtcacctacgcactcctccagtcctccttcgccctgcggtgcgtccagtggacggacgccaaggccgcccagtagagcgccctctgtctctggatgctgcgctgcgccgtactccaggcggccgcggcggcgctggcgctgcacctgtcgtgccgccgccgctgggtccgccacgccctggcctacctcgcgctcgtggtcgccttcgtcggccactgcatgtacgtcgccgccgtccgcctcctcctcgccgctgactgccctggatacgtcttgctcaggatcttgtgcaccgcgtacattgccttcttcctatggggcgacctgctctacttccttggcctcctcctgggaggtgacaactgatgagc

SEQ ID NO: 65504 - DNA, 656 bp, Triticum aestivum
  Clone ID: PAT_TA_65504
agaataaagttgaagagctgtcttttggagaccaagcaacagaacatagagaggaggcatcatggacaagtctagcagggacttcaaaagaatcagatttagctgaattaagtatacatggtatgctatcacctgtaggacagggcctatctccagctggtgctcagacaagtgcacaaggcagcaaagggaaaaggcgcacaaagacggagaagactgtgagcttgccggttcttcggcagtactttgctggtagcctgaaagatgcagcaaggagccttggagtgtgccctaccaccctgaaaagaatatgcaggcagcatggtataaatcgctggccatcacgaaagatcaagaaggtagaccattctctaagaaagctgcagcagatcattgattcagttcacggaggagagacagctttccagcttaataccctgtacaaggatctcacaaacacctctgtatcatctgacaacaatttgtcaggaagcgtcacagttcctccacacaagcagagcaatcttactgattttgaggggcaccgacaccacaggctaagcagtattgtgccatcaacctcacactcacactcatcatgcagccaaagttctgattcaagcccgtcatcgtgcagtggtggatcaacaaagcat

SEQ ID NO: 65505 - DNA, 519 bp, Triticum aestivum
  Clone ID: PAT_TA_65505
ctcacatcaacatcgtggtcattggccatgtcgactctggcaagtcgaccaccactggccatctgatctacaagcttggaggtatagacaagcgtgtgatcgataggtttgagaaagaagccgctgagatgaacaagacgtctttcaagtgcgcctgggtgcttgacaagctgaaggcctagcgtgagatgggtatcaccattgatattgccctgtggaagtactagaccaccaactactactgcaccgtcattgacgcccctggtcaccgtgactgactgaagaacatgattactggtacctgccatgctgattgtgctgtgctcatcattgactctaccactggtggtattgaggcgggtgtctccaaagatggccaaacccgcgagcacaccctacttgctttcactcttggagtgaagcagatgatctgctggtgcaactagatggacgccaccactcccaagttctcagaggcccgttacgatgaaattgtcaaggaagtctcatcgtacctga

SEQ ID NO: 65506 - DNA, 544 bp, Triticum aestivum
  Clone ID: PAT_TA_65506
ccaaatcctctcttcatctatcttttccctggcccccaattcctcccctaaatctctagatctggatccatcgacgacgaaacatagcctcgcacggatatgatgggatcggagccggccgcgctacacgacgacgcgctcgccgaggtcctccggcgtctcctgccgcacgtcttggccgaggcccggcgggtctgcaaggcgtggcgcgacgccgtcgacggccgcctgcgcggcaacctgcttttgcgctcggtgcgcggcatcttcatcaacttcgccgcgaatcattactcggagttcttcgcccgcccctccactggcccggcgatcgacggagggctcaatttcctaccctgcgcgggcgtcacgatcacggaccactgcgacggtcttctgctttgccgcgaatcgcgggccgacgcaccgccacgcgatcacggaccactgcgacggtcttctgctttgctgcttctgctttgcccaagcgacccccgccgcacatgccaggattcgagcagaccgcctacctcgcggttcgagc

SEQ ID NO: 65507 - DNA, 588 bp, Triticum aestivum
  Clone ID: PAT_TA_65507
taccatgtccaaataatgcatgtttccgcacctttctttgagacatgacataaaagtgtgcaataagcactgacctcaaggaaagaaacaaaaaaatcttatacagtaaatcgaaatcacctaacaagctttggcacaggataaactgtactgcagacagcaggtattgtagccgttgtatatggattttatgggcaaaagtaaaaagatattatttgtcccacgactgtcttcatgtatgccttttgtgggaaatgatctcaagataaatggattggaagaagaaaattataagcctacctcgaatttgtacatatgtgctttttttcttcgctggttcctcaatggagtactcgtctgtgcctacaaaataactgtagaccatgctcactgctccatagcacgaatatgatgtcacttgtgcaaagattgtaactcttcatatagtggaacatacggaaaatatggtggctcgctttcttcaagattgcagatcactttaacttgtccacgatccatatcatagcacatgaatgtgatatcctcccaggccagagtgaagaagatcaagttacattctggatgaat

SEQ ID NO: 65508 - DNA, 613 bp, Triticum aestivum
  Clone ID: PAT_TA_65508
caacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagctccagtgcgcagccatccatagcgtcgtgcattccatcatcgtgcagcagcagcaacaacaacaacaacaacaacaacaacaacaaggcatgcatatcctgctgccactatctcaacaacaacagttgggtcaaggtactctcgtccaaggccagggcatcatccaacctcagcaactagctcaattggaggcgatcaggtgattggtgttgcaaactcttccaaccatgtgcaacgtgtatgtcccacctgagtgctccatcatca

SEQ ID NO: 65509 - DNA, 482 bp, Triticum aestivum
  Clone ID: PAT_TA_65509
ctagttccaaattcccctccaatggacgctaccggcgcacagtcgcatgcagctcatataagtacgccttaccccatggcttcctttgagacacccgcacaccggtgccaccaccacagctgcggcgagctgcactgctgcgccctgaggccgccaatggtgaagttctccaagcagttcgagggccagctcgtgccggagtggaaggaggccttcgtcgactactggctgctcaagaaggacatcaagaagctgcaggccgctgccggcgtcgaggcggcgccgccgcagtcacagttccaggcgcccgtggctgccagtcactgggtgatgaggctcccgttcctcaacccccatggccaccacaaggagcacagcgccatacaggtgcacaggaagctggcgagcagcggcaaccacggcgcggtggccggagaggtgtacgagacggaggttctggacgcggcggggttcgccggcgc

SEQ ID NO: 65510 - DNA, 543 bp, Triticum aestivum
  Clone ID: PAT_TA_65510
gttgcaaaacaggcaatttttctctctcaatcggccatcaccactctacaagtctgtccagagaggtgcatttcctccatctgttttgcggaaagagtcagagatgaatcccatcaaccctagttctgtgcatgttcctcctgcatattcaaggaaggttcctcttactacaaaggcagaaccacctcctaagagtgtcatcacacttgacaacaaaaagttatgctctataagcaatcaggctgcacttaaatgtcagcccacaaaaagagacgcagatcctattgtggaaaaagaaactactgtgaagcttccattactgagcccaacatctgtgcttagttcaagttccaccgaggtatgtctagatactggaaggtcttcgtccagactaaatttgtttgatggaaaatccaagctggactcgctgcagcctgaaacaaacatacctcaagcaaaaagcccagagtctacaattccaaccccatgtgctcaactttccgatgatttgagagttgtttcctccactaagagccatgtcga

SEQ ID NO: 65511 - DNA, 634 bp, Triticum aestivum
  unsure (1)..(634): unsure at all n locations
  Clone ID: PAT_TA_65511
acaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgatagggacatgggtgattcanaccatcccggcaatgtgcgacgtgcatgttccaccatactgctacaccaccatatcaccatccagtgacgtcactaccgacatgggcggctactgag

SEQ ID NO: 65512 - DNA, 547 bp, Triticum aestivum
  Clone ID: PAT_TA_65512
acatgacaaggcaggagttcattgcgcacttaagaaggtgcaccagtagcctctagtaactgttttttgacttcctgtttttgtctctctatgtagtacctctgcaccatcagtgattcagtgatgcagtgccaacaattattaccattgcaaagaactatcgcactatagatcatttattaaattgttagcatatactagaaccctaaaccctaaatcctagagtactatagatcatttataatttttttagcatataccggaacaaaaccatggcaaaatctgatgaacatcttaaacatcactagagacaaaatttctcgtagagtacaactgcgtaatctgtgtgcactccttcacatacatgtgcatccaaaagggtgaaaaacatctggcgcgctcaccaaggcttgcaacttccgagttaaattttgttctttgcaggaacagcagtgggttctcgaggggagcatccatgtacagaggagtgaccaggtgccccatttttacccccatccgccagctttttcaccaccccaaaacttgc

SEQ ID NO: 65513 - DNA, 307 bp, Triticum aestivum
  Clone ID: PAT_TA_65513
acaggtcgaatgacattgcgagatggcgatgacaccgacgaggagcttagcgagaggcactcacctccattgttggcacatatcgcaaaccccggctgaacttcgatgtgtcatacgaaagtaattctgaatccgctaatgagtctgtgacatgtccatcaatgcacttgcatgggaggaacatcagtgtccggacttaattcatctgaatgcttcaaatgcgaggaggatttgatgactaaacttgaagtttcacaagataaatcacttgattctgttcctcgatcagttctccgtgatgagtccc

SEQ ID NO: 65514 - DNA, 385 bp, Triticum aestivum
  Clone ID: PAT_TA_65514
gccgtcgacttcgattgcagcaagaacggcagctgcatggacatccacgtcaacaccgtggcgatcacggccgcggacggtggagcaaccgtggctcgctgccagaacgcggaagtggacacctccgggttcgtctacccgaagatcccttgcgtagctaacgctgcatcgcccagcccggccaacgccccgtcgcccagcccacggcttagcagttagcacctagcaatgctgttgggcgcgtgtatatggatgggaacccacggtgtgcctagctatgctgcaagccttttcttctttttttgggcttattactgtgaaagctttactgcaaggtgtagggccatgtatattgcccagttacttttttttcttggagaaaaaa

SEQ ID NO: 65515 - DNA, 466 bp, Triticum aestivum
  Clone ID: PAT_TA_65515
ctgagatcacacacacaatggtgaaggctgtggctgtgcttaccggcagtgacggtgtcaagggcaccatcttcttcacccaggagggagagggcccgaccaccgtgaccggaagtgtcaccggactcaacgaagggctccacagcttccatgtgcacgctcttggcgacaccaccaatggctgcatgtcaactggaccacacttcaaccctgctggtcatgtgcatggggcacccgaagatgaaatccgccatgctggtgatcttggaaatgtgacagctggagtggatggtgttgctagcgtcaatattactgactgccatatcccccttactggaccaaattcaattgttggccgtgctgttgtggtccatggtgacgctgatgatcttggcaagggtggacatgagctgagcaagagcactggaaacgctggtgcacgtgttgcttgcggaatcatcgggct

SEQ ID NO: 65516 - DNA, 537 bp, Triticum aestivum
  Clone ID: PAT_TA_65516
tgctggccagactgatctaagtgggaatgcttcaaaggatgctatcctgatgcaaaagcttggagaaaccatttacccaatgaaggaagatttcatcatggtccatttgcagcattcttgcagtcactgctctactcttatggtagctggaaaacgctgggtctgccaccagtgtaaaagtttttatatttgtgacagttgttatgattcagagcaacggcttgaagaaaaggagaggcacccgagtaatagtagagatttgcatgtgctgcatccagttgacattgttggggtgcctgaagatacaaaggacagagatgatgtcttagagtgtgagtttttcgataccagacaggcattcctgagtctttgtcaaggaaatcactatcaatatgacacacttcgccgtgcaaaacactcctcaatgatggtgttataccaccttcataatccaactgcaccagcctttgttaccacatgcaatatctgcaataacaatattgaggctggtcaagggtggcgatgtgaagaatgccc

SEQ ID NO: 65517 - DNA, 189 bp, Triticum aestivum
  Clone ID: PAT_TA_65517
cggtgccgcgccggccgcggtgggggacgagctcgccctggtggagacgcgacagatccaccagtccatcccccgctcgccgtacgccccgacctccaccagaagcattggagaggatggaggcgcacatgtgtttttgggctgccactcggccggaattaatggagatgggggcgatggtgggtatgt

SEQ ID NO: 65518 - DNA, 641 bp, Triticum aestivum
  unsure (1)..(641): unsure at all n locations
  Clone ID: PAT_TA_65518
ctcatgctcctggcatgggatatatgaaatctaaagtgcgcaaggggaggggccctgcaaaactcactgaaccacgtagggtagctgacaggcctgtgctgactccgactaacgtggacacatgggatatcgaccctccttgtcccaaggtggcttctaccatcactttacttctcaagcagtggcacccnaggtcaacttacgtaatggcttgtcagcaaaccagcgaagtacacccacaacaattggttctccactttcaccagtatcattcggatagaagggctatcatcttggatgagttccttcgacgttacaagtgggcccctgggcgggaggcagagtgcctgaagctattcaaccgcagaacagtcagacagttcactggactcctgtgtgatgagaagcgaaaggctagagtgaagttgtttgcatcaaggaaagtgaaaggagcttcggatgctaccaagtccaatggacagtcaaatttggatgacaagggtgctagcaaaaagtcgaagctgccgcgcagagacccggcaggtgtagggcatgangatgacgaccctcttcagtggaagcagttccctcctgaatggatgctgccaaagtggtgggagatgctatgtgagcactgggct

SEQ ID NO: 65519 - DNA, 475 bp, Triticum aestivum
  Clone ID: PAT_TA_65519
catagatctggtcagcacgatctggacaacaagatcttgctacttctaatatgcgtgttgtagttataattccgcttgaagaattattctctggaaaagcacagttgatgtgtttccatgctaatgtagaccatatatcatcaatgacgacaagatgccttttatcttgtaatagttctcttagctttccaatggatttcttatcatcccagctctccatatcttttgtgaaatcatcattgtggggcacctgcgaaatcacatctttgatgattttctttgtatccggcttctgggagaccgacacaagagcatgacaatcaaaatgcccttgaatcttgcgatagacttcattcgccaatgttgtctttcccaatccaccgaacccaacaatagacagcaccctgcgacgttgctcgttctcttcttccatcatccacttggcaaggtcgtctcttggaccatctattccgac

SEQ ID NO: 65520 - DNA, 362 bp, Triticum aestivum
  Clone ID: PAT_TA_65520
ttcattcatcactgagtgcttagctacctccaagcttcagtcgagccgatcgagctgagctccctccccccatgaagctcctcctactttactcctcgcttctgcttctgcttctccttttgctatcctcccagggcctagcctctactcaaggtagagggccgctgcattaccagctcaaggagcgagctccaaagtggtgggggtgccggagggagcggaggcgatgtcggcggtgaggatcgggtcgaggccgccgcggtgcgaggggcggtgcgccctgtgcggccggtgcgaggcggtgcaggtgccggtggcgccgcgggacaagggggggagccacttccgcctgtccggggcct

SEQ ID NO: 65521 - DNA, 575 bp, Triticum aestivum
  Clone ID: PAT_TA_65521
catttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctgacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctgcttccagtcatctcagcaaaacccacaggcccagggctgtgtccagcctcaacaactgccccagttccaggaaataaggaacttagcgctgcagacgctgccagcaatgtgcaatgtctacatccctccatattgctcgaccacc

SEQ ID NO: 65522 - DNA, 464 bp, Triticum aestivum
  Clone ID: PAT_TA_65522
ggactatatggacatgatgcgtgatctacacatcgatgactatttgctcaagtggaacatccaaacagccaacctgttcatggtggagggggcgatgcctcctaaattctccaattcataattcactcaagttgatgttgtaagcctgagtgatgcttttcagttcaactaggaactcgtcattattggagtctttcatctgtatataccaacgcaaggcgggagaagaagcagattgattgatgaaagaaacgcaagaaaaagagaaaaagagccgctaaatgatttatggggcatgtgacttatccctgttggttctcctttccgcaaactaaaccaataatcaatattgtcagtttgagtgtatgctggatgtgagagttaatgaagatggtcagtcgtgctgttgaaagtacacaagctgttaaggtctatcgaaaaacatgtagatatgtttgggagcc

SEQ ID NO: 65523 - DNA, 557 bp, Triticum aestivum
  Clone ID: PAT_TA_65523
gccaccggcccctcgctccttgtcgccgctctggatggccactgctcccaacatcgagatgatcgcctcttcgctgcgcagctgctccctcaacggcggcggctggcggccgggccggcgccaccgccacggccacgccaggggcgctgagggcagcaacgacagcgaaggcgtcaccgtcgagctcaactccgacgtcgccctgccctaccactggcagcagtgcctcgacatccggacggggcaagtgtactacatcaactgggaggacggcacccggacgactatcgaccctcgcacgccgtcgctttgctccgccttgtcgacgccgcggtccacctgtttcacttcacaccgcgcagccttcacttcgtcgtccagctctgggtacacctccgcggcgtccagcgtcaccggcggctacggctacggctatgatgacagcgacggctatagtgaaggctacggcgacgacgaagagagcagcagcagcagcagccggagctccggcgtctcgtccgtgctctcgtctttcttccctagtaacgagccctcct

SEQ ID NO: 65524 - DNA, 489 bp, Triticum aestivum
  Clone ID: PAT_TA_65524
actggtctctccccatccatccagccgccggcgccggccacactcactatcactcgcagtagatgcatccaccatccaatcaaccaccgaatccaagctgactacggatttccgccgcacaccggaggagaattgaggaggagcttgggggtgtcggatccattgacctcgctgcgcggcggaggcggcgctccccgtcccttccagatcgacggccaccggcaggagctggggagcggagcgccggaggagccgccacctcgaaacaggaggccgctgcctgggacgcaaatcggctcgattggtcctagctagctagggtttcaatcagtcggccgggaccatggagtcgccgccgcccaagcgcaacgccggccacggcggcgaggacgggatcagcgcgctccccgaccacctcctcctcgacatcctcgagcgcctcgacctgcgcgaggcggtccgcgccggcgcgctctccacgcggtggcg

SEQ ID NO: 65525 - DNA, 574 bp, Triticum aestivum
  Clone ID: PAT_TA_65525
cttctctcgttcaaatccaaatccacacaatgcagttcactctctccgctgttgtcctcggcctcgccgccactgtcgctgctctccctccctccgctggtgctggaaacggtatcggcaacaagggcaacaccaacgtcaagttccctgtccccgatgacctcaccgtcaagcaggctcaggccaagtgtggtgaccaggctcagctctcctgctgcaacaaggccacctacgctggtgacaccaccgatgtcaactctggcatcctcggcggcaccctcagcaacctgatcggctccggctccggtgctgacggtctcggtctcttcgaccagtgctccaagctcgatctccagatccccatcatcggtatccccatccaggacatcgtcaaccagaagtgcaagcagaacattgcctgctgccagaactctccttccagcgccaactccgacctcattggtcttggcctcccctgtgtcgccctcggctccatcatctaagtgctttcgcatgctctctcgcaccatgcaagaagctctggtcatcattccggccctggtgggctcacgcc

SEQ ID NO: 65526 - DNA, 621 bp, Triticum aestivum
  Clone ID: PAT_TA_65526
ggtagtcgcagtgctcgtcctccgttgtcctcgccatctctgtcgtggcgcttctcaacgcggccgtggcgctgtgcggctgcagctacaagcgcatctttgcgttcggtgactccctcgtcgacaccggcaacttgttgtactccatcggcaacagcgcgtcgccaatcaaggagctcccctacggcatgaccttcttcaagcaccccaacggccgcgtcaccgacggccgtgtcgtcgtcgacttctacgcggaagcgctcggcctgccgctgctgccgccgagcatcccggaggaggcgtccgggcagttccccaatggcgccaacttcgccgtggcaggcgccattgcgcttccaccggagtactacaagaccaattacaacttcacgatgaacgcgccttccaacctcgaccggcagcttgcctccttcaagaaggtcctcgcgcgcatcgctcccggggatggtgccacgagggctctcctgagcgagtccctggtgctgatgggcgagatcggcgggaatgactataacttctggttcatcgaccccaggaacccccgcgagacaccggagaagtacctacccgacgtggtcacctgcatcggcgccaccctgc

SEQ ID NO: 65527 - DNA, 554 bp, Triticum aestivum
  Clone ID: PAT_TA_65527
tgcaatccccggggtcggtcggcagccgacacaacaccagatcgagcgtcgggcggggtcgggcgccgctcctccaggcggcggggtcgtggcagacctttagctggatctgcacctcgtacagcttgcatgccagcgtcctcttccactccttccccttcgacggcgacccctcaggttctccgacgagatccgcgtgtgcactcgcggcgcgagggagacgtcgacatcaggggtctctccctcccgtccgcatcaaggccggaggggactgccagtggtggactgcaagttagagagaagagaggcgctgtaaaactgttgtattcatctcacaagtgttacactggttacatataggagagagctcccaagagaagcggcacgcaggccatgcacagaggagtgcgggtgagatcctagagaataggactacgttacaacagctcaatagtacaagggcagttatatacgccggtcgaccggcccaggcttccgtcggtcgcatgggtatcgtttgattggagaactcgcaaccgtcagattaaaacatg

SEQ ID NO: 65528 - DNA, 397 bp, Triticum aestivum
  Clone ID: PAT_TA_65528
cgactacgccggcgagcaccagcagcaagctgcgccgcccccctgtcctaagctccattctccttctccctccttcctgtttcttctctctcttaactccctcactcttctcattgctacaagacctcaagtcaaacagtccaagcatgggcccgtcgcacccatcacgcctagccactgctcacccgctcgcctgcatgttgtgccgagggccgagccgcaactacttgtctgcatcgagatccaaggagacgaccgcatgcccctgttcgtctgcgcatccacaaccgaggacgaagctgtaagctcgatcctccctccctgcccctattctcacacctctccatggctgggctgtgcgtggcagcggggcggcggctaggctgtgtgggaagtg

SEQ ID NO: 65529 - DNA, 701 bp, Triticum aestivum
  Clone ID: PAT_TA_65529
accgccacaactgcagttagagttccagtgccacaattgcagccacaaaatgcatctcagcaacagccacaagagcaagttccattggtacaacaacaacaatttccagggcagcaacaacaatttccaccacaacagccatatccgcagccgcaaccatttccatcacaacaaccatatctgcaactgcaaccatttccgcagccgcaaccatttccgccacaactaccatatccgcagccgcaatcatttccaccacaacaaccatatccacaacagcaaccacagtatctacaaccacaacaaccaatttcgcagcaacaagcacaacaacaacaacaacaacaacaacaacaacaacaacaacaacaaatccttcaacaaattttgcaacaacaactgattccatgcagggatgttgtcttgcaacaacacaacatagcgcatgcaagctcacaagttttgcaacaaagtacttaccagctattgcaacaattgtgttgtcaacaactgttgcagatccctgagcagtcgaggtgccaagccatccataatgttgctcatgctattattatgcatcaacaacaacaacaacaacaagaacaacaacaacagttgcaacaacaacaacagcagcaactgcatcaacaacgacaacaaccatcgagccaggtctccttccaacagcctcagcagcaata

SEQ ID NO: 65530 - DNA, 596 bp, Triticum aestivum
  Clone ID: PAT_TA_65530
cgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtgggtgcctacctgcgatacttggtatct

SEQ ID NO: 65531 - DNA, 533 bp, Triticum aestivum
  unsure (1)..(533): unsure at all n locations
  Clone ID: PAT_TA_65531
gtccgcggcatattcctcatcactgaaaaatgttctcccgacgtgttaagccccaaactgtcgcgggcatcgccaagaacgcccagaacttcagcaccagcggccagaacaatgtcaaagttgctgtcatgggagcaagtggcggcattggccagcccttgtctctgcttctcaagaactctcccctagtcactgagctgtgggctgtatgacattgtgcacacccccggtgtggctgctgacctgagtcacattaacaccaactccaaggtccgcgcgtcaaatggacccgagcagcttaaggattcattgaagggaatggaggttgtcattattcctgctggtgttccccgtaaaccgggaatgacccgtgatgacctgttcaacaccaatgcttctattgtgcgtgacttanctcaggcttgtgctgaggtctgcccgaaagctcttattggaattatctcaaaccctgtcaacagtacggtcccaattgcttctgaggtgttccaaaaggctggagtgtatgatcccaa

SEQ ID NO: 65532 - DNA, 645 bp, Triticum aestivum
  Clone ID: PAT_TA_65532
caaccaattctaccacagcaaccaccattttcgcagcaacaacaactagttctaccgcaacaaccaccattttcacagcaacaacaaccagttttacctccacaacaatcaccttttccacaacaacaacaacaacaccaacagctggtgcaacaacaaatccctgttgttcagccatccattttgcagcagctaaacccatgcgaggtattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcagcttgaggtgatgacttccattgcgctccgtatcctgccaacgatgtgcagtgttaatgtgccgttgtacagaaccaccactagtgtgcca

SEQ ID NO: 65533 - DNA, 491 bp, Triticum aestivum
  Clone ID: PAT_TA_65533
gtttgggttgtgcattattccctatcccactaatgattttgctggtcaaacttgggatgtgatcaagaaggtggggaagcaccatagttttagtggcggtgctattgttaagtgcaccggaatctagcaacaaaaattatacataaacagtttgaatatcttaggtcgcacttctcggcagtgagttcagcacttggacgagactccaaacttcaaatgctcacaggtctaaattattggacacatcctgatttataagttatcttaaattccaaattatgagatgttgacaatctaaaatcattactaatttcgtagggaacatatattggtgtttgatggggcagatcaaatttgtcatcgtgatttgcaatcccatgttgacacttccccaaagtttgacatgctttacaattttttgctacatagacaaagtcaattaaggaactagcaagcgttagcctgaagattcccgatcatttaagtgtgca

SEQ ID NO: 65534 - DNA, 381 bp, Triticum aestivum
  Clone ID: PAT_TA_65534
caagaacgctgcctacatcggcacccctggcaagggtatcctcgctgctgatgagtccaccggcaccatcggcaagcgctttgccagcatcaatgttgagaacgttgaggacaaccgtcgtgctcttcgtgagctcctcttctgcacccgttgtgcggtccagtacctcagcggcgtgatcctgtttgaggagaccgggggggagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggccagcgctgcgcctagtgctatgaggctggtgcccgctt

SEQ ID NO: 65535 - DNA, 481 bp, Triticum aestivum
  Clone ID: PAT_TA_65535
ttggtgcgttcacacttctcatggatctttgtattagcctgatagtgttgggatctcgaaattttgatgtaggtgaagaagggattcctatctcgaaattctgttgtaggtgaagcgcctcctgtaggccatggagatgactttggatgcattaggaggcgggcgacgtgggagcgctggaaaagagtattgtattatgtatggtcctccttcactttttggaaggttgtatagtcgttttgatacataagatataatttcaggttctacatacatattggtttgagatgttttcattttttattatttcaatgaataatgcattctggatctgttttatcataccaatttgaggcattctgtaagggttggttggaggaatattattttttgacgcactatgtgtgaacatgttgaaggggcatgaccatcaacgagcttgtggcacaagtttgaatgtgagtagctcctatcttttgtg

SEQ ID NO: 65536 - DNA, 509 bp, Triticum aestivum
  Clone ID: PAT_TA_65536
cacaacctccctctcttacatcactaacccagtcagtggttatgaattttgctctctgaaggacgtgcaatgttatattgaatcaggggacacaagtaaatgcaatgttaggccaaagaagataactgcccaggatgcttgtattacacagaatcaagattatgtgagttcctcctattgttttcactttctgtagcttgcatgtttgtgtgggctggaaatgtgtgagaacaatgcaatctacaaaaacaattagcttcatcaattggaagttctcatcgattggaagttgcaggggattcagtctctgactaaactgattaactaactggtgtatctccttggcatgatgtgcattagcttcatcaattacaatgccttgctagagcttctgcccgtgtgtttatttcacaccacattcaaagttaaatgtacctgcgacgcctcttttgggactgctcgtgacgaccattctgtgttatcctgacatggcttgctatgctgttgcg

SEQ ID NO: 65537 - DNA, 659 bp, Triticum aestivum
  unsure (1)..(659): unsure at all n locations
  Clone ID: PAT_TA_65537
cagttcttactctgaagaacttggaattgacgacttagtgcattttgacttcatggatcctcctgcacccgaaactctaatgagggccttggaagttctgaactatttgggggcactcgacgatgaaggcaacctaacatctttaggtgaaatgatgagtgagttccccttagacccacagatgtcaaagatgcttgtcatcagtccaaggtacaactgttcaaatgagatcctctcaatatctgccatgctatcaggctgatgcagatagttgctgtatgttgagttattctgacaaagcaaatggtatcgtctcgcctctttgcatctgctgaccaaccgtgggcttcgtctgttattaccatatcctttgtctagtacccaattgctttctccggcctanggaggcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgcgagtactatgtcaacatc

SEQ ID NO: 65538 - DNA, 535 bp, Triticum aestivum
  unsure (1)..(535): unsure at all n locations
  Clone ID: PAT_TA_65538
ctcccggttgccattctccctactagtaaagcaacatagggaacacgacatttatattgttactactttcaagatggcgtccggccctcccgggaagctgtcgagctttgagccctctctgtggggtgatttcttcatgagttacgagccacaaccactacagatctattttatggatgatggagagagctgatgtgggtgagagagaaaatccacatgttgtttcggagttgcgatggggtgtgggagaaaatgttcttantggattcactccaacatctcggaattgatcaccactttaaagaagagattgacaatatgttgagcgaaatccttgggagtgaatttagttgctctagtctccatgaggtcgctcttcgatttcgcttgcttagggagcacggtcattgggtatctccagatgtcttcaacaaattcaaatgtgaaagcggggtcttcaacaaggatattacttatgatacaaggggattattaagtttatacaatgcagctcatcttctcatccatggtgaac

SEQ ID NO: 65539 - DNA, 515 bp, Triticum aestivum
  Clone ID: PAT_TA_65539
tcccgggctcgtggccgatacacacgccctcagcctcctctttgttcagctcaagaactcgacgaactcatcagcaggacagcagccggccggtggattcggtgcgtgcctctttcatggttcttttcctcgtttttgctgttcatcttggttccttctacgttgcacacgcgcgcgccgggcattctgtagttcatagttgatccgccacccccttcctctggatgccgctgccatttgagccccagtgcgcgccggccgccgcgcgcccgcattgcagccccgggtgcagatcacctccgggaccgtagtccatgaggaacagagcaagcacgcgtagcgtccgtggtggagctgcgcgtacaggggtgggcacggacgggtggtcgagcgaggagacaacgcgagcgaggcaggcccggatcgtcgtcgcggaggtcgacagccttgagcgggcagagcggggagacgcaggcggcggaggaagacccgcgcgcgcgagatgaccgtggccg

SEQ ID NO: 65540 - DNA, 456 bp, Triticum aestivum
  Clone ID: PAT_TA_65540
gaagactccaatgaatatgatgggagtgcatcagaggaaaactccaatgaatctgatgggaatgcatcagaaggagactctaacgaatctgatgggactgcatcagaagaacactctaatcaatctggtgcatcacaagacgcactcacactagacttaagtgcaggagggtataagttaaagcagctaagggacataagcaagttgcatttcaatctggagatctatggccttgaaaaagttaaaagcacggatgaagctcttgaagtcaatctagctgccaagtttgaggtcattaaactgacattggattggggtgatgctgatgatggtacaaggtgcagtccagaagttgaagcaaagatacttgaggtcctatgccctcccgtgcggcttttaactctgtacattggtggctacaaaggttcgaggtacccagattggatggtgagcaag

SEQ ID NO: 65541 - DNA, 480 bp, Triticum aestivum
  Clone ID: PAT_TA_65541
atctttatttgcttgttcgattcagtctggagcaggagcagctgctactcccgacctccgattccttctttccatggatgaccacgaagacctccgcatgatgtgctgctgctcggggccctccctatgcttctcctcgctcgtaagggtccagggttagctgctcaggggccatggtgtgttccgtgtggcgctgccttcgcggccgccgccgttcccttgttgtgtctctgagactggaggtccctgctcgccaactcacagacggttgttctccgaccagttaaaaaagaattttctgaaggaggaggtgccgaaaggggatgggagcaacaagtctgaatcgaaaagtcaaagaagtcgaacctgaagaagtgcagggaagaattatagttgcgtgtggctggctggttcaggggaatttcagggtggcgcgggtgccggagcaggctcctaggcactggcgatctgtcggacgga

SEQ ID NO: 65542 - DNA, 619 bp, Triticum aestivum
  Clone ID: PAT_TA_65542
acgtagtagttaacgcaaatccaccgtgaagaccttactcatcctgacaatccttgcgatggcaataaccatcggcaccgccaatatccaggtcgaccctagcggccaagtacaatggctacaacaacaactagtcccccagctccaacagccattattccagcaaccacaacaaacatttcgcgggggctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggt

SEQ ID NO: 65543 - DNA, 543 bp, Triticum aestivum
  unsure (1)..(543): unsure at all n locations
  Clone ID: PAT_TA_65543
ttttctccgttcctcctccgcctccctccatgtcgtccccgccgcccacatctggtggggagcagatcgccgacatcaaggcgccgcgtccgcacgccgcggacaccaccggcgcagcgggagacatcggagctgtcgaggcaaaccaagcagtgtccgtcggtgaggccaaggcgacgccgtctccggcgaccatctgccccgcctgcacggaggcgtggagcancgacggccctcatcgcatgtgttgtattccttgtgggcgtgtgtacggcanatcttgtatggagacgttgctgggtcgttctggccagaatagtgccaagtgccctcagtgtggcaaacaatttgaggagaagcttataatcaacctctacgcaccaaanaacatgttggagggttgctgcagtcctgaggaaattaaagcgttttacgaacatatatttgttgcagtaatggcaacgtgtattgagattcaacaatggtttagataacgggttgctcagatggagagaatagttaacaaaaagttgacaatggcta

SEQ ID NO: 65544 - DNA, 408 bp, Triticum aestivum
  unsure (1)..(408): unsure at all n locations
  Clone ID: PAT_TA_65544
aacaatcatggccgatgccgctctcgccgatcacccacgcatgccgcgtcgtggcactgccgtaccccggccgtggccacgtcaacgcgatgctgagcctgtgccgcctgctcgccgcacgcggcgtcgccaccacggtcatcctcaccgaggagtgggttggtctggttggcgcagcagagccgctcctaccggcgtgcgtgcgcttgaccgccatccccaacgtcatcccctcnaancatgggggcgcagccgactaccctggcttctcggacgccgttaacaccaggatggaggcccccgtgcagcggctcctcgaggagatgctgcagctgcaatcaccggatatggcggtagtcgtggtcgtggccgacttcttgttgcagtgggcggtgcccatggcgttga

SEQ ID NO: 65545 - DNA, 520 bp, Triticum aestivum
  unsure (1)..(520): unsure at all n locations
  Clone ID: PAT_TA_65545
caacgtcctactcaacaccatttggtatgacactgcattcccagctcaagatgagtttctgatagacatgctctgcactaaaagccttgcacgcttggaacaacggtcaatggctggccttgtgacatttgttcgtgccctattccctgaactcgccgagaatgtcgccatgttatatctacttaaggccaatgccaaccttcgtgaagccatttcaaaactgcagctagaagatcatcatttgtctggatcctataagaaagcgtacaagatggccgctcaggtagcatgtcatcccaacccaaaagcgctacgagagtntgccctgtcaactgcgccatcaatcatgtcctccgtacgatcacttgtgaaaaccactgcacacacgttatcctccagagaagtcggtgacatctctgccctgttggcatctctaaggccgtcagtccagaaagttcccaaattgacgccctgtgcgtctagttttgtctcacgccgccaggcaaggttcgaggatgat

SEQ ID NO: 65546 - DNA, 604 bp, Triticum aestivum
  Clone ID: PAT_TA_65546
acacgcgggtgttccagcaggtggtacgagcggggcagtcggttatcatcgaggagtgcgaggaggagcaggtggaatcgccgcacgccaaggacgcgctcccgggaaaggaaaaggagaagaaactacctcaagttaaggtgagacccaggcctgaaaagggaaatcgctctggagtcggctcaagaacaaggagaagaaactacctcaagttaaggtgagacccaggcctgaaaaggggaaatcgctctggagttggctcaaaaacaagatttttcgtagagaaggaaggcaaatatgttcagaacatgtgaagcaccagatttttcgtagagaaggaaagcaaataggttcagcacatgtggagcaccagcaacagatcaatatcagtgatgggattatatatggcagtggttttaaaaaccgaatattggaataaaaacaaactttccatcacctttttagatatgttgtttccatgttaaaaaatactccgtaatttgaattcttgtatttgtgtggttcttgcagacacgtcccatcaatgaagtaaggaatcgttatatggtttcttcttacgaggcgaaccatcttgatgcctatt

SEQ ID NO: 65547 - DNA, 390 bp, Triticum aestivum
  Clone ID: PAT_TA_65547
tgttgccatctgcagtcagccggtttactgtcaggatggtcacaggcgacaacattaacacagcaaagcaattgcccgggatgtggcattttgactgaaggtggtcttgccattgaaggcccagattttagaactaagagtgcagaagaaatgtacaaattgataccaaagatacaggtgatggctaggtcttcaccacttgacaagcacaccttagtgaagaatctccggactacacatgaagaagttgttgccgtgactggtgacgggacaaatgatgcacccgcacttcatgaagctgatattggacttgcgatgggcattgctggaactgacgttgcaaaagagagtgccgatgtcattattcttgatgacaacttctccactata

SEQ ID NO: 65548 - DNA, 430 bp, Triticum aestivum
  Clone ID: PAT_TA_65548
caagtctctgccttgggagttcccgtgtacattcttctagccttgtacacttgtaaataaatctggtgttcttctcatagggttctgcgtgctttgcatgtacatttggattttcattactcctcaaagattcgatggtctactatgtagttccggtgtgagaatcagaatattacaatatcataattcagaaatgaattcgacttcgatgctgcattattgatattaccagaaaccttctaccttcctgttcacaaatctggcttctacatactttgcatttaaatttcggtagccatcactcatcgggacttcgtgtacactactaaattgactgtcgagatcaagatattaccacgaaatgattggagaataagtcagccttcagtgttctgctattgatacaaggtgttcttatccttgttctcat

SEQ ID NO: 65549 - DNA, 252 bp, Triticum aestivum
  Clone ID: PAT_TA_65549
ctgtttgttcgttttgtcaagcaataatagtcagtactcacctcatattgaataacccattacacccttctgtgtactatttatataagtaaacatgtcgattgacaccctttgtctttttaggttcagagaacatcacttatgcctggaataaccttgatgttcattttgctccttgagatgtatcttctgtttagatgtatctctctgtctcttacctctcatctgtcaaatttgattcgggaatcggga

SEQ ID NO: 65550 - DNA, 543 bp, Triticum aestivum
  unsure (1)..(543): unsure at all n locations
  Clone ID: PAT_TA_65550
agatcaccgagcccagcgcgcgcacaggacagcaggcgccgcgatctcggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccanggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctct

SEQ ID NO: 65551 - DNA, 528 bp, Triticum aestivum
  unsure (1)..(528): unsure at all n locations
  Clone ID: PAT_TA_65551
ggcaaccatggcggtcggcaagaacaagcgcatctccaagggaggaagggtagcaagaagaaagccgtcgatccgttcaccaagaagcagtggtatgacatcaaggcgccgctgctgttcaccagccgcaacgtcggcaagaccctcgtgtccaggacacatggtaccaagattgcctcagagggtctgaagcacagggtgtttgaagtatctctagctgatcttcagaacgacgaagaccaggcctacangaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaac

SEQ ID NO: 65552 - DNA, 333 bp, Triticum aestivum
  Clone ID: PAT_TA_65552
cccaaacccctctccgaacccagaactgctccctcggcggcggcgcgttgagatggctgacggcacggagagcgagcaggccgcggtcgtgggggacgggaacccttcgcagttgtctaagagcgcgaagaagaagctgctgaagcaggagcggcaggcggcgcggaaggccgagcggatagcgggggagaaagagcgccggcgcgccgacatagagcggcggaggcgcgagtgggaggagtctctggccgcggcaccctctcatgatgcgcgcgaggcgatgctggccgcgcgcagggagacgcgactcgagcgggtgggaaagcgcgtgga

SEQ ID NO: 65553 - DNA, 349 bp, Triticum aestivum
  Clone ID: PAT_TA_65553
agtaaataatcacatacagtgaccaagctgaggacgaaatataacataggaaatactcaataagcaaaaggataatccctggaaatgcaatacatattgcaaacaagcatttaagcaaggcctttataatagagcaacatcacatagtgtagcttaaaatacgtacaattaactatgtttctctttctcttgctgaaaatcacaatactgcacatgttcctacctactttgtgatcagtgaccatgtgcatgcctaaacctgggattatgattcttttgtttcctctgcctacacacctaaatgaaaccagtgagtttgcacgccatttattcataaagcaaaaccaca

SEQ ID NO: 65554 - DNA, 512 bp, Triticum aestivum
  Clone ID: PAT_TA_65554
gcagcggctgccgatgggcgcagcgccgccgtgcgacaccaccgcaccaccctcccggcgtggtgcgtcgccctcaccccaccccccacccatctgagatgcagcccgctcaaccccagcgacgcggccgcaccccacccgtgcgatggcgacaacctcggcggcgaggcggagtgggtggcgggagaggcggagtggcctttgccggcagccatgagcagcgacgacaaccacctctaggcttctgctgctctccccgacgcggggctacgtcgacgacgtccgcggcgacaacgaccatgtccacgcatctgccgctcccctgacgtggtgttgcgctccgacgacggccgcggggacgatgaccatcccagccttctgcgctctccgacgtggtcacgaacgcgagctgccccactcccgccggggagcttggacatcagcaccggtgtgctagtcagagctctgctcggtaattcccattcttccatttctacgtttcgttttgctct

SEQ ID NO: 65555 - DNA, 428 bp, Triticum aestivum
  Clone ID: PAT_TA_65555
tgtggcctgttgtagtctctgcctcctcagaacaacaagcccccgcagccgcgcccggatcggatggacaccgccatgcaccccgccggcgccgacgacggcggcctcgccgacccgctcaccggcaacgcgggcacaggcaccgagggcattatttgtggtatgccagacttcaagatgggtggaaagaggggcgatgaatctgcccctactgatgctggtgatgaagacggcgaagatgatgacggggatgaggatggtgacttcgcggagggcgaagaggaaatctcggaaggagaggagtatgacaaccccaaggccagtgacgccaagaagaaacaaataggcgagggtgaggagaatggcgaggatgatgaggaagaacaagaggagcaggagggtggaggaggtgacgacgatgatgatga

SEQ ID NO: 65556 - DNA, 474 bp, Triticum aestivum
  unsure (1)..(474): unsure at all n locations
  Clone ID: PAT_TA_65556
gcagggcctctcccctacggaactagtgcgagctcggccgcccgcccgctcgctcctctggcggcgccagcgtcggatggacgccgcctcctgctgtcgcgtcttctcgacgcagagatgccccttcccgctgcgcaggttgggggcggcaccgttctccaccgggctgagcgagctcttcgacccgtcgtcgtcggtctcgaagcgccggtcccgtggccccgtcatggccgcgaagaaggccgcggatggtacgaaacaaaaagatgggaaatataagcacacggtggatctcccaaagacgacttttgacttgagagcaaactctgttatgcgtgagccggagctccagaagttgtgggaggagaaccangtgctgaagagggtgtctgaaaggaatactggggctacatttactcttcatgatggccctccttatgctaatggtgatcttcatatgggtcatgcgctgaa

SEQ ID NO: 65557 - DNA, 544 bp, Triticum aestivum
  Clone ID: PAT_TA_65557
ttttgcatagtaaacacttttactaatacttgcaaacaaacattgctttgtttgtatctgaaaataattttcagttccatgaatatcatataactatcccaactttcgaagtttgggtttcatggaagcaaacatattgcacttgactgaaacggaattatagcttttggatcgaaggacgagagtcacatgatccatagctttagcgggaggatacggaaagcatgcgataggacaaagtccttctcggcacttttgaggacaatcctcatattacgttaccaatcgtaaagttttaaccaaatatttaacagttattcaattttaatagggaaggtggaaacacgagccattattctacaactattttgcaagaaacacttagacagtgttcataattaattgcactgagaattaaacatgttaattcaacagtgcgctcccactcaaatcaatatctctcacaattaattttgagtgatacaagatccagacttcaattcatcgccatagaatcatcatctcataacgggaattttaatcg

SEQ ID NO: 65558 - DNA, 441 bp, Triticum aestivum
  Clone ID: PAT_TA_65558
tccagctgtctctccggcaaggcagtggccgaagagacgtgtgcaccgtccaaaataagaagtgtcataacaggtatcgaaattcaccttccaggaccatgtcctctgcatcggagagctcttacagcgatgcagtcggtaggagcagtgagccagtgatcaacctggaccaggcgctccaaggtgggagagctgtgcctcctggagactcagccgggagaacagaatttgcagttggggcaatgccggtggccagagtgaagcatatgtgttccctggaataataagtaccctgactcgcctatttcgtttttttactgcacatcatacgcctatttctaactgcatgtatgtactaccaaaaacatacaatgactggatgatcttgtactacagttagggctgcaggggagtcttcatgtgcagctaatcgtcgaggcg

SEQ ID NO: 65559 - DNA, 436 bp, Triticum aestivum
  unsure (1)..(436): unsure at all n locations
  Clone ID: PAT_TA_65559
ttgcagctatgcgtgtcgataaggaccaagaaatcaaagccaggcggcttggtaactcaaaaggtctgggagttctcaactgcttcctggaagaagcgcaacacgaagtgggttggcacgcaacttccaatgacggcggcactaacttgaggcggcgtactattccatagagtccatttcgctctgtatgtggttcgttccattacgtattagttttgtggttgagatgatagcacagatgaccctgtgataatcttgggagccggggaaagggcagtaggctcggatctgacgtgattgcttctctgccgtanaggaagtggccctgaggcgaggtctaaccccctacggctcgccctcgttttgtcgtcgatgcacctgatgcttttgtatacgctggacgggtctccacgtccttctcccatctgtaatgtac

SEQ ID NO: 65560 - DNA, 560 bp, Triticum aestivum
  Clone ID: PAT_TA_65560
cttcctggcgtcccttctccggcccgcctcgtcgtgcccctcctttcgcctcccctcctccacagcccctgcacctccgccgagcctcctttccaggcggcacaaggcacctcccgtcccacccacgccccacacccctccttcccggccccgcgtcgccgccgccgcagcctacggaggcgcccagctgctgggtcccgtcgacacgcagacattcatcatcgccgcctccgtcgtcgccgcggtctccctgtcactcgtcctcggcctcaagggggaccccgttccgtgcgacaggtgtgctggaaacggaggcacaaagtgcgtcttctgcaatgacggcaagatgaagtcggataacggggtggtcgaatgccgggtatgcagaggagcagggctgatactctgcaagaagtgctcaggttctggttactctaagcgcttgtagccccagctgcccaacattatgtgcatttgtcaagcagacaagctagctggagtttacacgtctgggcgctgtacagacaaatggacggctcctctccattgccgaactgttt

SEQ ID NO: 65561 - DNA, 604 bp, Triticum aestivum
  Clone ID: PAT_TA_65561
ttctaactaccactgtcagttttgtgtcaaaaaaaaaaaaactctcaatcaagctcttcacagtctatgacttctattgttgtagtttgattgatatctgccaggaccctagcggtatttctcagaagatttcgacattgagaactagttcagttaagtttgaatcatgatccgctggcacgaagcactgtgggccgttcatgtatcatccaatgtcttatagttcctccttaccgcttcactgttgaagatgaccgagacgacgtcgattcttcatcggacggctggaaggcgtcagagtgttgttgtttgctttccagcaaaagggctacagtggccaactgccccatctgcttttcttttgtttcctacaatcttgtaaggctataaagccaggattctagagccttccgggacattctggttgcatttgggtaaaccctagctgccagtgttcctggttggcccttgggtgtatcagaactcgttctaacttcctcgcaatcaatctcaacttttgctaagttctgttattcagtgaatacttgtttgaatttagtcttcagaccatcttgggtctgacaatgtcacaagttggttaaca

SEQ ID NO: 65562 - DNA, 416 bp, Triticum aestivum
  Clone ID: PAT_TA_65562
tcctccaaccccgtccgccgccacggccagtcagacgtggtggcacgccaccaccacatcaccatcaggagctcctcgctgctccatcgatgagccccttgctgcacctcgtcttccacctccttacgccaccgatctgaagctcttcttcccaatcttgctgctgctcctcttcaccatcagcacgatgacgacgacgccagctgcctcttctacaccattttgtgttgttgctgccgttctctctctaaattttctgtgaacttgagatgtgtaatgttcagatttgataaagtgcttgcaacatgctatttgtttagtttcgcacttgtaaaatatagtgcgtgttttgtgtgaactgactagttgatgctttgttactttgggaagtaattcatctatcagattttgtttaa

SEQ ID NO: 65563 - DNA, 243 bp, Triticum aestivum
  Clone ID: PAT_TA_65563
tggctacgcaaatgatcccaaagagaagactaccgttgggccttttgatcgaccacgcgattcaaaaagctctttagtgcagtttgcaacaacaaaaatcagaggattggtcgtttgtaagggcggatatctcagaagcggcagccacccggattggaatttaatttcaatcaatttccctgtctgaagtttcatactagatgagttgcaagtggtactatgttccttcgctgtgtcgacccg

SEQ ID NO: 65564 - DNA, 417 bp, Triticum aestivum
  Clone ID: PAT_TA_65564
cgtgagctgacggcgccgatccattttcttcctcttcgacaggagacacgcccattaccccccttcctgttcctcccgccgctgctatcgtgcaagaacttggtaccagagagtgtgtgtgtgagagagaggaacgattcgtcggtgccatggcgccgccgaagaggcagctggccctgacgggcgccggcgcaggccgggaggaggcgaagcgcctgcgcgtcggggtcgccaaagccaacgccgccggctggcgtgcgccgacatcgccggcctcgccggggacgcggctcatgcggcggaccgtgctcgtcgtgctctttctactgcgaatgagcgacgggatcacggtgacggaaagcatctcccagattggtcgcatggttcagaggaagatggaagggattcacaaggttc

SEQ ID NO: 65565 - DNA, 586 bp, Triticum aestivum
  Clone ID: PAT_TA_65565
tgtttggtaaaagctaaactaacctggcaattccatctagcctgcacacgctagaaaagccttgccccagcaggagggccaatttggctctccgttggtaataaatgagtggaagaaagaaatcaaggtaactgccactggaattgtgcttaaccaaggagattggtagctgaaccaaatagctggctttgcccacgtaggctgtagctcaaaagccttggttagctcggcattgacggcaaaagatataaacacaccctcaatgacatcactccctctaattcacaagtgctgtttggacattagcacgctccacaccgtaacttcgacaagcaatttctgctatcatgcatacatttaaattttttctgagtggacagagtaccatatgttgacttaggtgaacatttctggtttgtgcaatatatttagttgccgagttgatcgattagatttagatagaaagcgtccaaatacgaagaaaattgctgagccattaaactgttttctggagatcaaagtcaccaagtattctatggagggctcgcagaatggcgcctgtacagaaatgagttgactttgtgtt

SEQ ID NO: 65566 - DNA, 478 bp, Triticum aestivum
  unsure (1)..(478): unsure at all n locations
  Clone ID: PAT_TA_65566
cccacgacggccagccaccgatccacgagtccacgaggagcgcgatgccagccgggggaggagaagcaagcaagcatggccgcacgggaaaggagcagagccacccgccggcgatccgccgccgcgacgggtcccgtcctgcgccgccgttccccgccgtagcttctcagaagacgaagaagcagaggaaccagaggcaaccgccgccgacggcggcggcggcggggagcgtctcctccgagggccccctcgccgagatcctggcgcggctgccctaccggtcgctctgccgcttccagtgcgtctccaagcagtgggccgagctctgctccgacctcatcaaaagcatcaagacggcgccgcagaccctctccgggttcttccacaacaacttggccggcagcctctgcttcancaatctgtccggcggacgcccgctggtcgacgcttcgctcccgttcctgcgcgagagctacca

SEQ ID NO: 65567 - DNA, 499 bp, Triticum aestivum
  Clone ID: PAT_TA_65567
catcaaagccagcaacatccctactggacagatgcttggagtcgtgcgtgtctggttctggcctcgcaaggctggtggtggacaatgagacccatgtgcccactgtcatggcgggtacctagcaccagctttggagtgcttttgctggaacagcaacaagggcagcagcatcatccactgactgaacacggtgactggggaggagcgtctgtatgagattgtggactagaacgcggaggtggaggggattttgagatcctgattcctccgcctccaaatcttcggtcgccccagcaagcaagctccaggagatacaggcttggttttgctcctactctagctagctatatttctgttacctgaactttgcgttcctgccactcatggacgcttaactgaacctcaacctggacctgggctttctctttgtttcattttgaatgcatgcatcatgtgtgggtggcaggagagcaactttcttctcaacggaggggtaagc

SEQ ID NO: 65568 - DNA, 571 bp, Triticum aestivum
  Clone ID: PAT_TA_65568
agtctgagttttttttttttttttttgatgtccacgacgagtttgattgattctagatgtccgacattgtggtggaacctatccagctcctccgatatatgccatgatgccgtaactcgttgtcgatcgtatcgcgttccccggtggcgacgcgcttatttggcctcgtcgaagacgtaggtgaggtggcactttccgcagtactggcggttgtgcatggcggccatgaagacaccggcaccgcactcggcctgggggcactcgcggcggaggcgctcgatcttgccgtcaccgtcgaccttgtagtacttgaggaccgctagcttggtcttcttgcgcttgtgcttgatcttcttgggagtggtgtacaccttcttcttgcgcttcttggctccaccacggaggcggaggaccaagtggagggtggactccttctggatgttgtagtccgaaagagtgcggccatcctcgagctgctttccggcgaagatcagacgctgctggtccgggggaatgccctccttgtcctggatcttggacttgacattgtcaatggtatcagagctctcga

SEQ ID NO: 65569 - DNA, 518 bp, Triticum aestivum
  Clone ID: PAT_TA_65569
acggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccaaacccactcatcaaggccaatgacaccatcaagcttgacct

SEQ ID NO: 65570 - DNA, 546 bp, Triticum aestivum
  Clone ID: PAT_TA_65570
cttattgacccctcccctgcatgctagctagctgcctaagattacattgcgagctgcctaccgattacagagcaacagttgcctgttatattaggtgaaccgccaaggagtatgggcggccgcgctccaccagctgggagtcggaggaacagcggcctcggtccagagaagcagcagcaagagccatggccggaagagatgtcgctcaacgaattggctatgatactggcataccttcagaagggcgtaatcggcatgggctacctggcgcttacgtggtcgacggtagtcctcctgggtggcttcgtcaccgcgctggggaagaaggatttttggtgcctcaccgctattagcatgatacgggcagcctggaacggtctaccaagcatatgggacaagacggattgcatccaatatcaagaacaatgaaatcaatgggtacataattcctatttgcaaggataagaacattatttattttacccaaaggtttcttgaaggtagaatcctctaagtgcaatgttgaatcaccacttaccgggatta

SEQ ID NO: 65571 - DNA, 574 bp, Triticum aestivum
  Clone ID: PAT_TA_65571
cgggtactcgctgttgctttcagccgggaacatcatccaatcacacgacccagtaagttctcgatcccagaatccattagccagttaaagcacctatgctatcttgctttcaggacattcaaatgcactgtaattttaccaagtgcgctagctgaacttcaccatattcagctgctagattttggtcatcatagccaaacttctgaatttactactgataaccttaccaacctgcggtacataatgtgcaagagtgtgaaatgtcctaacataggaaggttgatctcactccaagcattaccatgcaacacattcacagtaaggaatgtacagggttatgagataaagcaactgagagacctaaacgaccttcgtggcaatctggtaatcaatggccttgaaaatgtcaaaggcaaggaggaagctcttgaagccaatctaggtgccaaggaacggatcacagaactgatgttggaatgggattatgatgatgatacaaggtgcagtccagaagttgaagcagaggtacttgagggcctgtgccctcctgcgaaacttgaaacactgatgatcg

SEQ ID NO: 65572 - DNA, 505 bp, Triticum aestivum
  Clone ID: PAT_TA_65572
gtggtggtgatgatgaggatgacgatgattgtgtggttctagatggtgaccctgagaaggcaattaccatcggggaggacaaggggagtgtgggagatagcagctccgatgaattgcagatagtcggggagaaaggaccggtagcgtgcagggacttccctcattcacgccatctatgttctaacttgcccttcagcgctacttctcacgtgaagcattgtagcatgtgtcactgttttgtatgcgatgccccagctccatgtaattattggggtaaaggtatccagcttaatgatcattgtcatgctacggataaggaatcaaagtggaaacagctgcggcaagcattcaagtctaaaagtcttccagcatctcgtccagaacaatgccagaatgtcatctacccaacaatggcaccatccattaagaaggatatacagtgtcaagtctcgtcttttgcaaacagaagtcctcttctgcatgttatgagccaaaacaaacaaag

SEQ ID NO: 65573 - DNA, 358 bp, Triticum aestivum
  Clone ID: PAT_TA_65573
gtcgtccatgcccggcggcccgggaggggcactaccggccgctggtggtgcccggatgccgctggttggagcagggaggctctggccgcggttggatgcggggtgcagaacccgatctggttctgcggttccgtcgtcgaggaggatagctggtggccctgcacagtggtggcgtgctcgctgtgcgggggtgcacgtccaatggaggtacgggttgaccttggcctgctgtgtgggagtggctggactgggcgaaagcctgcccggtgatggccggccggcggcgacggcgtctgtgggcgtcgctaggaatcttcatagcctctactctcggatcatgttcttggggtgaaaaccc

SEQ ID NO: 65574 - DNA, 347 bp, Triticum aestivum
  Clone ID: PAT_TA_65574
cccttctcttttgaacagaaaagaggtgatgacccttgtaatcatgcacaagctctttgctttttacccacaaaaattgttagttgatgcttgctaactgcaggtccagccaactggtaggtgggtgtagatgcttgaattgcatagggccaactaactgccccttgatgggggcaaacaagatgttgttgatacataaatgtgtcaacattgacaccccaactcacacttgtttttccccttgtgtaatgagttcatcttgcattgcatctacccatggataagaattgtacacactgtaattttcagttttaactaggctgaaatgtgcgttttttatcttctca

SEQ ID NO: 65575 - DNA, 548 bp, Triticum aestivum
  Clone ID: PAT_TA_65575
agcgcagctgcttcccaacgacaacgccacgcctccttcctcccccctcgctctccgtttctcgccccggatcgggacgcagcctctcgctccgcgccaaacgcaccgcatcgaattgtccgcggccccgcgcccatggaccgcgccgacgggccggcgccgccacgctccggcgaccgcgcggtgcatgaccaggatgacactgcccaaggtgcacaggggaacaattcgcgaaggccaaacctttctttgcaaataccaaccaggaccttggataaccatatacctagttcaacgaggattaatatatccgccagccccagttcgacaagagctggactgccgccaaggcctaactcagctagaccaaaatcatctatcaagcagcagagtttcaggttaaggaattcaacacaggaaggtgaccggacaatccttctacttcctgggacggcgtcggaagggtcgcaagataatccaactcaaccaggatctttctcttttagaaaggtcattaactcattatcggcaaaacgtacctattcttt

SEQ ID NO: 65576 - DNA, 195 bp, Triticum aestivum
  Clone ID: PAT_TA_65576
tttttttttttttttttttggctatcaacacatgttttatgagcgtatctaataggacgaactgatccaaattttacaggtacaacacattttcgaacttgcataacaaagtggtgcatttgacaaactacaggatgcccatcaagtatttttcagtctcagctcttccgccttctggcattgttcccgcggtgt

SEQ ID NO: 65577 - DNA, 582 bp, Triticum aestivum
  Clone ID: PAT_TA_65577
atcatgttattgatttgtgtgaatattgtgtgttccattgccaagcagaaatctcttgatgcaattcaagctttgaatataaaatacttataatttttattctttttgttctcattcctctggtagttctttgatagcaaagtgcactgctgtcagtttactcttaactccaaagtccaaaccatccaaggcatgagcaagtcttttctgaggttcatgctcggacatgatccttctaccctactccttcttgtccttttttgttttctgttgttttacttgaaaacgagggatgctacaactataaggacatcatttcttgtttcaagcaatttattagcctgatgtcttaatctgatataaacttgacgtctattgattcttttacatcttacactaaccaagagcatacctagtaagtctggactctggagtacatttacagaacttgatttttctttccatgcttctaagcaagcttggtgaaaagagccagattgtaaggacttcttgtggtttcaggtgatgatagcttgaaatcctcaaaagctactcaggtggctgatgtcaaaactaaaaggc

SEQ ID NO: 65578 - DNA, 608 bp, Triticum aestivum
  Clone ID: PAT_TA_65578
cttacaaccgaaaccgataccaccactgctgtcgcagctacccatcgttcaccaccatccgcacacggctctctacacgtacgaatcaacaccatggcgatcgcgaacccactcctcaactttgtcgttcgcggcttccaggctcttttcggtattgtcgtactcggaatatccgtctcactcattcgcggtcaccactggggtggtctccccgctagtctgggcttctcagcctttgtcggtggcgtcacgattctgggagcagcgcttggagtcgcgggactgttcttcagcttcttggatggtatgatcggattgatagtcgacggcgttgttgctgtcatcaacgcggcaggtggcatcgtcctcgctctcaagatctctggtgtggattgcgatgccgacacaaccatagagaacgcgactaagctcattctcaacgacatcttcaatggcggctgcagagccgaagacgagtgctggtactatttcgcgaaaaacggcgacaacaccatgaaatcgaggtgcaagtcgacccaagccgactgcgtcttcatgttcctcaccgtcattgtcctcgccgtgactgccttgctggctttcttgcg

SEQ ID NO: 65579 - DNA, 390 bp, Triticum aestivum
  unsure (1)..(390): unsure at all n locations
  Clone ID: PAT_TA_65579
ttgacgccgtccgcgagcccgggtgcacggtggcgctcgcggacctccaccgctgcctcgacgctttagcgagtcatgcgaccgagccgagggcctcgtccaggtggccgccgccggactttttttttttccgcctcccgccacgacgagctgttccgcgcgctcacggacctccaccgctgcctcgacgccttcagcgagtcccgcgaccgccccgagggcctcgcccatgcggcggccgccggcctcgnccccgccgcctctcgccatgaccagctgttccgtgtcgtgcgcttggtcgaaaaggatctccgggcctccgctgccggccgggaggagaacacgatggaagagaagaagaatcgcccttcgaccatgccgctggcggcc

SEQ ID NO: 65580 - DNA, 355 bp, Triticum aestivum
  Clone ID: PAT_TA_65580
gggggtcgtggtcgaccacggctgcggctcgagacgccgacgaggcgcagctagtgcgcgaccgggtgcacggcatgggtgttatatgcgagattgccagatgtgagtggcctaatgggcggccaaagctagggcatctgcaagaagcagcccgcgaaatgaggtaccaaaaactgttggacatttgtataaagcagcaaataggagtgttgcttattgcacaccactctgatgaccaggcagagctctttgttctgagattatctcgcaacagcagggttctaggtcttgctggtacagcctttgtgtcccattgtttgcacctaatttaaaatatgatggacataatttttgt

SEQ ID NO: 65581 - DNA, 400 bp, Triticum aestivum
  Clone ID: PAT_TA_65581
gttggccaccgcggaccgcgccgacgaatccgcggggtggggagcagcgccgtgtggtcactctcgccggcgtcaccagtggagaatcctcactggtgagatgcaggccgtaaagcggcgcggccacggcgaggcgtgcgagggcgaggcctcggcgcggacgggtgcagcggcgccaatgttgcgggcgggcgcagcgcgcgagggcgagggggccggacgcggtgccgttcgcgagcccgagtgccgcggggctccgtgagccggagcggccggagtggccgttcgatggagtcggggatggcaggcgcggcggcgcggcagcgtcgcccgggacacgcgcgaccgtcggcaacctctggagcggcacgccggcttctgcttcaacaactgctggggt

SEQ ID NO: 65582 - DNA, 534 bp, Triticum aestivum
  Clone ID: PAT_TA_65582
acaatcgtcatttgtcgcaatacactcgcgacaccgattgccactgattggtttattttcccgctaacacatgtttacgtaaaatgtatacaggtttaggaaaatcctagcttacaagagaaaatcaaattgtacaaattgcacggacaactagtaactcgcattgtaaatcagtagccttatcactgccaggcactcacatcgcaagatcgagtgttcaacttcttcggcttcccgagcaaacacacataactttaacttgtcgtccttgaactgcgatggcttggccctgtgctcgcttatgtatcagttgttgtcctccgagctgagtagacgaatcatcgctggcatgatcttgtgttggtcctttttggcttacccagtaattataaaccagtttagcacaacttttttttgataaaaagttttagcacaacttttttttccagctagtgagcgaacacaatgtttaaccgaacgaagttatgccataacgagcacccacatactatcccctgtatgcactttgtcttt

SEQ ID NO: 65583 - DNA, 478 bp, Triticum aestivum
  unsure (1)..(478): unsure at all n locations
  Clone ID: PAT_TA_65583
cacatccaatctcggcactggagtcaaattccgtttcaagacagatggcgcctcatctgcgagtagctcacccgtgccatcatggaagagtgaaccatctatctccccaacagaatcatcaactggaaatgcattgcccgacaggctaacacatcgtcaacaaatctcacgctttgggcaatcagcctttcagactggcagtttggcgtttgcaggtttacaggattcagcgtcatccaccagtctctcactgaaaggttctctgacaagtaacattttaatgaacttacaaaacaagggcatcttgagcaatacgcagtcttccctagagacatcatctgccagcctacagacttcagtttcctcatccttcatgtccaagactctgccatcggtgaattctgatttaccaggagcagcaccttccanatccgcatggaaaccgtcaactttgactgatagattgagcacatcctct

SEQ ID NO: 65584 - DNA, 658 bp, Triticum aestivum
  Clone ID: PAT_TA_65584
ctgcggcgccgcctgggggacgtggccatggccggcggcaaggcgggggctgtcgcggctggcgccgcccgcgcccgcggcggtggtgcgcgtggacagcaacaacgtggcccgcctcggcgcgcccaagcccgggccgaggccgcggcagctgctctccctgccgccgttccccgccggggccgacccgctccccgggaggaacgtggcacctcgccgcgtgacggcggtcagctgggtgaagcactgtttcgccgacgtgccgcaggaggtcgtgcaggcgcacttcaacaagaggcaggtttacactgagtgctcagatcaggaggtttcagcagagagcatttggtgccggaagcatcatttgaagaagatcaagcattctgaagtgatggagcctggcatgagaattcatcttcctgtgtctgtggctgaggctgagataaagaagcggtaccagaccattccaactgccacactgcatcccaacagggatgagattgagtacctgaaaaggcttgtcatctacaaggactcagccatacttgtgcttaacaagcctccaaaagtgcccatgaaggggaatttaccactacataacagtatggatgtgcttgcagcagcagcactgtcatatgggaatgaagagggtccaaaa

SEQ ID NO: 65585 - DNA, 449 bp, Triticum aestivum
  Clone ID: PAT_TA_65585
tcaactctgccttgcatacctaatagctctaacctaattaatactttgttaaagatgattgtggattgaaccgagcgtttgtatgctagaaagattgtcatttttttctacttaagatcaatattgtgcttcattctcttagtttatagagatcaagtattaagtaggtcaatggaattgcaataacctaaagtctatgccatattgcttgaccagatctatcatttacattatagaccacttggtcataaaatataaggctgcagtccatgtgttttagtactaagttatgcttactatgttgtccaacacatgactgctactgtttagatttttgactgttgtgttctgcagccagtttttctagattatcctaggaccgctcttcatttatttcatacgtgtagttgcatgttctaccttgtatcatcatagttttattattactg

SEQ ID NO: 65586 - DNA, 262 bp, Triticum aestivum
  Clone ID: PAT_TA_65586
agtctgcgaaattcgttctcccgatctgcaaccacgacctcgccggagtagttttggcccggatctgcggccggcgcgtctcgtcggtggttagattcggccgcggtctcgtgcggccccgatctgcctgtgtttgcggagttatatgctcctgtgcgtggtcgcgtggtagtcggttggtcgccgacggatcactgccgagtgtccctgtagttggtgttggagggtgcggtgattttgggtgtgggatttgctctgggtt

SEQ ID NO: 65587 - DNA, 455 bp, Triticum aestivum
  Clone ID: PAT_TA_65587
tactgccaaccaaggagttttctatatcgatactgtcaaggaagagtgggaaggctactactcgaatgaagacgttgaactttggaaacgaagcaattacggccttagagaggcattactcagagatgtcaggaaacacaaccgcaaaaccacagctatctcatgctgtggtgcaaacccaggtatggttagctggttcgtcaagcaagcactcatcaatcttgccaaagatattggcttccctcttcccgaagaacccaagactagaaacgaatggggaaagctcatgaaggaccttggagtaaagggaattcatattgctgagagagacactcaacgctcaaatgagattcgtgacccaaaagagttctggaatacatggtctgttgacgggttcatctctgaaggctactatcagccttctgagttgggctggggaacccatgaaaaatggg

SEQ ID NO: 65588 - DNA, 553 bp, Triticum aestivum
  Clone ID: PAT_TA_65588
ccccgccgcctccagctccggcgacctgcccgcggacgcgctgtacgaggtcctcctctgcatcccggccaaggagctctgccgcctccacgccgtctgcccggcctggcgcgccctcacctccgacccgctcttcgtcgcggcgcacaagtcccgccaccacaaggcgcccccgctcctcgccgtggcctacgacgacgacggtaatcacaacggtgtcgagattttggatctgtcgggcaacgtggtgaagcggattccgaacaccgagtacaaagctgttctgatgcacgatagtatccgtgttgtgcgcacgcggctggacctcatctgtttgagttgggttgtctgctctcgggccttctgggtgctgaatcccgccactggagctactatcgccttgccgttgggcttctcagaggaattggagcatgagctagagggattcatttgggactgccaagttgagtcctgtgcttttgggcatgtctcctctaccagagagtacaaggcgctccgtgtctctagaattaatcatcaccagcaggtaagt

SEQ ID NO: 65589 - DNA, 482 bp, Triticum aestivum
  Clone ID: PAT_TA_65589
tgcttccccgtcgctgccgcctgctcgcggcgaggcgctcgccgtcgccgcctctacgccttattcttcaccaccgccacgcccctccgccatctgctcctaccaccccccgcgcacccacccccgggccgctgctgctgcgcccccttctcttcccctccccatctggcttccccgccgccgcgggcgacctcggcctagggcatcggcggctgcggagctcttcctatcgctctgtgggagcggccaggcgcaggcgctgcaaagatgcctcaggtgatggtggtcgcgcggaactttatggacatggtggccgcactgcctgccgccaaactcgacatgctctacgattccgccttcatctgtgaggctgtactcaggtcgttcccaccgctggcaaagaagtacgtgattcagatgttgtacgtgtcggcaccaatgcctgctgcggctatgcaggagtgggtgctggatgagtatgc

SEQ ID NO: 65590 - DNA, 233 bp, Triticum aestivum
  Clone ID: PAT_TA_65590
actgcgcaccgtacttggtagcgccacatccccggcagccgttttgaacgcctgggaacgccgcgtcgagcgatcccatctttaagaccgtggctgccggctctgcttgctgactccgacggctgtcgccacgcgaaggttgggcagagagaagcgcgccccacgcgcgctggagagcgtcgtcactaatgaacggccgacagccgtcgtctctagtgctgccacaccggaag

SEQ ID NO: 65591 - DNA, 260 bp, Triticum aestivum
  Clone ID: PAT_TA_65591
ttgggttcacagtttacccatctccccaggtctccacttctgttgttgagccatacaacagtgtcctgtccacccactcactccttgagcacaccgatgtcgctatccttcttgacaatgaagccatctatgacatctgccgccgctcccttgacattgagcgccgaacatacgccaacctggaacaggcttgttcctcaggtcatttcatcattgactgcttccctgacgtttgatggtgctctgaatgttgatgtcaa

SEQ ID NO: 65592 - DNA, 598 bp, Triticum aestivum
  Clone ID: PAT_TA_65592
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagc

SEQ ID NO: 65593 - DNA, 310 bp, Triticum aestivum
  Clone ID: PAT_TA_65593
aaattccgagatctttttgttacctggaatccaccttccttggaggttgaggagaccgggaatctcggcgaccatgattggttgctcagcggtgcaaagaaacctgatgccagcgacagcagctgcaaggcaagtgatggtttggcgcccatggaggtggagttttcatggcaaccaacggctattcatctgcctgaccttcatatgtatcagttgccatatgttgttcccttttacgtttgtgtacgaagactgaggttatatgacaagtataagagatgttgggagatagctgtgccggtgtgggaga

SEQ ID NO: 65594 - DNA, 634 bp, Triticum aestivum
  Clone ID: PAT_TA_65594
ttctgttttaataccaataggacgacttggggttattcttttaattttggaacatatatcagaaacgttactttcttccgacatgaaggtacccatatttatgatttctggtgcagcagaaaaaataatatcctttaccaatgccgtgccagaatggctatgtaagccacgccaagaaaagctattctcgagggaggaggaggcattatttggccatgtggagcttctgaaggaaggcaaactatctctgtttcctcatctatactcaaagggcctgctggcagcgtggaaggagccctgcattgtattttgtccagactggaaccttaggcacagcacagcagtccatttgcttcgtcggtggcatgcagataaacggaatcttcttgttttggagcaaggagttgatgctgagttggctcttaagcctttcatgcctgtggcaatccaagttcttgaatgttctttcctctctggaataaaggtgcggaaagtcaatccattgctgtcagttctcaaaccgaagcttgttctgtttcctgaagatttgaagtcgcggtgtccatcaaaggaggacgctccatggtcatacctgtactactccaagggcaaaaccattgagatcccaaacaca

SEQ ID NO: 65595 - DNA, 420 bp, Triticum aestivum
  Clone ID: PAT_TA_65595
gtgcataccttgttttgcttagtctgagagcagaattagattatcctggaagtagcttctctgattattcagaaatacttgacctgccagttatgtcatttggttaccgtgatgttcagctgatgctagttgaactgaacttcgatgatctcctcaagagggttgcgctgtgatgaaccagcggatgtgcaattactgtggaccgtcatgcttatcaatacaactatttaaatcaatatatatactctctccgtttttatttactccgcatattagttttggtcaaagtcaagctttacaaactttgacaaagtttatagacaaaaatattaacatatacaataacaaatcaataccattagattcattcgttgaatgtacttccacatcatatagatttgttatgctaaatatttatat

SEQ ID NO: 65596 - DNA, 477 bp, Triticum aestivum
  Clone ID: PAT_TA_65596
acgaaggcgtctgctgcttgagcgtgacatcttcgggcggtctgccctgaatgtcattgcatgtgagggcgcagaccgggtggagcgccctgagacatacaagcagtggcagctccggaaccaccgggctgggctgacacagctgccattgaatccagatgttgttaggcttgtgctggacaaggttaaggacaactaccacaaggacttcgtcgttgatgacgatcagcggtggttgctgcacaggtggaaggggcgtgtgctctatgccctgtcaacatgggttgccgacaatgcaacctagcttcttttctcaatcaaacttggattattgacatcaatagatatatccatgtttgtaagttagcacttatctcaccatttatgatcttataattccatggtgccatgaggtagtcaattacttctagtatgccaagtagtcatttgattatgctctcatggatcatgaagctt

SEQ ID NO: 65597 - DNA, 243 bp, Triticum aestivum
  Clone ID: PAT_TA_65597
caccgggcatgtgagtttctttattggttcttgagaaacaacttctctcgtcaacaatctggtcttggtaacgactatatgcctcagattctagctgaagtgtccaaggatactgatgttggagaatttttgttaaagttgatctctagtgaaagagaaaaactcacaaatctttggggctttggtacaaatggatctcagcaaataaatcctgataaccaagagggatctatgatagtgttg

SEQ ID NO: 65598 - DNA, 544 bp, Triticum aestivum
  unsure (1)..(544): unsure at all n locations
  Clone ID: PAT_TA_65598
gtcaacctggccatgttgtcgtcctcgtaggcgaggaggcatggagccgcggtgctgctcgtttaggcacagaccgggtcaactcgatctcttgctacaaaaggggcggatcaagatagtcagggattctcaagcctgtgcaaaatttctaatccctcacacgcgtctatagataagctattatacaatcgactatcggatcgaaaggttccacggccttttacatactcacacggggaaaccacaagcgcaagtaaccccaagcagaggtgtgcctgggtgagagggggtgtaccaggaggtggatgccccgtaggcaacgttgaaggcgtcggaggtgcgggcgccccgccggcgtccatggcgacgccgcacaccagcggcccgagcggctagggttggaggacctgcangtcaaattagcgcagtggaggacctgcaggtcgaattaaccattcagtaaaatgaacctgtgctttcaggttccagtagttatttctgtttactatttactcgcgctgtcatatatttgctggtttttttt

SEQ ID NO: 65599 - DNA, 632 bp, Triticum aestivum
  Clone ID: PAT_TA_65599
gcatcgttgacttgtcctgctcaacccccaccagtggcagtggatcaagattcttcaggatttccatagccgccctgggggcccgcccgaactacgcctaactgttgtccatgaagacagtgagttcctggacaacatgcaggcgtgcctgtgcaagcaagccgctaacctcaagctatgtttttatttcgacaaggtgattggcaaactcgagacattggacttcagcaatctccgtgagatccttaagataaacttcggcgaggcagttgtgatcagctgcgctctacagatgcatcgcctcctcgcggttgatgacagcataagccgtgacttcactgctcagctccagcaaatggcaaacatggctcggcttaagcaaatggcctgctcagcgtgcagtccggcatcgacactgaactatccgcagacaccatcccctcaacgccagataccaagcctgctggtgagcttcctctacgccatccgtgcccttgagccgaagatcattgtgatgatggagcaagacgcggaccacaacgccccgctgttccacgatcggttcaccaagacagtcgactactacgccgccctcttcgacagcctcaatgcggtggatgcagccagcccgc

SEQ ID NO: 65600 - DNA, 576 bp, Triticum aestivum
  Clone ID: PAT_TA_65600
tttgtggttcacatagcaaatgcttgatagtgaatgcacatactactatttgttctttgcccttgtgcatcggccaatgtcatatgtgccatctcgagacaaatatatgataagttgactcaattatagatatccctattcgtggcatcaattatttatttctaaagatttatttcttatagctgttatatactactccctccgtttcagtttacaagtcctgtgcgtatacctaggttgtcaattttatcaccctaatataaactatatagcacaaaaattataccgtttgaaaatagaacatatgaagtttatattggtatattttttgtaatatttgacttgtattaggttggtcaaattgacgacctaggggtacgcgcacgccttataaactgagagagagggagtatccttacccatgaattaatattttttaatgatattaagcattctgggcagatcagtggcggaggcagggggactagcaggggccctgggccccctaacatctgagctttcctactaaattgctgattaacagtgtagaatcagtgtttatttgctgctttccta

SEQ ID NO: 65601 - DNA, 313 bp, Triticum aestivum
  Clone ID: PAT_TA_65601
ctcctcccctaggttgtgctgcccccctccacacccgtgccggcgccgccgtcgccgtccgcgtgcccccatggcgctgccgaaccacaacaccgtcgattaccccagcttcaagctcgtcatcgtctgcgatggcgggactggcaaaaccacttttgtgagcaggcatctcactggagagttcgagaagaaatcgagcccaccattggtgttgaagttcacccattggatttcaccactaactgcggaaagatccgtttctactgctgggacactgctgggcaagaaaagttcggtggccttacagatggat

SEQ ID NO: 65602 - DNA, 546 bp, Triticum aestivum
  Clone ID: PAT_TA_65602
gtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcggcgccttcgacccgcttggcctcgccgacgaccccgacaccgccgcggagctc

SEQ ID NO: 65603 - DNA, 431 bp, Triticum aestivum
  unsure (1)..(431): unsure at all n locations
  Clone ID: PAT_TA_65603
ccaccaccacatccttggcggctgtgtcgctgcccttctgctggtggcagctcaacgcctgcttgctaccgtaggggcaccggcggttttatgctgctgctgctgagtcgccgttgtggtgctgccgacgaaccgcgagccggtacaccggcgttatcccctccgcgtgggcagacctggacggaaggcaacggatccggcgctcagcgcctttcacctccaacggcgcggcctcctcgactgagcggcgacggctcgacctcctctgactaggtggtaggacgaaatcccaccctctcttgcttcttgacttggttcagttgttttggtccgatttggtttactgcttntaatacctaattatggtttcatcttccctttttgttgtcagtcatgcgagctgggtttttgctgcttggatctccactcta

SEQ ID NO: 65604 - DNA, 659 bp, Triticum aestivum
  Clone ID: PAT_TA_65604
gtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagt

SEQ ID NO: 65605 - DNA, 259 bp, Triticum aestivum
  Clone ID: PAT_TA_65605
ttttttttttttttttgctacattgctatgcaatgcgttggaacaaccatctttgttttgatcttaagacttgccatgcattgctacatgtatgcatgcaaacatctttgtttgatccgaagacttgtcttacatgcatgcatgcatataaggctagctagctagctgcatgccctgacatgatcaaaaatggacttgtgggatcttgtaaacagaaatgcttccagagttatccaatgtatatgtaacatatggcaat

SEQ ID NO: 65606 - DNA, 603 bp, Triticum aestivum
  Clone ID: PAT_TA_65606
ccatctggttctggatgacggcggcggcgccgagtccgtcgtgccacgccgtgatgaccggcggctggacgccctccgcccaagaccgcgacgccgggctgctccccgggtacggcatgaccacctacatcctcaacggcgggacggagtgcaacagaacctcccaggcggcccaggacagggtcaacaactactacaagaagtattgcgacatcctccgagtgggctatggtaacaacaccttctgtcagaacgacgagctagctcaaccaccatcgtcgtctctgcaccctcctcctcctcctccaggaaccccaggagaaccttcgcctccgcctgcatcaaggagtgttctgatcggcgtctctagttcagtctccctcttgatcattatcggctccttgatctgcttccttttatggcggcgacggacacggcggcgaaagcaagctgaaatccgtgaggaggcaatggagcatggatcggaagagggcaacttcttcgacgttgaccaggccatggaagacgacttcgagaaagggccgggcccaggcggtttcgctacagagacttggtcgtcgccaccggcaacttctgtgatga

SEQ ID NO: 65607 - DNA, 411 bp, Triticum aestivum
  Clone ID: PAT_TA_65607
ctggtgcttgggcgcgaggcacgggacgctgcactccacctcatcctcttggtgcggacggtggcatcagcgggtgggcgacggacggcggcatcagctggtgggcgacggacggcagcctcagcaggtggccgacaacacctgcagctggtgctatacccatggattccggcacagcttgaaacactcaggacaaattaagccagggtggagtagcagatgcgtgcaggtttacctagagcttgagtagatatacattaagccagtgtggagtagcagacgtgtgcacgtttacctagagcttgggtatacacacacattcggttcatacttaatggtacacctaaacgcgtttcaaccttttcccggcatcctacatgaaaggctggcattctttctgtgctaacgtga

SEQ ID NO: 65608 - DNA, 701 bp, Triticum aestivum
  Clone ID: PAT_TA_65608
aaactaaactatcacttcatcaaatgacctgaatgcgtccttcacccagtcagtacgaggcaaatcagcttgaaatgagtcgattgccaaaacagtttggcaggttcggcaaggcttcaagaattaaagataaggattcgcataatgagtatcttcctgggcctggagcttattagtctagctcttctatcaatctgggcagcttccataagggctaaacccttcgaaaggggcccaaacgcttcccaaactagtaaaaaattactcctgctcccaatttgtacccttccccagcgacccaaggcactaacgcccctaagtactccttcttcaaggagaaaagataaaaggcgcacgtccgttccttttcccttatgccctctcccaatgcctacaacccaaatacacctgacccctcttcaagtttttcgattggacgtgctaaaagaagggaaaacatcctaccaactcgctctccagggccagggtaatactctcaatagcgttaattcgtctcaaaatcttttaatcagcaatcgcaagtgctgtctagagccaagcgcttggcttcttcaatcaatttggcccatgttcctgctcctaacgcatattcatctctttcctttatttaataaaatgccaaaaaacaacgcggatttacagcacagcgtcgatactcatgcaaactactataaacgcct

SEQ ID NO: 65609 - DNA, 456 bp, Triticum aestivum
  Clone ID: PAT_TA_65609
cccgatttccagtttcgttgcgattgtgaggatgcgttcaactacgttggttcgtctacttcacggattcgatcttcttcctagcgggatttcaggcaagatgaccgtcaccttggatctcactactatctttcctatgctagttgtctcgatgctattgctatgtcgcgctacctaccagttatttatcaagcctcccaaattgccatgatagcccctaacctttttcaccatcctagcaaaccgttgtttggctatgttacagctttactcagcccctcttatagcgttgctagttgcaggtgcaggtgcaggttgtttcatgttgggacatggatatcatggatatcatgggatatcacaataactcttatttaattaatgcatctatatacttggtaaatgatgtaaggctcggccttttgcctggtgttttgttctactcttaccgcccta

SEQ ID NO: 65610 - DNA, 340 bp, Triticum aestivum
  Clone ID: PAT_TA_65610
acaacggcgacgaggtggacggctacgacgaggcgctctgccctcacgacttcgaggaccgcggcgtgatccttgacgacgagatcaacgagaccatcgtccggcccctcggcgcaggcgtcaagctccacgccatcatcgatacctgtcacagcggcaccatcctcgacctcccctacctctgtcgcatatccaggtgcgtatgtacaccatctaatctactcccagttaatttccagtacacggacggtagctttgccttggtgaaaaataattttctcctctgtggaatcaagaactgggtgctggcaatgggagaaccacaaccgtcaaccggacg

SEQ ID NO: 65611 - DNA, 393 bp, Triticum aestivum
  Clone ID: PAT_TA_65611
tcttctaaaccctatacctttccaattcattgcaatttgttccaacatatatgaattatcttgtggacacaatttgaacattcatattgatttggtggatgtataacattcggaggttgctgtggggcttcactctacatgggacatcctgcaaccgaaaaaattcggtgctctctgcaaccgaaaaactatcttatgccgagttcctgaagaaacttctgttgtcttggttgccttttgcttgatcaagtcatgctggtagccattcaaaatatgttgcctgtttggtctctcactttgttatctgcactcccaatccatgtgtttctgttggtctgttggcctgctgggcttgttctttgcagtatatgttggaattggtgggtgtgccct

SEQ ID NO: 65612 - DNA, 399 bp, Triticum aestivum
  Clone ID: PAT_TA_65612
gcatggatgcaatggcaagaagatcatggttgtgtgcatcatcaagcacaccacggagataatcgacctcctcaccgatggtaactcaatctagatcatcactttatactctcctacctttgtgatgttagtatgcttctgctgactatacaatgtgacttataatttctagctgtgcatgttgtagactgttgactgtagagtggtacacttcctggagcattgtaatgccttaccaagtagcaattgcatgaagatagtccacagcacaaaaactatgtgtaatggatccatcacttacaatctgtacgtgaataccatgtgtaatgactgttattttttgcatcgtctgaacatttttttgctgctgtattgtttctcactcatgattgatctact

SEQ ID NO: 65613 - DNA, 576 bp, Triticum aestivum
  Clone ID: PAT_TA_65613
aagcagtactactttacagggaccaaagttttcgaacgaaagatattactgctcaaaggaaggtttaaaggacgatgagcagcttaccgaggcaaactttaataagccagagaccagaactaactgcaaagcgatggtccgttttagagttgattccgaaggtcagtggcgagttattcagataattcctgagcataatcacgagttggttccgcctgaagaaatacacttactgagatcagtgaggatcctttcgattccaaaacccggtacactgaacgcaatggtgaatgctgaaatccaatcgatgcatgacagtttgcatgtgcatgatgatggtgctgaatgccatagtcaggttagcatccaaagttacgcactgcttgaaccagaggatgccgaagcacttgtaggatatttgaagcgtagaacaattgagcaaggtatgttctattgggatgtgcaagtagaccaagaaggccaaatgaccaatttcttttggagagacggtagaagccgtgttgactatgactgttttggagatgttgtggtatttgacacatcatatcgtaccaa

SEQ ID NO: 65614 - DNA, 229 bp, Triticum aestivum
  Clone ID: PAT_TA_65614
cccgcgcgccgcccccaaaatcccccgtcccacatagatcggcacccaacgctcagacgtccgtccccgatctccccgcatccggtcagatctgcccgtaccgggcaccgcggtggctttagcttccagccggatgccgcgcgacctgtcaaggtcgccgccgcgccggcgccggccgtcgccatccccgcttcgccgcggaccgggctacagggagcgcgtgcccagc

SEQ ID NO: 65615 - DNA, 589 bp, Triticum aestivum
  Clone ID: PAT_TA_65615
aattatgggtggtcgatcggctgatgcgtctggggatatcaaggcacttcacaagtgaaattcagcagtgcttagagtttatttacaggcgctggactcaaaagggactggctcacaacatgcactgcccaatcccggatattgatgacacggccatgggtttccgtctcctccgccagcatggctacgacgtcactccatctgtgtttaagcactttgagaaggatggcaagttcgtctgcttcccaatggagaccaaccacgcttcggttaccccaatgcacaacacttaccgtgcatctcagttcatgttccctggtgacgacgacgtcctggctagggccggccgctattgccgtgcattccttcaagagagacaatcctccaacaagctgtacgacaagtggatcatcaccaaggacctgccgggcgaggtcgggtacacgctaaacttcccatggaaatcaagtttgccgagaattgaaacaaggatgtatctggatcagtacggtggcaacaacgatgtttggattgccaaggtcctttacagaatgaatcttgtgagcaacgacctgtaccttaaaatggc

SEQ ID NO: 65616 - DNA, 438 bp, Triticum aestivum
  Clone ID: PAT_TA_65616
ccgctcttatgctatatgggtttgagctgcggcaatggaagattgcttactcttttagtgatgcattatcagattcagcacgcgttcagtggaaaatggcttggtcactctgctatgcatgttctgttattggcaatggcaacatctcgaggcgaagcatatatgattatggaacaaaattgagaaaaggcaaagattgtttgctgctcattaatgatctatccctgtcggctgggatattgtttgcactggagtatgctgaatttcaagcagccttgatagctaattgtgttgttatcagatcgctcggtgttgccacaaccaatgggttcttacatgttcctgcagctgattgtgatgccctgttcaattccgaggagaagctgtatcagtgcatcatccaaatgctacagctgcaatgggacccaggtgattgct

SEQ ID NO: 65617 - DNA, 485 bp, Triticum aestivum
  Clone ID: PAT_TA_65617
tttttagaaaaatcgctttttgttcctatttaactaaacaggaggaactttttggactagagaaaaactctactagaagttttttttttctttagtccttttttttagagacggaggggattctaacctaacttttttcgaggatgggaatctaaccaaacatacgtaaaagtctacgtataaggcatagaagcccatgcttcagcccaccatgacgtgcctatcgaagatccaactgaagcgggccggacggagctcgctacgggccgccctctggtttgccagctcctccatccgccggatcttgggcggcagcccgcacacgtactcctgcgcgcggcggccctctccagagagcccggcgagctccgccacccgccacctgcgcacgaagtgctccaccagatcgccgtagtccctcgccgtgtacacgccggcactctgcgccacggtggagaaccgctcgaacaggctgttctcgccgc

SEQ ID NO: 65618 - DNA, 504 bp, Triticum aestivum
  Clone ID: PAT_TA_65618
ccagcgcccgtccgtccctgaggagccgcacactgcggccgacgaccgcgagcccgtccgtcctccgcggcgcccagcatccttccttccgtccgccacgtcgccagcgccgtgtgaagctccacctcgcgagctcgtcctcacccgccggctgtccgcaccccagctcctccagccgcgcacccgagcccgtccgacgtccacaccccgaacttcgccttgcgaggttcgccggtcgagcactgcccatccccgaccaccctcgcgtgcctcctcgcggcaccggagcgagtcagctccctagcacggctgggccagagcggcacggctcagcagggccgtcgccggcggtcgagcaccgcccatccccgacctccctcgcgtgcctcctcgcgacaccggagcgagtcagctcctgagcgcggctgggccggagcggcgcggctgagcagggccgaacgacggcgcagcgagcggaacacggcagagtggtgcggtgagcgt

SEQ ID NO: 65619 - DNA, 520 bp, Triticum aestivum
  Clone ID: PAT_TA_65619
acatccaaatcggaaactgccgggaagaatgctcattcggcaaggggcatatgtacaaataatagcagaccattatctgcagatgatatccaaaaagcaaagatgcgtgccatgtttatgcaggagaagtatggcaaggttgacacaagtaaagtgtctgataaacctgagatgacagaaaataaaaaaccctctggcttggtcaactcgaatgagcctcctatgcccagaagtcccctcacatcaactgctaaacaacctgttgacccaagcccatcaacttctatacagaatgctgtacctttgtctgataatccagaaatcctggccactccgaagctaaacatagctcccagtgagacccccatagagaaattggattccaagagggttcattggcagataccaccagaggtgtggatagacccctcgtggagtgttagtgctggggaaaacagcaaggagcttgacgttcaggcacagagaaatcgacgtgagaaggaaaccttttatgcaagtc

SEQ ID NO: 65620 - DNA, 605 bp, Triticum aestivum
  Clone ID: PAT_TA_65620
ccaatggctgacgccgacgcgaaggcccctccaaaatcgaacctcgatgcagacctgatcgcctcgatctccccctcctccacttcctccggtgctcggagtgccgtggcgatcgagagccagttcgcagacctcgcaatctctgacgagctacccaagccttcgggatggggcgatgatgccgtccgtggtatcgccggaagcgatgagataaccggagagatcactggaggaaaagtgcagccggtggcgacagcggattcgaggcctcggtttccgcagcgtcacgcggagccggattgtacttactacttgaagttcggaacttgccgcttcgggatgaagtgcaagttcaaccacccggcgcgaaagaagaagaacagggtgaaagagagtgggagtagcagcatcgggagcaacgacatcagtaataaagcttttccgccggacgatgatcagactcctaaagaagaatatgaagatcctgttccaaatatttcagctgaagtcgatttgttgaagggaagaatggaggcaatgcaacttaagattgctgatgagactgaaaaaggattctatttgaagaagtttaaagagacagaaca

SEQ ID NO: 65621 - DNA, 568 bp, Triticum aestivum
  Clone ID: PAT_TA_65621
gcggcgctagcctacgaccctttccaccccagccattccggatactacctctgcacctacgactccaaggaccctcggtggagacgcacgcccgctgcctctccacagccaccaccgcctgaagactttgtgtccagcaaggtcatcaccatccgccgctctggctccggctcctgttccggcatcatgggctgggtcgacctctggagtggcatgctcctctgtgacgtgctcgctgccgccgccgacaccctctgcatcccgcttcactatctcacctttccagagccgaggcagctgcgaactgagctccctcttgccacagacattggataccactttcgggacatcgccctagccaatgactccggcatcatcaggtttgtcgaccttcaggtccacgccgaacccagcccgcgctcgcaaactcctagtggctggacggtggtcacgtggaccttggaggggctcaatggcggtctggatgccctgtttttccggcaggagcacgagatccattctggacatatccacggctacaacctgcctcagtctctctttgtttcca

SEQ ID NO: 65622 - DNA, 599 bp, Triticum aestivum
  Clone ID: PAT_TA_65622
tctctgtgtaaactgaaatactaagtcattctctgaataacgccacttgctgccactatattctctataattctgattaaatcatcagcttgtgaggtgaggcactaaaactcttgtgacaacaagtcacccatacttgaggtgaggcacccatcagcttgtgataacaacaagtcacgcatcataattgtgtgtacataagtgtttggtgagagtggctctacaaatcataacaagaagtattccaagtagttcagctcagatgcatcataattgttcatatcataattgtactactgaaaattgtttggatcattattgttctgctgatatctactgattttttccattaacactgatttttcaattaacaatattcagttaacactgattgttgtagctgctgtaatcagtttattccagttgatatgtaccttgtccttgtaatcacttgttaaaacttgttgttatgttcagtttgaagtatatctggcagctgttattgatctgtaccttgtctctgcaatcaattgttaaatcttgcttctgttggtcaatttgaagtgaatcttactgctgttgttgatctataccttgtc

SEQ ID NO: 65623 - DNA, 641 bp, Triticum aestivum
  Clone ID: PAT_TA_65623
tgttgctgctgctaccactcttgttgagccgtctacatatcgtgaggctgctgctcattctgaatggcagcatgctatggcagaggaaattcatgctcttgagcgcacaggcacttgagaccttgtacccctgcctacaggcgttagacccatcacttgcaaatgggtctacaaggttaagacacattcagatggttctctcgtgcgctacaaagctcgtcttgttgcgcgtggcttccagcaggagtatggtcgtgactatgatgagacttttgctcctgttgctcacatgaccactgttcgcactcttttggctgttgctgctgttcggcagtggtccatctctcaattagatgtcaagaatgccttcttgaatggtgagctgcgggaagtggtctatatgcagccgcctcctggctatactgtctctgatggcactgtctgtcgccttcggcgcgctctttacgggctgaaacaagctcctcgtacctggtttgagtgtttctccgccgtcatcacaaggatcgggttctctgctagtgttcatgatcctgctctgtttattcacacttctcctcgcggtcgcacccttttactactctatgttgatgacatgattatcacaggggctgaccaccaat

SEQ ID NO: 65624 - DNA, 455 bp, Triticum aestivum
  Clone ID: PAT_TA_65624
tcgcctcgtcccttccagatcaccgccaccacctccctccagcggagctcgtcgccgtacatggcctcccccatgccctacccctctcgcccctccccttcccccacccaaccaaaccaaccagcccacccggcacccttcctcctccaagaaagcaaagccatgccctctgacgggggatgagatctgcgcctgcggggaatttattggctctctccaccggcgaggcttggggaggccggcgttccctgtcgagacccgtcgcgcacgtcctccagcgccacccgcagcacgtcgagtacaccaccaccctggagcgcctcggcctgggcgacctctcgtccccgcacccccgggcgcgtgccgccgccatgggcatcatgcccctccaagtccaagcagcgggcggcgccgatgaaacgatgcaatggctcttcccaacacccctcccgtgg

SEQ ID NO: 65625 - DNA, 295 bp, Triticum aestivum
  Clone ID: PAT_TA_65625
aaggtcggctggcataattacagagaccgcatgggctggtgctgcttttaaccttttaatttatatgctcgctagccatgtgtttggagccctttggtaccttctttccattcagcgagaagatacctgctggagaaaagaatgtggcaagataaactgtaactttgcatctttatattgcgggagtaatacagctagagacaatattttcctgcaaaatgtctgtctgacaaatggcagcgacgatatagacccaacctttggaatttacctaccggctctccgaactgtttca

SEQ ID NO: 65626 - DNA, 447 bp, Triticum aestivum
  Clone ID: PAT_TA_65626
aaaccacctaaatatgtttctctcaactgcattttaaatgaacctaagagcgaaaatgtttgtagtgaggttccccttctcgattctagcttaattgctacagggataacagatgataatcgaaaatttcctaaaattgctccacttagtctggttcttaaaaaggcgaagagatgcaatgctgtcaaaaccccctgcaacacagaaaacatccactcttgtgaggaaaagagtgcagttcgtcctgtaggtaaatattcttttggtaatcaaaattacagttcaaaagctgaagatggaattcagagttccaaaaagagtagatatccacctaatgccttgaggttgagaccgaacattgagcgtgactgcaaaaggccctgcatcgatctttgggaaggtaagcctattggcccaacagatgccgagacaagccaactttcagtg

SEQ ID NO: 65627 - DNA, 227 bp, Triticum aestivum
  Clone ID: PAT_TA_65627
tctacacgcggatcgtgaggagggcccgacaaggaacacggtgttcctggcgtagttaagctgctattggagacaccctccggcttcgcaattttctcttttgccgaggattacctcgacaaagatatccagatcatctggcttcacgacttccaaatgtttgaggacaaatccagtgccattaaccttactacccggcgattaggcgccaaactcgcccagatgat

SEQ ID NO: 65628 - DNA, 350 bp, Triticum aestivum
  Clone ID: PAT_TA_65628
cacatcgccggcgagcccatccggccgccgcggctggaggatgcgggcctggaggactgcgcgctcccaccggagtccatcgccaaggctttctcccttgcagcgtgggccgtctcctcccgcctcccccacctccccctttccgatgacgaggacgacgttgacccgctagcgcctcgtggaggctgcgtggaggacgcgggacccacctacggggtcattcccgacgcccttgttggcgcgaggggcggcagtgaccgcggcgccgacgaggtcgtcgtcgggcgcggagacagggttgttgtgatcggccaaaagctgggaccggatgaggggtgtgccgaggggac

SEQ ID NO: 65629 - DNA, 178 bp, Triticum aestivum
  Clone ID: PAT_TA_65629
tcagctgttgggtcagcagcagcagcagcaagaggtttgctctgagttggtgcttctcccgcggccggattcgttccgagttggagccgccccttgaaattcagggaggtcttgaggccggcgggcgggcggtggcgatggatgatatgtgcgaggctttgaaggagctggggaccgg

SEQ ID NO: 65630 - DNA, 175 bp, Triticum aestivum
  Clone ID: PAT_TA_65630
caattgcctaattttcctggctgctgaggaaaccttgctgttccggcgacctaaagtctcctccgaggcggctggggtttggggatttgtcaattttcttgatttcagccctcttgttggggctgccgaggccggattatgagatgggcttcttgtcgtgcctgttccggtgccc

SEQ ID NO: 65631 - DNA, 306 bp, Triticum aestivum
  Clone ID: PAT_TA_65631
ccggtgtccatggcggttcggcggctccgctcgccggactagcgtgcaacggagggatacccgcgcgctgcttcgtcgagcgtggccacccgtgcagctacacgacatttattgcgggatgccggaggagagagcattggtgccaattcggccataagtgcccgccggcggtgacgcgaggcactccgcgtcatccattatgcgtcctaaacctgcggctcgtccgccgctgcggatggcacgccttcaacgatgctgctgcagcatgaggtactgacgttgacgcgcatggcgtggtggccatgc

SEQ ID NO: 65632 - DNA, 113 bp, Triticum aestivum
  Clone ID: PAT_TA_65632
agtaggatactacaataatctctcaatgaactacttgatcatggaattcaaccacatgcaacgattttccagtatgatcttcctcaaatccttgaagatgaatatggtggatg

SEQ ID NO: 65633 - DNA, 356 bp, Triticum aestivum
  Clone ID: PAT_TA_65633
gcggcgggttcatcatgcacgagctccttctccccggccaggcaggacgcctcgccggcggggacgagctggcgctctcaaaggtctacccgtctccgcgcgtcgccaccaagaagaggtccaggtcccagggacaaggaccgaccgccagcgcaacaaggaccgcggccgcctcctctgctccagcgccgacgtcttcgccgccgctgctccagcgctcctgcgacgtcttcagcagtgcaagaagtagcagcgccgtctcctctccgcctccttccctggagccgccggcctcctctgctccgccttccctggaggcctcgtctctcgggccggcatcctctgcgccggggccg

SEQ ID NO: 65634 - DNA, 272 bp, Triticum aestivum
  Clone ID: PAT_TA_65634
cgccggcacgtccatgtcgcgcgcgcgcagaggacttgggagccggagctggagctatcgcccccgtgtgcgcctgcatgcatgcgcgtgggctcgcgcctcatttggccgccgccagccatattttgcgagctcccgtccaccgctttgcggaggggcgcgtgatgaggcgatcggccgatggagacgccgctccctcaacttggctgcctgccggttgtgtggtctcgtctgttccattccgcacgcctgcgctttcacctttttttttc

SEQ ID NO: 65635 - DNA, 353 bp, Triticum aestivum
  Clone ID: PAT_TA_65635
agcactagcttcagctagccagcctctgccactccggtcattttctctgcatccacgacggcaatggccaccgctgatgtccagaacccatcggccgcgctgacggaggaggcgcccgcggtggagaagccggtcgccgccgaggaggtcgcgaagacggaggaagcccccgctccggtggaggccgaagtcgaggcgcctgcccccgtcgaggttgaggagaccaaggaggaggcgccggcagcagttgtggcagaggagacgaaggagcccgagccagcagctgcggccgaaccggaggccgaggcgcccgccgtggtcgagacagagaccaaggaggccgtggctgaggc

SEQ ID NO: 65636 - DNA, 499 bp, Triticum aestivum
  Clone ID: PAT_TA_65636
aactatgactccccttcaagctaagctaggaaaaagttgcccacagtattggtaaatttggcctgtattctgccatcattattcttttaattcttttggtcagattttccatcgaaaaagggattgacaagaactggtagacttctaaagacgttaaggaactaatcagctactttattctctctattactgtgattgttgtggctattcctgaaggacttccactctcagttactctttctctagcagtctcggtcaagcaaatgctaacagatagcaacttggttagaaaaatggaggcttgtgaaactatgggaggtgccaataatatctgctctgacaaaacaggtacactcactatgaacaaaatgaccctgactcaaatttggaatggacaaactattgatattgactctcacaaataaacactttcctttgaggaaattactactaatcgtgaatggattgaacttttgaaaatcgaacatgtgtggacagc

SEQ ID NO: 65637 - DNA, 319 bp, Triticum aestivum
  Clone ID: PAT_TA_65637
ttaaaccctccctgggggcccgcccatgctcccgcggctgcgccaagctccggcgcctcctctcctccgccggcgccgcgaacctgcccctcctgtgatcctataggcgcacggacaatggctccctggcggatttggatgaatgccaccggacggacgccccatctgcttttcccatcgagatctaagctgcagccccaaagagaactaaatattctccctctccaactcgcgcgagcttcgatcctgtgccctgcggccggcgtgccctagaccggccccggccccaaacgcggttcccaacccgacgcccccctcc

SEQ ID NO: 65638 - DNA, 488 bp, Triticum aestivum
  unsure (1)..(488): unsure at all n locations
  Clone ID: PAT_TA_65638
cggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtgatccccaacatcaacccggtgctgctccccaagaaggccgctgagaaggctgagaaggccggcgccgcccccaagtcgcccaagaagaccaccaagtcccccaagaaggccaccaaggcctanatccggccgtgccggtgaactgatggtgctccggcagccctcgtgtgcctagtgtctctgtgttaagttagctatggtgtgttc

SEQ ID NO: 65639 - DNA, 584 bp, Triticum aestivum
  Clone ID: PAT_TA_65639
cgcaacatgcaaaattatcgtactaacacaactggagcataccctaaaaaaaaacacaactggagcatgtggcaccgattttaatgattttgtatcgtatcacactcgacgcctcactattcaaatttgtttacggtccatcgaggcttgcatatggcaaataacccctcaagataacaccaagacctctcaaggccgcaatcactactcgtgacgagctctgaatgtcccacagcaccttgtgatcgcaaaaactaaagtcagccgcataatgcacaatcaactaacagcacgtaaggctcgaccaaaaacgatagctactactctacaacattcagaccgtgatagaaagattaatcataggttgcttgcttcctggcacaagataagtcaccagcattccagttaggcaatcactttctcgcgacgatatgtaatgtgcgtccgaagcaaagtaaacttgcagcaagcaaccagatggttgtatatcattttggtgcagttgcgagtttgcataagattatgatctgtcaacctcatcagcgtattaactgcaaaaaacaaacggtaacgttaacttccct

SEQ ID NO: 65640 - DNA, 639 bp, Triticum aestivum
  Clone ID: PAT_TA_65640
gtcattcatcactgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgcc

SEQ ID NO: 65641 - DNA, 359 bp, Triticum aestivum
  Clone ID: PAT_TA_65641
gcgtggcgtctcactgctcgtcccttctggtccacctccccatgtaaatttgaagcctaaggtgccaacaaaggtagtttgtgctgaacatcttgagttacagaacgagatactcacactatttaacatacactgaggcaagtactttcctaaaggagctcctgaatgctttaggctttgatgtctgctttagtctgatatttccatttgatcttccaaaaggagcaaccatcacagtgctgaaattatgtcccacttgatggttcttaattgtatttctcagtttaagtttggacttgcactataggtggttgcgaatctcagtctttgcgtgtctgtctatgacatccttgccgtcg

SEQ ID NO: 65642 - DNA, 657 bp, Triticum aestivum
  Clone ID: PAT_TA_65642
cccaccacccgccgcatcgccgtctcctctccccggagcacggcgccgcccgcatggcgtcccctaccgttgcggcctccccgacccgtgccctcgctgacaccaccgcgccctcgccggcctccccgccgcgccgcctcgcctcggcgccgcccggcgtggacgcgcccgcggtctcctccccggtatctgcccactccggggacctctccgcctgcgatgtcttgagcccgttgctcgctagtaggagcgaggagtacaggctgatgttccggctcccgccggacgaggtccttgtgcaagattttaactgcgccctccaagaaaatattcttcttcaggggcatatgtatttatttctacaccatatatgcttctattctaacattttcggatacgagacgaagaaaactatacctttgcaggatgtcactgatgttcgtaaagcaaaaacagctgctatttttcctaatgccatagaaattgttgctggtgcgaagaggcatttttttggatctttcttggtgcgcgatgaagcatatcgtattatagtagatggttgggaacagcatgttagcgatgctagattgctcattgaacgtcaggatgcaaagtcagcaagcagcagtgacgaaaatggttacgttttgttggaag

SEQ ID NO: 65643 - DNA, 718 bp, Triticum aestivum
  Clone ID: PAT_TA_65643
acagcatgttcggcttcggtcaccacggccaccatggccagaacccccctgccaacgctccggccgccggcggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggaaggtaaccccgccttcgccatcgtcaacaaggccactggtctcgccgtcaagcactccctcggccagtcccacccggtgaagctcgtgccattcaacccggagtacctcgacgagtccgtgatgtggacggagagcggcgacgtcggcaagggcttccgctgcattcgcatggtgaacaacatctacctcaactttgacgctctccacggcgacaaggagcacggcggcgtgcgcgacggcacctccctcgtgctgtggaagtggtgtgagggcgacaaccagcgctggaagatcctcccctggtaaacgtgtcatgctgctgaagctgagttgatcgccaccgtgacccggagtttggtagagatcggcctgtgatctgttgccgtgtcggtagaataaaagtcgtgtgcggtcggcggtggtgatgtgtccgtgagtgtgtgtgcttagtttctgtcctgtcgttgtgtcctgctatggcgagc

SEQ ID NO: 65644 - DNA, 578 bp, Triticum aestivum
  Clone ID: PAT_TA_65644
gagcctcccccccaaaagcgagccccctcccgagcgcgaagctagggtttctagccgccgccaccgctgccggcccgccgccgcggcgagcccagccggccgaagcctccgctgccccgcccccggtacaggatcccagcagcgcctccctccgtcaagcagccgctcccaccagcagcgcccccctccccggagcaggcgctcccacccagcaacgctgccgaccggagctacgccggcgaccagtccataggcagggcatcaacattgtcaattggaggggcttggaactgcttcggaatccacagtagagcaaacacgaaggataatggctcatcgtggacacctagatggactaatgcgccatggtgcattctctggagccggcctctctggccgccagcctttggagccttctcctgccaccatactggagatcctggaaaacaagcttgccgtgcagaccgcagaggcagaaaaacttatccgagaaaatcagcgattggcagatagccatgcagccttgagaaaggatattattgacactgagacagaaatgcaaatgattcgcacccacc

SEQ ID NO: 65645 - DNA, 508 bp, Triticum aestivum
  Clone ID: PAT_TA_65645
tcgtcgttgaacgctcggagcgacacgggcgccgcctgcggcgctgaccgaggagaggaagcggaagcgcaaggagtcgaaccggctgtccgcgcagcggtcgcgcgcgcgcaagctgctgcaggtggacgagctggaggcggaggcggcagcactgcgcgcccggaactgcgccgtggcagcggcggcacaggaggccgcgcgccggtgcgcggtcgtccaggccgagaacgagctcctgcatgcgcgggcgctggagctgggcgcgcgcctcgagtcgctcgccgagctgatccagtacatcgacgcggccgccgccatgggtgcttcctccatcccgctcgccggcgtcaacggcaccgccttgccccagcagccgatcctgcaaacggagttgtactgcaactacccctactactgctagcagatcgcatcatgctggttccgtgcagctctgtgttgtcgatgcgtctagtagtagtatgtgcttatgcttttcctcccaagt

SEQ ID NO: 65646 - DNA, 395 bp, Triticum aestivum
  Clone ID: PAT_TA_65646
agtcggcccgaatctcgggggctacacccagtgggtgcgctggtgcgtccccacgaaagattgcaagaaacaaaacaagagacaagagaagagttttgtccggctgccaacagccggcagaatagaagaaagaagaaaaagggtgttgcaagacgcctcgccgcctggctggtcgagcctgaccggccaggacccccttcgagcacccgggggctcgaaggctacacccagctggtgcgccggtgcactccgcgagcgacgagccgcgccggctgccttcggcaaactccgcatcggctacacgaaaataaatttgagctcctcacccgcatatttttgcatcacgcaagcacggataaccccgagcgttgctcgggggctatctctgcattttt

SEQ ID NO: 65647 - DNA, 613 bp, Triticum aestivum
  unsure (1)..(613): unsure at all n locations
  Clone ID: PAT_TA_65647
ttaaacatgtttctgcaatggggttgtatgggtggaatagtatttgtgaaacagttggtgcagagtggttggaggacatatctaaaaatcaggtccataaattgttaaaagggcttcctcctttaaaatcagtcagtgccgttgtttcaggcactaagaaattgatatctttacccatcgaaagttacaagaaagaccggaagttggtcaagggaatgcaaagaggtgctgttgcctttatcagaagtgtttccattgaagctgtagggcttggtgtccatttggcagcgggagctcatgatatgctgctgaaggcagaacatgcccttacagctcttccaccacctttagccgcgtgtgaagctaaaagaaacaaagataacgtaagggcaaaccaacccgaaaatgcaacacaaggaataaagcaggcttatgaaagctttactgatggacttggaaggactgcctctgctttgattgngaatcctattaacgtgtataatcgcggggctggtgccagatcagcactgactactgcaatttgtggagctccagctgctgtagtagctccagtatcagcaactgcccgtgctgtacattatgcacttcttgg

SEQ ID NO: 65648 - DNA, 635 bp, Triticum aestivum
  Clone ID: PAT_TA_65648
tcccatattacagggaagttctttataagccagatttcataaacgtgagcaggggaaagccagttatttttgacatggacatgagccctggagattttgtttcccttatatatctcttgaaggcaccaagagaagttatagatgtaaagggagttttggtcaatggcaatggatgggcaaatatcgcaagcatcgatatcgtttatgacattctacatatgatgggccgcgacgacattccagttggccttggcaatactactgcaatgggcaatccaacccttggttgcaacaatgtgtatgctattccgttgggcagtggtggatttatcgactccgatacattatatggactggctcggttattgccaagaagtcctagaagatacactcctgaaagtacagatgatccggaacatcggcagccactggcttttgaagtgtggcagtctgtcaggaggcaactttgtccaggtgacaagatcactcttcttaccagtggacctctcaccaatttggccaacatttcactctctgacagggatgcaagctctgttatagagagaatttatgttgttggagggctcatcaaagatggagggcatgagaaggggaatgtgttcactgttccatcg

SEQ ID NO: 65649 - DNA, 552 bp, Triticum aestivum
  Clone ID: PAT_TA_65649
attttggtcacttatctgaacaaaaaggttctggtctcttaatgaaattgggtgtcgattgagggcttcagtgataacacctgcgtcgctgcgtacaattccttgatctatcttcacaatatatcaatgttggtgtctctcttctccatgcctctaatagttcatggaagtaactgcataaccagattgattaagactacctgcatcatgtaatttaatcaattgaatttaattgacttgatttcctctattatgttgttgttctctcaattgaggttggctgaccatgactctgccctattccctaggatttttttagagcactgaagatgttgtttgtgatagacaggaaactacatgcagactaaacttcaagattgtgcaactgatattgaacaccacgttctaatcctgactctctagcctttgaaccttctcaactactaactacgccccaatccagcatttatttttcaggctaacaaaggtgacgatgattcacctggtggatgaggaagcatacagatgagagtcaagttgcgtccatcctct

SEQ ID NO: 65650 - DNA, 627 bp, Triticum aestivum
  Clone ID: PAT_TA_65650
ccggcttctttgatgacaatcagagcatggaagaagattcgagaaaggaaccgcgcccaagtggttttgctacagcgacttggccatggccaccgacaacttttccgacgataagaagctcgggcaagggggcttcggctcggtgtacaaaggattcctcaaggaactggaccttcacgtggccatcaaaagagtctccaagggctcgaagcaagggaggaaggagtatgcctctgaggtgagggtcataagccggcttcgccacaagaaccttgtgcagcttatcggctggtgccatggaggccgtgagttgctcctcgtctacgagttgatgcccaacggcagcctcgacaggcatctctgcgctgccaataatgccattcttccatggtcggttagggagtatcacattgcttcattatggtgcacgccggcacaatgggatacatggatccagaatgcatgatcactggcaaggccaacgccgagtcagatgtttacagcttcggcgttgtcctcctggagatcgcctgcggcagacgacccgtggtggtggttcaccaagaagaagaagatgatgatgaagatgcggtccacctggctcagtgggtctggagctcgtatgga

SEQ ID NO: 65651 - DNA, 578 bp, Triticum aestivum
  Clone ID: PAT_TA_65651
tacgcgcggacgtcggggcagtttcagttggggagtctcggttgggaggggctcagggcaggtatcgtttcaaggggctcgaatggctgttagacagaattttttagccatcgaattattattgcacttgcgagtcaaaatgtgcagaaagatgaatcaaagaccaccacagcatcgacacattaacattgttctggctcctctcattttctttctttctgaatccctcaatccatcagaggagctcaagtccaagtagaggcagctcatggacttctgaacaaagacaaggaacaaagaatcccccaatgagcaaagaatcccccaatgcccaaagatgtcagcaccattatatggagaagtgttgttttttaatgtttaccaggggaatctacatatcactatccaagaatgacttcatgttctggtattcctttttggttatgtcttgggatcatacacattgagcggtctggggagtatatatcttttccaaaaagcaaagtaaaattcaaggacaaaagatttaaagtataatcgttcttcaggtgtccgctagatgtgaatggtaacttggt

SEQ ID NO: 65652 - DNA, 564 bp, Triticum aestivum
  unsure (1)..(564): unsure at all n locations
  Clone ID: PAT_TA_65652
cccctcccctagccaccatcctcccctgtccctccttcccccatcgcagagacgtccatgcctccttccatcatcggcaagggagcaggaggtgctccagcaggcgtccgccggcgaaatctgcaggccagcctccatcttccacctctcctactctccgttggtgcagcagcgccatcatgcagttcggccgctcctgggcgcacgattcatgacaaaattcgcaccatacattattattatgtcatttattttcagcaactattcaaatagtttgtacattctgaattgcaaaaaaaaatattgtacacttacatgtgataaacacatttaccttaataattgtccccaataagcagccagaaagcttcatcttgtacatatttcttactttctatcactatcagttcaagtgatcaaaatggtntaaaaaacaagttgaatattcctcgttttgtgtctctttggatccaaaacattttcaattctagtgtagcttgctttaagaaaatataacttcactgtgcaaaagctcaatggttcaaatgcgatttgtaattcact

SEQ ID NO: 65653 - DNA, 598 bp, Triticum aestivum
  Clone ID: PAT_TA_65653
caccagcacagccgcgcatccaccgttgctagcaaggtcgaccaatcagcaccgagatggctgctgccttctcctccaccgtctgtgccccggcttctacgccgaccaactgccttgggaagaagctgaagaagcaggtgacctcggccgtgaactaccatggcaagagctccaaggccaacaggttcacagtcatggcagcggaaaacctcgacgagaataggaacacggacaagtggaagggtcttgcgtacgatatctgcgacgaccagcaggacatcaccagagggaagggcatcgtggactcgctcttccaagcgcccacgggcgacggcacccacgatgccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccagtgcgagcttgtcttcgccaagatgggcatcaacccaatcatgatgagtgc

SEQ ID NO: 65654 - DNA, 390 bp, Triticum aestivum
  Clone ID: PAT_TA_65654
gcactccttttgaacaatgaatacacgtgtatattggctcttgattgtaaaactatgtggaattctacctacataatgttaaaaggtgcattccaatacaaagatgttttctaaagactttcaatacatgaaaagaaatttacttgtccaactggagaagattgggtctttgctaaggaggtttgtgatacgctgaaagtgttctttgatgtcacagagttgttgtcgggcacttcatatgttacagctagtcttttcttttcgcaaatatgtggcattcggttggcaattcctaaatgggaaactagtaaacatagtgtcataaaagctatgtctaaagaaatgaaagacaagttcgagaagtattggactgatgtccatggtcttatg

SEQ ID NO: 65655 - DNA, 450 bp, Triticum aestivum
  Clone ID: PAT_TA_65655
gcccgtgctctcccgagtagcgtcgcgcatgtccgccatggccgccaccggagcagcgctgcggcttcgcctcctgttccggatgctaagggtgggggagctcatcgccgtcgcggcgctcttgtcgtggtcctcctcccgcgcgccgtccgtggccgccgccgcgatgcgcgtcgcgggctcgctcctcttcagcccccgcttcgtgttcgtcctcggcaacgccatcgtgctcctcctcctcgcgctctccaggcgcgagcgcgtggagccgtccccggcctcctccgccgcggcctcctctgccggcgccggtgtggagcagggccagacccctgccgccagcttcgcttcgttcgccgtacaaacgacgccgacgccgacgccgatgccgacgcaggcaagtgaagcgcccgtggtggtgatgccggccatggcgatggcgatggc

SEQ ID NO: 65656 - DNA, 501 bp, Triticum aestivum
  Clone ID: PAT_TA_65656
tcaaattcaagttccaattaggttggcgttgatgaattgtgcaatgcatttttcttatttagggctaacacaaaaaggcataatgccaggggcacaaaattgtttcacctgaaagtgcagattgtacacttggtttctaatgtgttgaaggcttgcgatgaaaccatttatgtttcacctgattgcggcattcttatttctgaaatttatctgtccagcatttcattaaactaagtgtgtgcagatctgggaaagaaaagatgctgaggaattcagggtgagattttggtggaggaatgatcttctctctctagcttccagagtgttatggtccgcggataccaatttcattgtttgtggttgatgcacactctggatattcaatccttttactagtggctcatgccctgtttgttgttgcatggtttgcaatgcaatcaccggtggagttacatctatagtaactatctgaagtcatcatgattaattatttaattagtg

SEQ ID NO: 65657 - DNA, 473 bp, Triticum aestivum
  Clone ID: PAT_TA_65657
tttctccttcgtccctctccatcccctttccttctcctgcagcgccataccaccggcaattgcaagcacgactgcttgggtccgccgcctcatccgtgctcgactgcaagcacccacgaggcacgtgctttgcctcctccagatccacgaagtgaggcagaaagaaatatgacatcgatgattcaaggtgccttcacaagcaagtgcactacaagacacgggaagaaggtcctcccatgacctctcgccgccgagctcgaccgcaaggagctcgcggtacacggggaaattgaccacgaatacctgtcttggttatcccatcctcaaatccccaaatttatgcagttaccttttttctaggagagagcgagcagtttatccccttccagacctaatagactacaatttcgaattgattttgtttttgcacgaactgaaactgcaggatgcatgttcatctccccccaacctat

SEQ ID NO: 65658 - DNA, 420 bp, Triticum aestivum
  Clone ID: PAT_TA_65658
acttctccgccgccgtcgccgcggcgctctctccctgccctgagatctccgttcgccggacccgggatggtcctgccgcgccggcgcggcggccacaaccaccacccgtgcccgtgcccgtgcccgcgccgcgccgttctgccggcagcggcgctactgctgctcttcctcctcgccgccgtcacgctgctctacgtctctccgccgcctctgtccgaccacccggccctcgcctactcccgccgccgctccccgcatgctctgctgaacagctctggtggcggcagcctagtggagcccgggcgccgcgagatttcccgggttccaaaaggtggttggattgcgacagatggcctctggggttcgaagctcgctagcaaattctatgggtgcagcaactcaagcagcaagtttcttgat

SEQ ID NO: 65659 - DNA, 562 bp, Triticum aestivum
  Clone ID: PAT_TA_65659
ggtccactcggtgtcgtctccgctgttgagtttatcggaatcgtcttgttcatcgtctatattgtcttctcgatgacctattatgttgtagacagtgtgagcttcatctccaaagcgcacttgcccccaactactcgcaggtatgttgtattatgaaacctgttaagtgagaaatgtttcatgccagtactgatcgactaatcctcttcttatccttacagttaccgagcatgaaaaataccaaattatatttttatttagtgatagtaccatattattctcatcactgcggctaaagtaatgaagatggtatagattttggcgtcagtacattattaagcctcaagtattagttagtacttgtaggggttaagttttatgtggttcaagctgaagttattacgttcagaaaaagattggtggaggatagatcattgtatggtcatttttagagccatcacttcgttgacgtggaaatcaaaatggaacatacacatatatctgcagtaacttaaatcgtgatctgtatacgtcaaatacatattgatatgagttgatggta

SEQ ID NO: 65660 - DNA, 241 bp, Triticum aestivum
  Clone ID: PAT_TA_65660
atcagttcacctgaggaagtttttgatgaagaacaggatgatggttggcagcctgttcaaagacctaaaacagctgcagttttaggaaaacagataaagcattaccgtcctgccatcagaatgtttttttatcctgacaatcatgctccgcgggtgcttcccaatataagccaaggaattcctattcaaataaccgttattacttcttaaagaagaaaactattgtacctgcagcatacgc

SEQ ID NO: 65661 - DNA, 156 bp, Triticum aestivum
  Clone ID: PAT_TA_65661
ctccaacaaatccctcccgaaacctctcgacctccaatggcgggcgcgacctcctgcttcgccacgctcgccatcgcccgcccggcggcgtcaggggcggcggcgcagagggcgctcctcgcctcgaagtcccctcgtcagacctctccctccgcg

SEQ ID NO: 65662 - DNA, 392 bp, Triticum aestivum
  Clone ID: PAT_TA_65662
gaggttatggatacaatgaagcatgttatcaatctttccaatgtggtagatacgctctgcaagcaaatgtgtcagtgcatcgagaatgatttgttataccctctccgcacgcctcataatattgccccatacaaatccaagggtcttgatagagcctcagagctccatatttgtttggactctgctgaacaaagttcaccatctacgaagtgtagtcaggatgaacacaagagtcaacctggtttatgtagcgaaccaggctcatctcttacgggaaagcgacctattcttcagatgcacgggtcaagttccgacaacagtggacgcccgtctcacaagagagagagaagagacgctcatggcggcggtgctcttttcgatctcaacatgcc

SEQ ID NO: 65663 - DNA, 427 bp, Triticum aestivum
  Clone ID: PAT_TA_65663
tcttccgcaagtttgacggcttggcctgggacatcgagagggctcagccgccggtggatctgtggaggaagttcgtgtactgtacctcgctctccggatccattcttggttcggttgatcacatgaagcaggaagatttcaacaaggtcattagtcctatatcggtcgcacacttctcgcagtacaagctagtggatttgctactcaagaaactggatggcgttggctttcagacgtgctttcctgatgagcttggcggtagctccactcaagatttgctgctggaaaacaagatactgatggggcacgagtgtagttccattcagctgaccgatgatggtattttggttggagcatcgtttaacaatggggggagggtgcacgagaggaagcttcactgtggccttcttctaggggcagatggcgc

SEQ ID NO: 65664 - DNA, 425 bp, Triticum aestivum
  Clone ID: PAT_TA_65664
tccgtctgctgctcaccttctccgcggcgctggtcggtgtcagccacggctcggacgggaccaacagcagcgtcccgccggggaagttcccgctggggttcgcgctgacgctgacggcgtcggcgctcttctccctcatcctgtccctgatgcagctgacattcgacaaggtgctcaggagcgacaccttccacgacgtgatggagatgcagttctggagcaacaccgccgcggccgtggtgtcggtggccgggttgttcatctccggggagtggagcgccctgcacggcgagatggacgggtacaggcagggcagggtggcctacgggatgacgctggcctggacggccatatcgtggcagctgaccaccatgggcctgatggggctcgtcgcggccgtgtcgtcgctcttcaccaacgtgatc

SEQ ID NO: 65665 - DNA, 450 bp, Triticum aestivum
  Clone ID: PAT_TA_65665
cctcctctgacccatctctctcctccatcccctacaagtggtgctaccgagcaggagctgccacagcgcgaggatgcatggggccgagcgatgggggatgctacaagctgctcgccgccggtgctagagccggccaggatgggagctacaactggcaaacttttttgctacaaccgactacacatatgctggaaccggccgtttttttagctacaactcgcggagcagcaacggtggcatgttgtttttgctggaaccggcacctggatttgctggaactggcgatcaaaattgctacatccatcgctgcgagcaaacctccaagtgctggaaccgacgacttgttttgctgcaatcggcaagaagtttgctggaaccagcaaatgctcgatactggtttggggcgtgacggcgagctacgaccggccgaccagagaaaaagctacaata

SEQ ID NO: 65666 - DNA, 225 bp, Triticum aestivum
  Clone ID: PAT_TA_65666
actccgccgtgctctgcgggagcagcgccttcttcgccgcctggcgcccgagcccaacgccgccgccggggccaggaggatcgaggtcgacggggtggacaacgtcgccgccttcagggacgccgtggagctcatgttccaggccgacgctgcgcggtggctcgccaaggccggcgtctcgcgggccatcgccgtcctggaggtggctccctcggttgtgtttga

SEQ ID NO: 65667 - DNA, 619 bp, Triticum aestivum
  Clone ID: PAT_TA_65667
gacattttcccgaacttcattcttgcacgcatcagaaaaacaaattgcatggctcattaccagaagatctacaatacatgtcagctgagcacatacaactcgggtccaataagtttatcggacaagttgcacggttacctataaatatatcaagactaaacctatcttcaaactctttctctgggtccttgccatcagatctgaatgctccactacttggagagttgttgcttgctaataatcaatttacaggcaccattccgttgtctatatgccagttgactagacttaataggttggacctatcaggaaacaattttacaggagatattatgcagtgttggaagaaatctgacgcaaactctacgaatcaatttggttttgacatgctaagcttagccctgcataacaacagtctcactggtgaattccctaaatttcttcaaaggtcgacaaggttaatgttccttgatctttcttacaataggttatttggaggattgccagaatggttgccagaaaaaatgccacatctgaaaatattaagagcgagatcaaatatgttcagtggtcatattcataagagtctcacttcccttgatagtcttcattatttgga

SEQ ID NO: 65668 - DNA, 596 bp, Triticum aestivum
  Clone ID: PAT_TA_65668
acaatatgttgacaacccaatatattacatggttcatgtttaattttggtctggttgaggattttaggcacacgtcacacaacacatcattcgtaatacaagctaaaaaaacacatcattgataatacacagcccagtttccttgaactgatcactaggcacacgtcagtatttgattctaggctgttagcaacctgttccctcatgtgataactgtttgtttcatttcattggtaagtatagtatagcttagtaatgcctggctgtatgtgcctgttattaaaggattgcctacttacaccatacactatagctgcctacttttctgactatgactactgctgttgtgccatttactttgctgttcattccagcaaatcatgtaactacatcttagctgacgttcttcttgagtgaaatattttggtagttcttagcatgtctcatttccccatccttccaggtctacaggcttcaccaactgaacagggcagctcaactggtgacagcactcaccttttctgttagaggaactgaggcaacaaatcaaactttgtctatcatgaactccttaggggcactactgactgttcttc

SEQ ID NO: 65669 - DNA, 638 bp, Triticum aestivum
  Clone ID: PAT_TA_65669
ccctagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaagagcgcgccccagagcatctggtacggccctgaccgtcccaagtacctgggcccgttctccgagcagaccccgtcgtacctgaccggcgagttccccggcgactacggatgggacaccgccggattgtcggctgacccagagaccttcgccaagaaccgggagctggaggtgatccactcgcggtgggcgatgctcggcgccctgggctgcgtgttcccggagatcctgtccaagaacggcatcaagttcggcgaggccgtgtggttcaaggccggcgcccagatcttctccgagggcggcctcgactacctgggcaaccccaacctggtgcacgcgcagagcatcctggccatctgggcggttcaggtggtgctcatgggcttcattgagggttaccgtgttggtggcggccccctcggcgagggcctcgacatcatctacccgggcggcgccttcgacccgcttggcctcgccgacgaccccgacaccgccgcggagctc

SEQ ID NO: 65670 - DNA, 382 bp, Triticum aestivum
  Clone ID: PAT_TA_65670
cccccttcccctctccccaccaccccgcccctgttccccggaagcgcgcgagctgccgccggaatcagcagcccgcgaagatggtggccgccttcgccgtcactccttcgtcctccatatgcggcgtctgcatcccgacggcgtgccgtccggaggcgcggggcgtagtgcctgctccgaggttcttccacagccataaccgagcgaacagacggtctgcaacagcttggtccttgaaggccggcctatgggactctctcaaatctgggtttttaaaaactagcaatggtgcagagacagtggagccactgtccacagcgcttgaagaagaagaaattgtgcctgaggaattagtgctcctgcaaaggacactacctgatgg

SEQ ID NO: 65671 - DNA, 471 bp, Triticum aestivum
  Clone ID: PAT_TA_65671
aggtctagtgctacaccggcgcggcggcagacgatgcacaaccatctctcttgaagtacaaactcctcttcctctccccttttgtgctgatgtccatatttttttttttgctccaattgttgttgtgtagtacatctttttgttcaatttgctgttgtccagtacatctttggggatgtggtgatgtgtaataattttgatagcatgcatcaattggaggtgggcaagaagatgaacaaaagaaaaaggatggttaggggagccgctgtttttgtcacacttgctgcaattgcagtcattgttcgagctataataaggaagagaagagcatgtattacatatggcccaatgcatgaaagagatcgaatcagatatgattatctagatcaaaaaatttggcaaggcgatgtgttatgtaaaaacatgttaaggtttgaaagagccgcgttctttcgcttgtgtggcatactc

SEQ ID NO: 65672 - DNA, 519 bp, Triticum aestivum
  Clone ID: PAT_TA_65672
aaaagcactgcaaagaggaacataattattcagagagcaggcacaataaaagtagactccatgacagcaaagggaagaaaaggtcttatgaagaaagcggtcataatggtgatctggaacccaggaatgcaaaagaatatcatggagatgctaaacgcaggtctgatgtaagctcatttgtttccaatgaagaccgtaggcgagaatatgagaaggttgattctcggaggagggattttgagaggaagagccccaccagatccagcacatatcctgtgaaggagcaaagcaggcatttccctaagcaagaagaatcctcacccagggagaatggtgctgctcttggaagacatagacgaacatctgactttcaatcagttgagggtcttagtaaaactgatgcaaatagcaatgaatcctctctgcccttgaaagatggtagaaatttgagatctgatggccgaccaatccattttaatgacagaccaccatcagcgagtgattgtcaagtttccaacc

SEQ ID NO: 65673 - DNA, 586 bp, Triticum aestivum
  Clone ID: PAT_TA_65673
tccttctttccccaaaccaaaccttatctgttctcctccattcccccaaattgaccagaccaccagtctgtcactcgcttctcactgctgccaaccgctggtcgccggtcttgccaactctcgccgccctctgcagtgagggccctccaggcctccacgccaggtgccgggtgttggctgctggtgcttctccttctctcactgcttctgcggggcgctgcatgctgccgtgcagtggaccgctgatgctgccgcgggggaggaaactaaacagtgaactgttgttgaagcgtcgaaggagcaagactgctgcaagagcaaaggtattttttcaaattaattaaaggaaaaggattcaatgatgttcttcatagacttgcgtaatgttttgattgccatgtaattttttaagttatgtattgtgtgccaaatctcgatagcctaaccatctatgatttttgtgctatgtacatcagtaatgaagtacaatttcagatccatcattcattcatgcttttcgggctatgcttttttagtagtatcggacagtcagccgtcttctgattcagaaaagaggtgacagtga

SEQ ID NO: 65674 - DNA, 272 bp, Triticum aestivum
  Clone ID: PAT_TA_65674
cgcgggagccaccccgcagcgggtcgctgcctccccagccgccggagccaccccaccgcgcccttcgccgcctctggagccgcagcttggcctccgtcacgccgcccctccgcctccgtcgcaagcttttaacttctgttaaatttgggtggatcgatgcctcgccgaactaacttatgaaattggagatcagttgatttgataatcgttacctggctggcaatccctgacaagtgaacttaatactacgtgcatgacaactacactttggt

SEQ ID NO: 65675 - DNA, 584 bp, Triticum aestivum
  Clone ID: PAT_TA_65675
gcgccgtcggcgaagcggcccgccggtgccgacgtatgatggggctgggcgtccaagccgtacgtggcaggatggatcgatcctggccatgactgaagcacaacgtcggatccaactcataccagccacgtgaagatgacaagtcagtgaagaaatacctacatggtagggtcaataaagctgagctcgatgattacagatggggcgaccatatttgagattgaggagccacaagtcgtccagaggaaccgtggtctggtgaccatctataacaagatgggtcaactgcgccggaggttctataagctgatgattgagggtcgccaggggtctaaagaaggaaatttcatcaaggataaactaaaagtctttctgaaggaagtaaagatcctccaggatcaggtcaagaaactgcgtggagtggatggttacttcaagatgccacctgtccttgcggaggacctggttttgttgaagtagactctaggaaacccgcttgtgctactaactaaaccacaccaattttggagtgtaactcttgctaagctgtcctatgtggagatggagcatgcctcaagctgctc

SEQ ID NO: 65676 - DNA, 146 bp, Triticum aestivum
  Clone ID: PAT_TA_65676
ccgctgggtggcagcgaacgtcgatgtttgcccaagtcttcgtagacctctttctgatgaagtatcttttttgtgtcattccaaatgtgatgcaagtctcggtatcttattggaaatacatgttctttctacagacaaacgttgcc

SEQ ID NO: 65677 - DNA, 289 bp, Triticum aestivum
  Clone ID: PAT_TA_65677
aattccgatcactacagcaagatgaaatattgtctattgattgtggtagcagtatgtttgtttttggcgattgaaatggttaacgccgattgtccaggaaattgctggtactacatgtccgacgcaaccaaacgatgtgctgtgtgcgacagcgacaaatgagtgcagtgggtatgatctatttggcctgtggcgatgttggtgttgttaaacttgtctttttgatcgattcataaattgcatgcaacattatatagttatatagtatatatatatatagtatcatata

SEQ ID NO: 65678 - DNA, 498 bp, Triticum aestivum
  Clone ID: PAT_TA_65678
ttttttttttttttttttgttaaaaaactaataatccgaaaagattcttgcatgcatgcaatgatgtagcaatctatttacattagagacgtgtggtgcatctctttttctgccacacgtgtggcagttatcgacgtcctaaaaatatcagtcatggaaatgtcgtccttagcatacacctcacaaatcttacaactgcacaagttgaaaaaccaacatgtcgctacagatggtagacctcactgctggcaatcagcattgccacagtcgaagtcggtgcaatgatggtcctgttgatccattgaaaatgctttgtcaagtgaaatcatgcgcacaacttggcaagatgagtagagcactaaggttgcacccgcttcggtaatgacccgctagacaagtacggtgccaggcaagcctcgttgttggagatcattgctgctgacatcttggtgataacaatgacatggatgggttcatgttgatccactgacacaatgt

SEQ ID NO: 65679 - DNA, 239 bp, Triticum aestivum
  Clone ID: PAT_TA_65679
gccgccgccctgctcaacagccaacgccgtcgccgcctgccgggtggcgtgcgtcgctcccgccgcatcaaccctctgccgcatcccactgccatcatgacccatctctctccttggtcttctgtctttgaccaatactgggtggcggctgtgcttccggtcgcgtggtggcgatgtggctggtcgagggaacacagtgtggggggggtgccccttcacacattggaccatcgtggcgc

SEQ ID NO: 65680 - DNA, 384 bp, Triticum aestivum
  unsure (1)..(384): unsure at all n locations
  Clone ID: PAT_TA_65680
ctcgcccgcctgctgcaaccgccgcggccgccggggggtccccacacgccgctcgccgcgggagccccacctccgcccgccttcgtgcctccccaggccccggcctactactccaggccgcagccgccgagcgccggtgcgcatgcaggcgtgcgtgcgtgcctggcgaggccgcttggccttctgtaagggaggggggccccttgtggattaaggggctaatccccttttagggggaggggggggggagtcaatcacantgggcccaaaaccattacgattaaattacgaaaaaggttttagtttgaaatatacaccgagtcacttacaggtggggccagcgacactgttcatagtctgaccagtcaaacattgactgctgac

SEQ ID NO: 65681 - DNA, 150 bp, Triticum aestivum
  Clone ID: PAT_TA_65681
ccgacgcggatgcactgggcgagggccgtcccctccgacttcggcggccaagcccccgcccctcgcagcgggcacacggcggtcgccatcggcgggtccaaggtcgtcgtcttcggcgggttctcctacaagcgcttcctcgccgacatc

SEQ ID NO: 65682 - DNA, 196 bp, Triticum aestivum
  Clone ID: PAT_TA_65682
gctcgtacgccgtccagccggtcgccgtgcggggcctggccgggaggtgcatctccggccgcaagctcgccgtccggcccgcctccgccgccgtctcccgctccacccgcagggctcgcggggcggcggtggtggccaagtacggggagaagagcgtctacttcgacctgtactacatcgccaacacgacggggca

SEQ ID NO: 65683 - DNA, 626 bp, Triticum aestivum
  Clone ID: PAT_TA_65683
ggcacccgcacgctcctcctgctgtttccaatttcatttcattttttacctcctgtgctcccacgctccgcgtctggactccaccatggcggcagtccgaagcgcagccatctccgctgccgcagtcgttgcgccgcgcggctttggcaggcgccgtcgtcttgtcccctgcttcgcggcgcctgcacgaggcgcatcaggagtcaccggggggcgcttccgggaagatgctcccgcgctctgccctacatgctagcgccgccaccactggggcgcccgactccgacgaggccgctgcggtgagtattcgccccgttggcgcattccatcgagcaagttgcaggccggcctttctttcttagttccttgtgcaggaatctttggtggaggcggagctgagcaaactcgcctgcccaatctgctattacccgctcgtaagctcgatagatcatcagtcagcgccatccaaatccgattctacccttgaatgttctacctgcaagaaattgttctctaaggatgattactgggatctgactgtggcagttggttctactgagtactccgagaccatgcctgctgcaactgagcttttcaggacccaactggtatcatttctttatgag

SEQ ID NO: 65684 - DNA, 488 bp, Triticum aestivum
  Clone ID: PAT_TA_65684
ccgatggagtttgctgtagcggcatttagcacggtagctggcgtcgccttgtcgaagctctgcagcgtgaaggggaagctaaatactgatgctaccatcatcagtgaagaactcaagtggatcgaagctgccatgaaggatcatgcttccagtgtcgagccgatgagtttcttgcaggcagaatattttgcacaactgagggccttggcttatgacatccaagactgtatagacagcttcaacgccaagatgacgaccgatgatgaatttgccgacaaaattgcccaactcaaggagagatcaactgcaacgactgaacggataaagaggtttggctttcctgtacaaggggctgcagcacaagcggcggctgctgctgtccccgcggagattcaaaattttcatttcctgatgaggggaggtaatcttaatggtgattaccacaactgcttgctatatctgcgcttgttccctcatgaacatcatgt

SEQ ID NO: 65685 - DNA, 192 bp, Triticum aestivum
  Clone ID: PAT_TA_65685
acaatggccgctccttctcccgccgtcgccgccgtcagcagtgcgccctcgtccgggctcctgccggcgcggcgcgcggcgccgtgcagcgccgtgcaggtccagctgccgtcgataaggagagccgtgccggggggcaagatggcgacggtggcgcgcgctgtgggctacgtgggggcggagggcaacacg

SEQ ID NO: 65686 - DNA, 377 bp, Triticum aestivum
  Clone ID: PAT_TA_65686
ggcgcaaaccatggcgtccatgaccgggctgtgcgcaggcgtgcgtctcccatgcccggccggcaggcgcgccagcaggttcaccgtgagggcgtcgtcggcggaggccgaggccgccggccgccgcgcggtccttggcctcatggccagcggagtcgtctggagcgcgttcgctcatgtggtgggcgccggcaccgtcgcggccatcaaggttggccccccgccgccgctggtgcggtggactccccggaacggacaactcggacgaagcaagggacttcgacctgcccctgaagaaccggttctacctgcagccgctgccaccggcggaggcggcggtgcgggccaaggagtcggcccatgacatcctcaacctc

SEQ ID NO: 65687 - DNA, 588 bp, Triticum aestivum
  Clone ID: PAT_TA_65687
cccccggccacgccgacctccggcggcgctcctcccatcctgcacctccaaccccgactccgccgcgcccaacgcatcttcaatggagcgcctgcacacagagaacgccggggtgcatgggcaacctccattgcactccctccgacggccgcccggcggtaacccagctcctcccctccctcatcttcaccaccaaccgagccccccaacgacgaaccaagaggaggcggtggcggctgaaactttggatcgctgatggggcgcggagatccaacaagcaatggtgacggcgcttcaaactctgcaggattaggattaatggcacacaagaagaatccatcaaacacgctctgcgctggatgtaaatactacttctaggtaagtttctggatcacaccggttcataattcaacaagcatgccaagcttctcaagacccagaagttcgcgtccaagcttgaccagcagattaagtttttttaatgtccaggttagttttttgttcataccctatgcctccattgagttcttctagctgttgagcgtccaaagtggaattagctatcaaaatgggttcaagctaaactct

SEQ ID NO: 65688 - DNA, 461 bp, Triticum aestivum
  unsure (1)..(461): unsure at all n locations
  Clone ID: PAT_TA_65688
ggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaggctgcccaacatcaagatcccactcatcttgggtatctggggagggaggggtcaangaaaatccttccaatgtgaacttgtcttcgccaagatgggcatcaacccaatcatgatgagtgccggagagctggagagtggcaacgccggagagccagccaagctcatcatgcagcggtaccgtgaggctgcagacatgatcaagaagggtaagatgtgctgcctcttcatcaacgatcttgacgccggtgcgggtaggatgggcgggaccacacagta

SEQ ID NO: 65689 - DNA, 391 bp, Triticum aestivum
  Clone ID: PAT_TA_65689
atctaccgaagccaagagctttgtgtctggaagcgtgcttgggccagtgcattgcgtccttttaaccctgaggtactccttagagatttggctctgcagcttcagaatactattgatgaacagcctgctagaacgaaagaaaaagttagccgggatgaaacttgaagatttgaaggagcagctagctgatgtactaaaaataaaagagtgccttgttgttcttgatgatgtatcgaccacttttgaatgggacttggtcaaacattgtttgggcaatgctagaaggatcatagtcaccacacgaaaaaaagatattgccaaacattgttcaatagaggacaagtacatctgccatcttgatggtctgaaagatgatgctgcacttgacctc

SEQ ID NO: 65690 - DNA, 383 bp, Triticum aestivum
  Clone ID: PAT_TA_65690
ggtgaggctgctgcatctatgactccaatggacaatgctgctgatgacaagtgtggcaacccttccaaggccttccaagatgtatgcctccctcaccccctcctgctccctcatttgttgatattcttcatattttgatcatttgggttagacgcttaaagaatgatgttcatgcttattatgttttgatagattggatgagtctctcaaaagaactagttgaattttctttgacgtgcttcatatgttttgatcattcttttaagctacacaactagtttgtctgttttttctctcctacatcagtttacaccctccgtgtcaaaatataagatgttttagcagttcaaattgaacttcaaaaacattatatattttggtac

SEQ ID NO: 65691 - DNA, 503 bp, Triticum aestivum
  Clone ID: PAT_TA_65691
agtactcggagtgcaaaaccctgcaaagttccggatcaacaagaaccagctcaccggcagcatcccggagaggctgtgggggctccccgccgtgacgatcatcgacgtatcggacaatgggttcaccgggaccatatcgccgctgatcggcgaggcgcagaatctgaaccagctctgggtgcagaacaacaggctcagtggcacgatcccggcggaaaccggccggctcgggcagctccagaagctctacctgtccaacaactcgttctcggggacaataccctcgcagattgggaacttggctcagctgacggcgctgcacctggaagacaacgcattgggtggcgcattgcccgctgatatcggcagctgctccaggctcgtcgagatcgacgtctcccggaacgagctcacggggccgatccccgcctcgctgtcgctgctgtcgtctctgaactcactcaacatctcacgcaatgccatcaccgggatgatcccggccc

SEQ ID NO: 65692 - DNA, 476 bp, Triticum aestivum
  Clone ID: PAT_TA_65692
aaagtttttaaaggtgtatctgcagcaaaatatcatacgttagtgtttggggctgatggtgaggtgttcacttggggtcatcgcctcgtgacccctcgccgtgttgtaatagctagatgtcttaagaagggtggaaatgcaaacgtgaagtttcatcgtatggagcgacttcaggtgatctctgtggcagctggagtgatgcacagtactgctctaacggccgatggtgctcttttttactggaattcatcggatctggacttaagatgtcaacagatattctctatgtgtggacggaatgtagtgagcatctcagctggaaagtactggactgcactggctacatcaactggtgatgttttcatgtgtgatgcaaagaaacgtaaggatgaaactccagtatttactcgagtgaatggtgttaagcgagcatcatcagtttgtgttggtgaaacacatatgcttgtgctttctag

SEQ ID NO: 65693 - DNA, 380 bp, Triticum aestivum
  Clone ID: PAT_TA_65693
cgcggcgtggagcgcgaccctcgaggagccatggccggcatcccggagcacggcgagggccgcgtcaggtacctggtggacacgttcgagaggctcctgtccctgtcccgcggcgaccgcgaggcgcagagcggaggcggcgcggggacgaggaggaggaagaaggagtcggcctcggtgccgtcgtcgccgcggaaggccgaggagatcgacatggcgtcgtacccctccgtcgcgtcgtcgtccgacctctcctactgcatcatcggcctcccccgccgcaacaggagcagcagcggtgcgcgagacgagcatcagagcgctggctcgtcggagaggagctcgtgtaggaaggcgacgaggcctcatccgttcaatct

SEQ ID NO: 65694 - DNA, 657 bp, Triticum aestivum
  Clone ID: PAT_TA_65694
cgacctcccctgccttcttcctctcccttccctgtcgttcttcctcacctcacatctccccttctttgtctgttcgaacagggcgaacaggagcttccgtcatcgcatcatggtgtcgttcccctatcatggcgcccgagcgcctcaaattcgtcaccgcatcgctccggcgagcctgctcgctggcgacctcaaccaccaggccgctcctctgcccttccctttcccctctccttctgcctatctctcacatggtctctctctatcaccttcataggataccaacgctgacgccatgtacgccgccgccccgtgcttcatctctgcacccctagaacggcacgtaatcgaccagatctggcgtctttcgctcggatccgtgcctcccccatgcccgcgagcccgcgtcggccatgttcctcattagcgacgacgaacaaggcagccatggcccctccttcgaccgaaccggcacagccacgcgggcgttgaccgcgccttcctcacccgcgtggaccgcgccattcctccaggctcagctgggcttggcccaatttgcgcttctccttgatagttctggttacgttgcgattgtgaggacccgttcgactatgttggtccatctacttcatggactcgatcttcttcctagcggga

SEQ ID NO: 65695 - DNA, 583 bp, Triticum aestivum
  Clone ID: PAT_TA_65695
atggcggcgccgtcgtccctcgcctcctcccgcctcgccgccgccgccccggcgccgcagcaccaccaccagaaccaccagctccgcctcggctgctcccgccgccgcgcgcagcgcctcgtcgccatggccggatccggcaagttcttcgtcggaggcaactggaagtgcgtaagtacccgccgctcccttcacgccccaccggctttgcgcgcacgggtttgacgcgtcagcgccgcgccgatggggaatctcgagtacggcgctggcggtggcggtggcggtggcggtggagattccccttgcgtaccgcgtgacgttttttaatcctcgcggcggcattgtggttgtcgccttgggggatttcgtttgtccctatccgttcatgcaggcatcgtgctatacaccgtactggggccatcttctaggattagagttgtttttcgtgccgtgccgtagttttgcaacttccttctttcatgtcccttataaccttcatcagattccaaaagacgtcgagaattgaggggcatttgatgcaagacttgagtaacagaagaatgttgctagttattatgtcacc

SEQ ID NO: 65696 - DNA, 259 bp, Triticum aestivum
  Clone ID: PAT_TA_65696
gttgttttgctcatgcacaacccatcataggagtcagtaggatcatcttcatgggtgtatggactgcaatagttatccggtttaaggtgtggtggatggcgcacaagatgaaggacaagggcggcagcagcccacatgagacacaactcctgctggtggagtgaaggccccggggcctgcagcgactaggaggaagacacctcgtaggaaactgagctggatggtgagaatgctgatgttgtggttactggagatgaga

SEQ ID NO: 65697 - DNA, 262 bp, Triticum aestivum
  Clone ID: PAT_TA_65697
cttcgtctgggttcttgcaaagctgttcgaccggggcgagatggaggacaagcggaaggccgccgacgacgacatcaaccgggcaactaagcagccgcgtgcaacgccgaaggagactacagccagcggcgacattgccgggacttcggagcagcctgcagacggctatttgcagccgcttccaccagccttcgctgtaggcctcccggccgatccctcttctcagctcggtgcagctcgcagtcgaggtggtggtgggtgg

SEQ ID NO: 65698 - DNA, 542 bp, Triticum aestivum
  Clone ID: PAT_TA_65698
ccatggaggcaagtattgcaaggcaaatatgccatgtccttttgtttccccttaaacgtagttttgatagtttcatgttctttttattttcagaacttgtcaggtacatcagtagacatcctgttcggaaacgtactcctcgtgtaccagttttacttcctttggacatcaatgctacaatcaaggctaatgaagagataaataatgatggaagctctcctgatggaagttcaggaatcactgaagcaaaggttgttcagggccagactttcttggaaatcaaaggaactgaagatactgagatatctcagtcccagcaacatttaaatttgaagaagagaagaattcagcaaagcatggacgaaggccagaccagcaaagttgagcctggtgccacgatggtggctaaaaaagaagggcataacttatctgattatgagagacttagtcggttattttctccagaggagatgatggtcttagatgtgttggagagtctggtgactgtgcccaatgaaacgtcacaggccaagattaatagt

SEQ ID NO: 65699 - DNA, 477 bp, Triticum aestivum
  Clone ID: PAT_TA_65699
cggctctcctcgccgtcgccgcctgctgcgcggcgctcctcgtcgcggccgcgccgccgcagcaccagcagcacaagcacgtcaggatctcagggaatgccggcgacgtgctggaggacgacccggtggggaagctcaaggtgttcatctacgagatgccgaggaagtacaaccattacctgctcgagaaggacaaccggtgcctctaccacatgtttgcggcggagatcttcatgcaccagttcctgctggcgagcgcggtgcggacaatgaaccccgaggaggccgactggttctacaccccggtgtacgtgacgtgcgacctgacacagcagggcttcccgctgccgttccgggctccccggatcatgcggagcgccattcagtacatcgcggcgacatggccttactggaaccggaccgagggggccgaccacttcttccttgctccccatgattttggggcatgcttccact

SEQ ID NO: 65700 - DNA, 564 bp, Triticum aestivum
  Clone ID: PAT_TA_65700
tcctcgtttgctgaccagcgactgtcgcgctgccccgtcctcttcctccggtccagttgcacgctgagccatggcagccgccaccaagatcgtggggatcaccacgaactccctcctcaagtccgccgcgccggcgtcgctgtcagctgccgcaccgtcgaggcacaactcatggtggtcccacgtccagatgggtcccccagacccaatccttggagtaacagaggcgtacaaacgtgaccagaattccaacaaaatcaatttgggtgtgggtgcttaccgagatgacaatggcaagccatttgtgctgcccagtgtaattgaggctgaagatcgtatgcgcaagaagaaccaggacaaggagtatgcccctatctcaggccctgctgagttctgcaagcacagcattacacttgcactgggtgaagataatgaacatgtcaaaaattctctcaatgcaacagttcagggtatctctggtactggctctctccgtattggtggggctttccttcaacgcttccttcctggaaaggacctgtatttgccaacttcgtcatgggg

SEQ ID NO: 65701 - DNA, 670 bp, Triticum aestivum
  Clone ID: PAT_TA_65701
aaaatacaacaaaagaatatatatttttcactagcatgaacaccaaagaaagactgttttaccaacaactaatttcggtacctctgtctattgttcatgtgattttgttgaaatactctttaacaatggtaaatgcacaagaaaaatgagctttataacaactataggttaattgaaccgttcagtgagttatagcttatctcaattgtatcacattggataactggataccttgaggcatgcaacggatctctttctttttgttaggcagtggttgggctcaaactggtgcttttggactcataaacatatgtactgtggcatattatatcccgtattggcttgaccttttctacctgaagatttccttaacaagtggcaaatgtatttttctacttctttgctgtattgcacctatcaaaaatagatcatttttagatgattttttctactgtcaactatatatggcacttgcattatttcatagatttattgttgctgggaaacatgttctacacagccataaactgcttcagcatgctcccctaaaagaacctacttcagcatgctgaagaccatgttgtgagctataaagcctacaactcttatgtagcctatttactaaagcaaagaaatatcttgcactgactagtgtgtatccttcgtttgc

SEQ ID NO: 65702 - DNA, 294 bp, Triticum aestivum
  Clone ID: PAT_TA_65702
cgcggcggccatggtagacgaggagcacgaggtgtacggccaggagatccccgtcgacggcgaggacgtcgacatgggcgccgggggcgacgacgccgccaagctgcacgagctcgacgagatgaagcgccgtctcaaggagatggaggaggaggccgctgccctccgcgagtatgcaggccaaggtcgccaaggagatggggggcggagatcctaacgcgaccacatctgaatcaaaagaagagatggattctcgttctgtttttgttggaaatgttgactatgcatgcactc

SEQ ID NO: 65703 - DNA, 563 bp, Triticum aestivum
  Clone ID: PAT_TA_65703
agctggctgaggggcgacccagccagctgaaggtgatcgccgtcgtcgggttttgcggcttggggaagaccgccctcgccgcggaagtgtacaaccgagaaacccgcagcgagagatttgagaggcacgcgtgggtttatgcggcgctgaagagcccacgggaggtgctagcggacctgctccggaaacttagctccgacgccccttcttgccaggggaaaagtgtactggagacctccgatgtcggccaactctgcacagaactgaaacaacatttggtgatgaggagatatttcattgtgattgatgacattcgaacagaagatcagtggaaaaccatcaaatctgccttgccagcagataaggatattagcagcagaatactggtgacgacgactattcagtcagtagctaatgcctgcagttctagtaatggctatgttcacaaaatgagcagacttgataaaatgtgctcgaaacaattgttcaccaagaaagcttgtccggacaaatattcatgttacaagcagcctgatccagcggaagttttgaagaaatgtgac

SEQ ID NO: 65704 - DNA, 529 bp, Triticum aestivum
  Clone ID: PAT_TA_65704
catcgtctccctctcgttctcatcctcttccccaaatccaattgattgccccgagttcctatgaggccagaaccccaactccccaagctaatcaatgaattgtccattagtatcacacttcagtgtatttctttgcatcctacaaataccccaagggccccggcgaacggatccagagaggcgagccggccagcgacgacacaccctgtgccctggcaggaacacggagagtagcagccggcagatggccatcgatagttggggctgtggtccgcctgtccggcagtggagagcggagacgtggagtccagtgtggagcagcgttggatttcttctatttgctccaagagaccaagaacaggattcgtgaagacaagaattcaggtgttctctctccttttaactgttcctttttcaaaacttaaatcactaaagaactatttgagatcaaccatgtcagaggagagattgaatggctttgccatggtgctttattgagaaagatatgtcggataacattgatcttgac

SEQ ID NO: 65705 - DNA, 336 bp, Triticum aestivum
  Clone ID: PAT_TA_65705
tccatccaccaaaacattaacaaatcacagccgaggcgaccgccagcgaggagtgtgccccccgccgaagccgcaggcgcacgagctccagccgcgcgagccggccagcgaggccggccggagatcccctccggcgccgccgcccgccggccaatgcagccggactgccccgcggacctggtggtgaggatgcgcaggcgtttgaaccgcagcatgggcacggcaggaggaatttgattcctaatcagaggcgacttgctgcagtgaaaggctgtgactattttctgtaatggagtctcggatggaccagtacgagatcatggagcagattgggcg

SEQ ID NO: 65706 - DNA, 691 bp, Triticum aestivum
  Clone ID: PAT_TA_65706
aattgacctatcccttgtttcactcaaatctagtgttgctgtgggttaatgactgaatgtgtgctagtttctgctatgacatgccaacaattctcagttacaataatgcattcacattgctttgtcgtttggaaaggcaatatgacgtgaaaaactttcctgtcatcagacaataagtagtatgaaccagaatgtatatcctaaaaaaggaaccagaatgtgaaattccatgatcttgagcagttcaaggctgcttggtattgctatctttagatgggaaagtaaaacacatatgtaaaattgcaagcatgagtacagatgaattttccaagtaatggatccaggtaaaagccacaaactaaagttcctcctttgatatttttctcacaaacacgtgtctaaacgtgtgtcattttatattagaagaaacaccaggaaggcgtgaagagtacagaagaactaggctacaacagactgtacagaagaattaggctacaacagaagctcgtactatggatcaacgcaacctgcctgtcatgactaccgcaatacagctacgtatgagtacataatctctacatatggagacagacatgtctctttctcaagttcttggcgacatcaagaatgaccgttcctggtggggtttgcggatgaaggatgcactggcaaacggtttatcatgggatgc

SEQ ID NO: 65707 - DNA, 332 bp, Triticum aestivum
  unsure (1)..(332): unsure at all n locations
  Clone ID: PAT_TA_65707
ggagggagaagtaccatctcacgcagcccatggcgtcccgacgtgttcgccttgtctgatcgaccgccccctcttattccctcttgctcggcacaatcgcgcacgcggaggcgggtaggtgggtcgcaggtctggctagggcggaggcggaggtagatctgtagggcggggaagataagcgagggcgggccgggatgaggggggaggccaacggaggggaccggcggccgcgggacgaggaggagccgccgcagcngccggaggaggagcaggacaggacgtcgaggccgtcttccgggcagcagcagcagccggctgcggcgggggcggcg

SEQ ID NO: 65708 - DNA, 607 bp, Triticum aestivum
  Clone ID: PAT_TA_65708
gcctgccccccgctggcgcgaagcccggcccggtggtctactggatgctgcgggaccagcggctagccgacaactgggcgctcctccacgcggcgagcctcgccgccgcttccgcggcgccgctcgccgtcgcgttctccctgttcccgaagccgttcctcctctccgcgcgccgccgccaactcggattcctcctccgtggcctccgccggctcgccgccgacgccgccacccgccgcatccccttcttcctccttaccggtgggcccatggagataccagcgctggtgcagcggctcggggcgtcggcgctggttgccgacttctcaccgctccggccggttcgcgaggcactggacgcagtagtcggcgcgctgtgccgcgatgctgccagtgtggccgttcaccaggtggacgcccacaacgtggtgccggtatgggcggcatcggggaagctggagtactctgccaagaccttcagaagcaagatgaacaacgtgttggacgagtacctggtcgacttccccgagtttgcagaggtggtgccatgggacagggaccaaccaaaggacattgattgggatacgctaattgacacggtttgcag

SEQ ID NO: 65709 - DNA, 277 bp, Triticum aestivum
  Clone ID: PAT_TA_65709
ctacagcacagcgtcgcgtctggctcacgcttgacatactgtcctccaccctgccccacagtccggacggcggcggcggcggcacgagcaggccttgcgtcgccgtcagggtgacaaacgccagcctcgcggacgtcttcttcgtgcccttcttcgcgtcgttgagctacaaccggcactcgaagctccgggggagggatatggtgagcaggaacaggatcctgcaggccgagctggtgaggtacctgatgaggcaggaggagtggaggaggtgggg

SEQ ID NO: 65710 - DNA, 561 bp, Triticum aestivum
  Clone ID: PAT_TA_65710
caccatggcccccctgtgatggcttcctcggccacctccgtcgcacccttccaggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagctttatcgccttcaggccaccgggttgcgaggagtctggcaaggcctaaactacgagttgaaacaatggcctatgtatga

SEQ ID NO: 65711 - DNA, 586 bp, Triticum aestivum
  Clone ID: PAT_TA_65711
ctatcacatccaaacagaacaagggattttatcatggcggagctcatcatctcggcggttgtcggggacatggtcggtagggtgatatctcttctcgctggccagttcaaaggccaagggtgcaccgacgccaagctacggaggatttgccatatgctcgtcaaggttcacagtgcggtagaggaggccaaagggaggcacatcacaaactgcggcaccctcgagtggctttcggagctcaacgacggtgtgtaccagggccgttacttgctcgacacggtccgatgtagagagcaggagcttgaagatgaccatgctgacaaggtaggaacacaacctttttctttatccttgtttaatcctgcaaagcgtgtgcgcgtagcggcatgtgccgtgaagagcctactgtctcgcaatgatgttggtggtcctgaggagattgacagagtggtggaaatcttggaaaccatatccggtgatctcaaggagttcatgatgctcctacagaactgccagcccatccatcgtcctttggctactaatatcttcatcgaggggcagatgttcggccgacatgtcgagaaac

SEQ ID NO: 65712 - DNA, 620 bp, Triticum aestivum
  Clone ID: PAT_TA_65712
gcgctcctccctcctcagcctcccggcgcatctccggcatggcccgcaccaagcagacggcgaggaagtccaccggcggcaaggcgccgaggaagcagctggccaccaaggccgcgcgcaagtccgccccggccaccggcggcgtgaagaagccccaccgctttcgccccggcaccgttgcgctccgggagatccgcaagtaccagaagagcacggagctgctcatccgcaagctccccttccagcgcctcgtccgcgagatcgcccacgacttcaagaccgacctccgcttccagtcctccgccgtctccgccctgcaggaggccgccgaggcctacctcgtcgggctctttgaggacaccaacctctgcgccatccacgccaagcgcgtcaccatcatgcccaaggacatccagctcgcccgccgcatccgtggcgagagggcctaggctgcaacccatgcttggcgtgttagatccctaataggcatcggtggaaatctgtgtgctactagtgtttcagaatgtgtctgtgttgttcttgtcatgtgtctaatctgatggtaccctcttgttgccatcagcaatggaaatgaaaatgttggcttccaaaaaaaaaaa

SEQ ID NO: 65713 - DNA, 484 bp, Triticum aestivum
  Clone ID: PAT_TA_65713
gccggccacgccgctacagcgccgcggggggagataaggaggccacttcgcctccccctgggatatttatcccctctctctctgtggcccacgcctgctctatctccctttggcctcgccctcttctccagatccgcccgcacccaagcaccatcgacgccatggctccgtccacgcgacaaccggctgcccctctccgcctctccgtgtccaggaactttacccgcctcttcttcatcaacgacgaggatcaaacggacccgggcgatgccacaactcgcggatcgagccgattccctcgtctgcatcaccggcgttcttcgacgactacatcgcccccgctgctccaaagcttccaccgggcctacgtgtgcctccccgatgttggagcccaggagccagacgccaccgtcgacgacgactcctactacactggaggtggctactactacgtgcaggccggcgatgacgaccatgattagtt

SEQ ID NO: 65714 - DNA, 551 bp, Triticum aestivum
  Clone ID: PAT_TA_65714
gaccgcgcgcgcagcaccgccgccgccgcgattttcgcttagtttgttcctcgcctccgctcccccttttaccttaactccgtccatgggcatcgtcttcctggctgcaatagccagtgctgctgccataaaaaagaagagccgcccgcaactgcacctggaaaattgatgatgtagaaacaacgccgtgcttgcacttttttattctgtatcttcgtgttattatgtactctataaagatgcattcagaattctatatatttcgagtttcttttatgccatgtccatggtggaaggttcagccactgtattttactctttaccatccatgctggagcagccttgccatggatggaagcattcacagcataatactttggcgacgcgtgcctctgtttgaaatatattggtacacttgtttgttgttattatgcatgcttcgttctgcagttttttaagaaattcaggccaggcatgctcaaagttacacttgttatcacagacatgtactaagatataatttccttgctaccagtacagcttctttgatt

SEQ ID NO: 65715 - DNA, 595 bp, Triticum aestivum
  unsure (1)..(595): unsure at all n locations
  Clone ID: PAT_TA_65715
gccgccactccacccgcagcggcaaccatggcggtcggcaagaacaagcgcatctccaagggaggaagggaagcaagaagaaggccgtcgatccgttcaccaanaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccc

SEQ ID NO: 65716 - DNA, 366 bp, Triticum aestivum
  unsure (1)..(366): unsure at all n locations
  Clone ID: PAT_TA_65716
cgtcccgtctctgttggtggcaggctagggttgcgctccgcgcgccgtcggggctcgcgatggacgacagcgccattggcgagaagcgcctgccggagacggaggatcgggaaagcccgggcggagtcgccgaggaggaggtggggcgcgcgcaggtcggtgccgaaccggcgcccgatgcggccgccgcggaggtgggtggtagcggcgagatcttggatgccagagaaggggacgcggccgagggggttgtgcaggcgcaggagggtggcggcggtgaggttgtggaggtcanacaaagggacgccggtggcgacgaggtggtgtctgatgtggcctgcgctgaggcgaccatggatccatcgg

SEQ ID NO: 65717 - DNA, 587 bp, Triticum aestivum
  Clone ID: PAT_TA_65717
tagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggaggccgaggcgcccgccgtggtcgagacagagaccaaggaggccgtggctgaggcagagccggcggcggccgaggaggtgaaggaagaggcggcgcctgctgccgaggccgagccggccgctcccgctgctgctgaggaagcaccggtggaggcagccgcggccgcggtggccagcgtcagcgtgtgaggcgccagcgcgcgcggaggaggagctggctgggtcagcgtcgacggcggcggccgtgtgctcctacgtggcacggcgtgatgctgagtcagccagtggagtggtgctactttttac

SEQ ID NO: 65718 - DNA, 576 bp, Triticum aestivum
  Clone ID: PAT_TA_65718
gctccctcctctctgttctatgaccacgctgctgggaggaagcggccgttcgtggctccatacctcagttgaagtgccacgcaagaggtcaggggctgccaccaccatgaaccaggacaaaggcgacgcccgttgaagagcctccgggcatgaagccgatggcgaacatgccgtctctctgtcaacaagcctctaggaggacctaccggctggtcccgtgtcgtcgagcaagggccgccggttgcgtcgttgtgtgaggaggcacgccaatgagcagtggggaggagatgaggacacgcccctgactccctatttccttcaagtcgtaccttccctaagccgtctcttctattagggagcttccatatgggatctggactaggaaaaggagaacctatgcggggatgccgggcgatgagccgacgacgagtgtcggtgagctggctggacaggtgccgggcacatgggcgcggttggggagctgcacacacatccatcgacggcgagcacatccaacgccaacacatcgaggtgaacttcacccaatctgtgtgtgtgtggtcacggtgcagcatc

SEQ ID NO: 65719 - DNA, 678 bp, Triticum aestivum
  Clone ID: PAT_TA_65719
cgtccgccttccgccgccccaaaatccagccatcttctcccctcctcctccgccgctgcggccgaccccgatcgacggagatgcggaaacaccaccgaggtctaggatcggtggctgcccctgccctgctcctgctcctgctactcgccctcgtcctgccgtctactcagacccagtcccagaagcagagcgcgcgagagacggctgccatggcggcggaacccgcgcggcggctggcgggaggcatcgtggagtcgccggggcgagagaacgatctccacatcgtcggcctcgcccgcttcgccgtctccgagcacagctccccccttcccttaatactccgctggagttggagaaagtggtgagggtcaaggagcaagctgttgctggcaggctctactacatcacaatccaggtcgatgaaggcggggcaaagaagctgtatgaagccaaggtgctggagcagctgtggctggatgtcaggaagctcgtggagttcaggccggcagagggcgcctctcccaacgtttaaggcctgtcccaactgtgcaacagtgcaaggatctccagatatggtgtggatatagctaccgtccgtgcgacatgtgtttaacgtgctctcttgtgtactagtatcaagaacaagtctgcttcttgcgagttgttttgacctgccca

SEQ ID NO: 65720 - DNA, 425 bp, Triticum aestivum
  Clone ID: PAT_TA_65720
caggtccctatcatggacgaaattgacagaaaggtcgacaaggctaacacagaacttagaaagaccaacgtcaggcttaaagagatagtcaaccagattcgatcgacaaggaacttcacagttgatatcatactcatctgcatcattcttggcattggtgcttacctctacaacgtactcgcccagtgaatcctcggaacatggcggcatcagcaattcagcatgctctgttagagtaaaattatactgttgtagaactactctgcttattattaaagttgccatgcagcaaaggggtacttttcggcattgttcctaggcatgcctgaaaagatcattattatttgtgaaacgatatagttcaaccggcggattaccgccgccttgattgcacgccacgatgttccagttacgtggtgaacccc

SEQ ID NO: 65721 - DNA, 560 bp, Triticum aestivum
  Clone ID: PAT_TA_65721
ttccctcccgtcgtcaagccctcagccccctcctccgttgccgctggggagccaccaagactcggagatgcgggcggagaaggcgcgcctaggatgatcgagcgagcgccagaggaggagagcgcaggacgcgggggcacgacggggaggtcgcccgcccgggaagaagccagggccagccgaggcgacaagcccttctttggtttgctcttcatcttcgtcgaccacttcgtcgaggatgtgggacttgacgattatactcaaataattgaaagcttgggtggcaaggttgggacaggaatcaactacaacgaagccacacacatcgctgtgaaaggtcaggtaccaccaggggccagaatattctgggaagcagatgggaagacagtcactaccactgcttggattgagaattgcttcaacatgaggaagttattaacgaatccatgtaaagatagcagcgaaagcctgctcccttctcctgatatgacacccctggcaacgattaaatcaaggaactgcttatctgatagcaaaatatcaagcaagaactgctcgcc

SEQ ID NO: 65722 - DNA, 372 bp, Triticum aestivum
  Clone ID: PAT_TA_65722
acctgtctaccaccatgtccaaccacggtccgtcgcacgatccttcttctcatcggcagcaccgccttctctcctccacgctggatcgcgggccacggtcgcctccttcccgcttggatctcctcctgccgtcgcgctctccctctcggtctccgcctccgcccccacctcgccgtgggcgccggcggccaaccccaagtaccacaacgcgaacgtggacgcgggagacgaggacgtggacgggggcgatctgctgcggcagttcacgcgggaggtggggcgagccggcgtcatgcaccaagtcacgcggcggcggtggcacgagaacgcgcgggacaagcgcaagcgaaagtcccgcgacgccgcatggag

SEQ ID NO: 65723 - DNA, 394 bp, Triticum aestivum
  Clone ID: PAT_TA_65723
tcctgcctctccccagatccgattgcgttagggcctgcggcggctgtcgaagcccggcgaattcgtgatagaagatgctggccttgagctcttgctggatttggtcgatcggttaccccactggaggagttcgccgacagttttgaaagcccagatctggcccctctggcattgttaatgccagaccaaaccaaccctgccattcaagcggactcgaatgctgctctggatgcaggcaataagttggcgtctgcgggcccgggaggccgcactgtggagagcggtggcgtccggaggcatctccgactgtccgcgcagccaagggcaacccaaaagcgcctggttggacaaagatgttacgcctccctaatgcgccacctgaccggacgccatg

SEQ ID NO: 65724 - DNA, 169 bp, Triticum aestivum
  Clone ID: PAT_TA_65724
gcgctcggtgcggctgctcaagatcgacggcttcagcctgaccgagagcatggaccacgacgactgcgtcagatctaggtggaccttcgacaggtacgagtgggaggtccgcgtctaccccgcgatgaccagctctgccgccgccggcggcggcgcgtacgtggtgttg

SEQ ID NO: 65725 - DNA, 270 bp, Triticum aestivum
  Clone ID: PAT_TA_65725
tgtggagctcgtggacgacaacgacccctttatggccaccgagtacatgacctacatgttcaagtactacaccgggcagagccactggaagcacagcgacattaagctgaatgactacaagacggtggtctttggcgagaagccagttaccgccttgagcgtcaggaaccctggaggagatcccgtggggtgaggctggtgccgattactttgtggagtccaccggtgtcttcactgacaaggacaaggccgctgctcacttgaagggtg

SEQ ID NO: 65726 - DNA, 460 bp, Triticum aestivum
  Clone ID: PAT_TA_65726
ggtggccgccggcggcgatccggtgccgctggcgctggtagaggggacgccgctgcacgtgcgtgaatgtccggagccagtctcagctcgagatttgcggcgattttgttcagaatgcatccttcgcccctgaaaaattctcagattttgttcagtgatgtagctatggggatgtggtggtcttgtgtctgatttctttgcccacactttgggggtagtactgtacagagggcaattgggaattgaacaatcaaatgttctgcaactcatccagaaacttatgttacttatgatactgacgacaataggctatatgcgattctcatgtagccggttttaactgaagtttaacatattgatatacatcatttttatattgttgaagagaggtcataaaaaatgtcaattagaaatttacaatccttacaaaatcaaaggggaaacaaaactactctttgca

SEQ ID NO: 65727 - DNA, 711 bp, Triticum aestivum
  Clone ID: PAT_TA_65727
cttttgtgcgtggggtttcagggggtgaaagaaaaaagtttgcattcggaaatgagattataatcaatccatctttgcttttccttgatgagccgacatccgggttggattcaactacagcacttaggatagttcaacttctacatgacattgctgagactgggaagacagtgatcaccacgatccatcaaccatccagcaggctgtttcataagtttgacaagcttatcctcctgggcaggggaagtttgctctactttgggaagacagctgaagccatgccctacttttcatccattggatgcaacccgctcatcgcaatgaacccagcagagtttctactggatcttgctaatggcaacactaacgatgtgtctgttccttccgaattagatgacaaggtgcacatggaaaatcagaatctgcaggatactaattccaagattaacttaaggccttcagcacaagatgttcatgagtatcttgttgacgcctatgagcatcgagtggcatataaggagaagaagaagcttctagcaccacttccgatcagtgatgatatgaaggcaacaataacatcttcgaaacgagagtggggcacaaactggtgccagcaatattccatcctcttctgtagaggtctcaaggaaagacggcatgattatttgagctggatgagaatcacccaggtcatagctacatcagttatct

SEQ ID NO: 65728 - DNA, 430 bp, Triticum aestivum
  Clone ID: PAT_TA_65728
gaatccaacattcttggcaaaggagggtttggcaatgtttataagggaacgttggaagatggtaaggaaattgctgtgaaaaggcttcgtgtaggttctgtccaaggggcagtggagttcaaaaatgaaatagctctgatttccaggttgcagcatagaaacttggtcaaacttataggctgcagtattcatgaagacgaaaagtgtttgatttatgcatacctacctaaccgaagtctggattacttcattttcaatgatagaagaaaatcactgctcaattggcccacaagatttaagataatcgctggtgtagccaggggacttctttatctccaccaagattccagattgacgatgatccatagagatctcaaagcaagcaacatattgttggatgctgagatgatccccaaaatatcagattttg

SEQ ID NO: 65729 - DNA, 394 bp, Triticum aestivum
  Clone ID: PAT_TA_65729
caacccgtgaggagaatgtgtacatggccaagcttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtact

SEQ ID NO: 65730 - DNA, 634 bp, Triticum aestivum
  Clone ID: PAT_TA_65730
ctagcccctctacctcgccttccttctcttcgttgtcaatgcggccttcatcgacccctggttccagatcgggcgcaggttaggcgagcccggtggtggggtgaaggggcaggggaggcgggcgaccagggcaggtaactgtcggcccgtcgcgatgtgctgaggctacagggaacagggaggaggtgggccacagggtgaaggagcaggccggccctcctggaagcaccgctgccgctcagccaggaaggaggccaggctcgcctctgctgtgccatgagcggcggcgccgcctatgcctccacccccaccttcttttccatgcctcttcctccgcatatgcagattttggggagactcccagaataataattcaagtggatggccgatgcaccttgttgtttagcggtctgatgatcggcgaaagtatgttctatattgcaagatgattgcagctgatgccgagcctctcgggagagcctcttccaatttcccctcctcaccaaggacgagggcatgaggtagtaactgtagcatgcagaattacctacagcttgagtatatacacattatccacttcatattttattccaatggttttacttccacatcacatgtttatttatattaaatc

SEQ ID NO: 65731 - DNA, 619 bp, Triticum aestivum
  Clone ID: PAT_TA_65731
caagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatg

SEQ ID NO: 65732 - DNA, 399 bp, Triticum aestivum
  Clone ID: PAT_TA_65732
accatggccggcacgtgcgcccacgtcgaattcctccgcgcgcagccggcgtgggcgctggccctcgcggccgtcggcctcctcgtcgccgcccgcgccgccctgcgcctcgccctctgggtctacgccgccttcctccgccccggcaagcccctgcgccgccgctacgggccctgggccgtcgtcaccggcgccaccgaggggatcggccgcgccatcgccttccgccttgccgcctccggcctcggcctcgtgctcgtcggccgcaacccggacaagctcgccgccgtctccgaggagatcaggggcaagtaccccaagaccgaggtccgcaccttcgtgctcgacttcgcttccgaggggctcgccgctggggtggaggcgctcaaggactccatc

SEQ ID NO: 65733 - DNA, 512 bp, Triticum aestivum
  Clone ID: PAT_TA_65733
gtggtgtggatgcaacaatcgattacagaaatcgtttacttgcttgtgccaacgctaccagtgcagaaacatgttacatcaccagtgatattcatgctcatggtctcaattcagagtgcactaaacaagcagatactgacatggacaatattgtggattcaaaatctagagcacaaagccaaccaagtggttacaaacatgatcttcagaaggtcacatcaaataattgccttgaacactgctatcggacagacacgtctcgttttagcaaagatctttctgtgaccggaaaagttgacgtcgaggaagatgattctcagtatgaggatggggaacttagggaatctggtgaccgttattgggccgatgacatttatgaagaagttaaatgtgctaattatcaggtatcagattacaaggatgaaaaagctgccccagacattcatcatgtacctgttggctctgtttaaacaatatggttatgccagttgctaattacaatggaacattat

SEQ ID NO: 65734 - DNA, 161 bp, Triticum aestivum
  Clone ID: PAT_TA_65734
aaaaaaaaccctctgacctctctctggtcccgtgctctggcccttcaccggcggcggcctctccttcgccgcgaccggaaacaagctgcactatctgagctcagttcctcctccacgctagacctctaccgccaagtagccgccgcctcctgacctgtcgc

SEQ ID NO: 65735 - DNA, 118 bp, Triticum aestivum
  Clone ID: PAT_TA_65735
cttccgctcctgtccctcatcggtacttggcggtcgacaagcgatcgatggcgtcatcgttggtgtggtcgaggcgcgcgctggtcagtgatggtggtggcggctgcgatggtggtgg

SEQ ID NO: 65736 - DNA, 495 bp, Triticum aestivum
  Clone ID: PAT_TA_65736
cgcgccatcgccgcctccctccccgccccgcgccgccgccaggccccgaccacctcccgcgccgtcgcctggccccggccacctcccgcgccgccgccgccccccatcgctgccgcccccaccaggaagccgagccagtgcagcggccaccacctccacccggcggtgcagtcaccggcccccgccacgcgcaccatggcgccccagctccaccggccccgccgactcctggatccactggcaaccggcgccgtcgccccaacctccgtctttcacggtcgctcgcgcgtcgtggcctccttcccggaccacccctccgccgtgccccgtcgactcagatcgtcgccggccttcctcccctgcttctaccgcggaggtggcctccatctgccgtcaaccgcccccacgacctgccccagggcgcccccgcgacctttccatggcgcccgcgtgacctgcccatggggccaccgtcgctccaccatgcgtgcgcgt

SEQ ID NO: 65737 - DNA, 520 bp, Triticum aestivum
  Clone ID: PAT_TA_65737
tgcgcagcttacattacctccacaaggtcgtgcaaattgtccaattgttcatttgaatttaagcccgtcaatgtattgttggacgagaactacataccacgcatcacagggttcgatttttccaagctcattggtgaaaagaacaccaaatccgtggtacttaagctgaatggacccatagcttacctgccaccggatttcctgcactccaagggtcctgacctcaaatatctagctacggtagacatatacagcttgggtcttatcattctagagatcgtaacgcagcaagagatcaaaggcaaccactggagtgcttattaagagcatagaggaaaactggagggaagagtcacaaataacacggttgtatacctcactagaagctgacgaactgcagcaagtaaaaatgtgcattgatattggcctatactgcgtccagtcaaagcctgaaaagagacctacggctgaggacatcatgctctggcttgataaagggatcaaaccagtcccaacccca

SEQ ID NO: 65738 - DNA, 354 bp, Triticum aestivum
  unsure (1)..(354): unsure at all n locations
  Clone ID: PAT_TA_65738
caccaaccagcgctgcccaccacagccccgacgacgaggcggccgccttcttccgcgcggcgccgcccctccgcgaccgcgacgccgtcgccgccagcctcgccgccttcgtcgcccgccaccgcgcacgctccgccgccggcgccggcgcatgaggaggaggagggcccccggcggtggcgggggtggtctgcgtgacctccngcggcaccacggtgcccctggagcagcgctgcgtgcgctacatcgacaacttcagctccggccagcgcggggccgcgtccaccgagtatttcctaaaggccggttacgccgtcatcttcgtccaccggcgcgggagcaagcagccttact

SEQ ID NO: 65739 - DNA, 396 bp, Triticum aestivum
  Clone ID: PAT_TA_65739
aaaaaaaaggctgagctagggtttgaaccaccatctctccggcctgcccgccagcagcacgccggcgagcctggcgtccatggaggcgatgggggcgggaggggcatgggccaagggtcggcccgtggtggggtgctgggccgggcgcggcagcacgggacccgtcgaggacaggggcgcgtgtagtgggtgttcctcggctgccccggagtgggcaagggcacgtacgcatgccgcctcttgcggctcctcggcatgccccacatcgccacctgcgaccttgtctgcggcgagctcgcctcccaaggcccctctccaagcaggagttaaggttgtatttctgaggggagcatgtctattaccttgattgagttgacttttggctattgtattatt

SEQ ID NO: 65740 - DNA, 628 bp, Triticum aestivum
  Clone ID: PAT_TA_65740
ccaccccccgtccgctcctggcgcccaagccgagaagaagccggcggcgaagaagcccgcggaggaggagcccgcggcggagaaggccgagaagactcccgccgggaagaagcccaaggccgagaagcggctgccggcggggaagtcggccgtttttgagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctcaatgttcagtacgtaaaaaaaaaaaaaaaaaaaa

SEQ ID NO: 65741 - DNA, 620 bp, Triticum aestivum
  Clone ID: PAT_TA_65741
gtttttaagttctgatcaatgcctatttatgtttccgtatctgctttgtattcgctccgtgtctgtttccggtagtatctgtttccggtagtatctgtttccgtatttatttccggggtttttgtattcgtttccgcttctgcaaaaaaatatgaaaacaaatatgatagcactcagtttcgtccgtttccgctccgttttcatccctacacatcagcactcagtttaagttttgaactgcaggggcgtgagactgcagcatgctgtgtacataagcagggagttgaggggcagaactgaaggtagactcaggtgcagttatccactccttcttgctttcactagaagagcgtattacgcggtgaaagcaagatcatgctgtacaggcatgcagctgtgagaaatacagtgatggctccgtctgagttctctagccctctgcaattacaggtttgggtgcacactccgcagatgatgatggttcagcagagatagcattgctctgtgttacataactatgttctgtcagtcaagtatcgttacgatgcaataggcagaggcttcaaaatcatctgcggagtaagcgataggaagccgttgtgcaataaatgtgctcatat

SEQ ID NO: 65742 - DNA, 437 bp, Triticum aestivum
  Clone ID: PAT_TA_65742
agcggcggacaagtggtgaacccgctgttcgagaagaggccgaagcagttcggcatcggcggggcgctgccgcccaagaaggacctccaccggttcgtcaagtggcccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagctggttgtgtg

SEQ ID NO: 65743 - DNA, 462 bp, Triticum aestivum
  Clone ID: PAT_TA_65743
gtaaattccctggcagtattaatgtttgcctagttaattgctgcatgggtatcagcttcagtatgattagctttgttatgttcctgtttatcaatctttgtgttagcgtgcatgccattttacgttctctccctctttcatggctgctttatttcataatttcctgccggtcctgcggaagctaaattaaatctgaacagatttaggtcctgtcctgtcactaccattagtcctacatatatcccccacttcaataaatgcaaccatagtatgaccagaagtctaattgatatcatctgtttctggtatatgtctgttgtgttgtgcctatgaatagcagcacgtcttctctttggttactggaactctttctcctaaattgttgtggttgctactattagacttgtactgtttggtgtgagtgagctcgttattgattgtcaatattacctgtttgttacc

SEQ ID NO: 65744 - DNA, 534 bp, Triticum aestivum
  Clone ID: PAT_TA_65744
cttggagcacaaagtcgaggagcatccccaacgcaccaacgtctgtgccatccttcgcatccacggcatcaacctccacgacgatggagaccatagatcctctcaatgggacccaagaatgccagtgagtcactttggcaaggatcctggtgtgtcccacagtcacaccaagtcgtatgtgcgctccaaggaaaggaagtttgagaacgcttgtggtatgaggaacaggggtggcttcaagatcctcttgaggggacccaataatgctcgtgaggcggtgaggcactttggcaaggctcctggcgtgccgcacaaaccacatcaagatgtacgtgtgctccaaggaaaggatgtttgagaaggcttgtggtaggaggaacagccatggcttcatcaagctgcagatccatggcccgctggagctgcccatcttcagcaacttgccgccacatacagaccccgcccccgcgtcggctacgttgacttccacaaagtggttgagatgcagcccaatatgtcttcaccttgaaccac

SEQ ID NO: 65745 - DNA, 520 bp, Triticum aestivum
  unsure (1)..(520): unsure at all n locations
  Clone ID: PAT_TA_65745
cgatcatccagcatcacgcatacacacgaggcaggcagagagaagcagagaggactcggcagaggaggagatggtgaagattccgagcccgaggaggctgttcaggagccggtccaagagcacgaccggcagcatcggcggggtggacatgtgcgccatggtggccgagcacgagaggatcgagtgggaggtgcggcccggcgggatgctggtgcagaagcgccgggggccggacgacgacgccgtggtcgaggccatcctggtgaaggtctgcaccgccggcggcgcgtggcagcacgacgtgtccatcgacgccaccgccaccttcggcgaactcaaggtgctgctgtcgctggccaccgggctctggcccanggagcagcggctgctgtaccgaggcagggagcgggacgacggcgaccacctgcacatggccggcgtccaggacaaggacaaggtgctcctcctggaggaccccgccgtcacggagaggaagctccggtccaccaccctcgcgcag

SEQ ID NO: 65746 - DNA, 552 bp, Triticum aestivum
  Clone ID: PAT_TA_65746
aacatggaaccgtgtcaatatgagtatcgccatcctcccgatgtcagcggagttcggctggagcccggcgaccgttggcctcatccagtcttctttcttttggggctaccttctcactcagattcttggaggcatttgggctgaccgttttggcggcaaggtggtccttgggttcggggttgtatggtggtctattgcaacaattcttacaccatttgctgccaagcttggccttccgttcctactcgtcgtgcgtgctttcatgggaataggcgagggtgttgccatgccggccatgaacaacatcctttccaaatggatcccggtttcagagaggagcagatctcttgcattggtatacagtggaatgtaccttggttcagttaccggcctggccttctcacctttcctgataagcaaattcggttggccttctgttttctatggatttgggtccctgggaagcatctggtttacactgtggcaactcaaagcgcgcagctctccgagtgaagatccggaagtaaccgaagatgaaaagaggcacatact

SEQ ID NO: 65747 - DNA, 368 bp, Triticum aestivum
  unsure (1)..(368): unsure at all n locations
  Clone ID: PAT_TA_65747
acgcacgacgaggagacgatgaactacttccaggacaccgacgtgcactgcgtgctctgcccccgggaccccgacgactccggcagcttcgtccaggacctgcagatctccaccatgttcacgcaccaccagaagaccgtcatcgtggaccacgacatgccccagagcggcggcggccggcgccggcggatcctcagcttcgtgggcgggcttgacctctgcgacggccgctacgacacgccgttccacccgctgttcgggacgctggacggcccccaccacgacgacttccaccancccaacttcgcgacggcggcgatcgccaagggcgggccgagggagccgtggcacgacatccactgccgcct

SEQ ID NO: 65748 - DNA, 357 bp, Triticum aestivum
  Clone ID: PAT_TA_65748
acatcttctgctgcgaccacgccaacgagcagaaccggaatgatcgcagggccaagggcgacaccaagaactcccagcaccacgcccaggagtacctcgacatcttcctccagtccggcgccgccattgcgctggttcacctctacctctcagatttctcctcctcgcgcttctacgccgagcgcgccatcaggtgctttctcagcactgaccctgcgaccttaccgcccaatgtaatgctcgtcacggcgccggtgctcctggaattctgccgcttgctttctctgaccgcgggcaacaaggatcgcctctacaagtcatgccgtcatacacttgcatcggcgctctgcttgccac

SEQ ID NO: 65749 - DNA, 108 bp, Triticum aestivum
  Clone ID: PAT_TA_65749
ggacgtcgagctatgcgcggatccggcgaccgacgaggtctacgcgcggctggctctggttgcggagggcgaggtctttgagaagaacatgggaggtgggaggtttga

SEQ ID NO: 65750 - DNA, 117 bp, Triticum aestivum
  Clone ID: PAT_TA_65750
gtggtttgctgagttcaaagcaacaggtacatgaatggaagaccattgaagaaactaacattgggaataatgttgtgatgcaaatatgaggtcatgcccatactgaagttaagctac

SEQ ID NO: 65751 - DNA, 283 bp, Triticum aestivum
  Clone ID: PAT_TA_65751
gtcgacctacgcaataaataggcggtgctatggctctcgtatccctctaaattttttctccctgccgccgccacccatagaacccacctttcttcctcacgagcggcgagcgatgtcggaccgcagatctcgctctcgccatgtcctcatcactgccgcagatagccgcggcagatctgtcgctccctattccatcagcgctgctgccaggggctgccgcagatctgtcgatcgctctgctgccgagggccgccgcagatctgtcgatcgctctgctgccctc

SEQ ID NO: 65752 - DNA, 433 bp, Triticum aestivum
  Clone ID: PAT_TA_65752
tgaccctggccggcgcctgcggtactgcgctgccgctgtggtactcgcaccgacgattctcccccactggccgctgaattcattagaggcgacccatgtgaaattggagcgcctcgctcgtcgaatccgtagtctgtctctgtggagcgaaatgcgtctttcttcatcgtctgaaattgtagagtttccatgacaccaagacttagtttcgtagtggccattttctaaaaactgtgctgcagcctgcaggtatacctttgctcctccgcgacccatttctttgactaacatgggtgggcttggagcaatgtgacactaatccagtgtgcaactgactagagttttggtcctaccaaactgtcccttctgcatctgatgcttttgttggttcgattgtgtaatcgtgcttatggagtatctagtaatgtaatgc

SEQ ID NO: 65753 - DNA, 246 bp, Triticum aestivum
  Clone ID: PAT_TA_65753
tggctgcgcatctacgaccggatggtggccgtcctgcggaagagccaccgggacgtggaggcgctgctcgccgaccgcacgcgcctcgaggccgtcctcaagatccagcacgacttctggctccaccgcgatgccgtcctcagggaccgcctcgactagacgcggagggtggaggactgcctgcggcggggcgacgccgccaagctcgacctgctcctcggagacaaggacctcgaggtgcgccgc

SEQ ID NO: 65754 - DNA, 248 bp, Triticum aestivum
  Clone ID: PAT_TA_65754
cgcggtcgcggcctcttatcgccgccgccagccctcttcggcccccgccgaggcgcagccggaacggcccgcggacgccgaggcgccggtgctggtcaggatcaagagagagcgggacccggttcggctgtacgagctgttcaaggccaatgcggacaaccgcgtcctggtcgagaaccggttcgcgttcgaggacgcggtggcgcgactggcaggtgctcgacggagtgacctcgtggaggagatcc

SEQ ID NO: 65755 - DNA, 539 bp, Triticum aestivum
  unsure (1)..(539): unsure at all n locations
  Clone ID: PAT_TA_65755
ccaacctccatcgaacagccgacgtgatcgaggtcgatcgacaagcttaaggtagccggcaagccagccaacatgggctgcagcatgagccgcctcctcaagctaccgtcgctctggtcatactcgtccttctcttcatgcccggggccatggcagccgccgccgcaagcttcgacgcctcgcgggcacagcagctgcccctgccgcccggagaagtgcacgggcccgagagcgtcgccttcgacgctcagggccgaggcccctacagcggcgtctccgacggccgcatcttgaggtggaacgggcccaagctcggctggacgacatacgcctacggaccaggctacgacagcgaaacgtgcaccacatccangtttggcaccgaggcggacatagagagccgctgcggccgcccgcttggcctgcgcttcaacgagaaaacgggcgacctctacgtggccgatgcgtacaaagggcttatgcgtgtgccgcccggcggcggggaggccaccgtgttggtcgaccagattgatggcatg

SEQ ID NO: 65756 - DNA, 260 bp, Triticum aestivum
  unsure (1)..(260): unsure at all n locations
  Clone ID: PAT_TA_65756
ggcgcctccgtgtacctggccaagatcgggctcgccttcgtcttcctcttcctgctcggcgggctcttcacctacctgctcgagaccgtccccgacatgatcctcgcctccactcctcctcagtccatgtagcaggatcttcgatcaaaaaatttgtcatctttggaagggaattcgtgttccttcagaagttaatgattcttaatccgctttgcgaanaaaaaaaaaaaaaaaaaaaaaaaaaaaaaaaaaaaaaaaaa

SEQ ID NO: 65757 - DNA, 349 bp, Triticum aestivum
  Clone ID: PAT_TA_65757
tggaagatatcattcgctggggaactgaggagctcttcaggaataacgatgaggtgaatggtaaagataatgatgaagcttctggtgctaaacatgatgtatctgatattgaggttaagcataggaggaaaactggtggcctaggtgatgtttatgaggataaatgtattggcagttctaccaagcttatttgggatgaaaatgctattatgaggcttcttgatagatctagccttccaacaactgtagctgaaagcactgatggggatttggacaatgatgatatgcttggcactgttaagtcaatcgattggaatgatgatctaaatgatgatcccggtgctgctga

SEQ ID NO: 65758 - DNA, 565 bp, Triticum aestivum
  Clone ID: PAT_TA_65758
gactcgcctcccgcgcctatcctggacaggatccgcactgccggaggctctgtagcagccgcacaggacggcgtcgaccttcgctgctcgccttcctccatgcctcctcgccgtctcctccaccttcctcctatgcctgcacctgcaagctgcctagtccaacgccgtggcactgccctcacctcgtcccctgaaccgcaagcagccgtcgcccgcctcctctgcatcgagctcgtgcactcatccgcgtcacctcggtcccgcgacgaccctcctctgcgtctagcgccaagtccaactgctcccctgatccggtcgcgccgccttggatccggcaggtttcccatcgccgcgccaagtcccgcttcgccgtgtcgttctcttcttcccctgcaacaagccgcagctcctcgctcgtcgtcctgttgaccgcgccccctccagctcctcgtttggctaagcagaggcccagccacgccagatccaccggcctgctatttccaccgccttgggccaaggcccactgggtgagaactcccactgtgcactattggcccagtccgat

SEQ ID NO: 65759 - DNA, 313 bp, Triticum aestivum
  Clone ID: PAT_TA_65759
gcggccgccgagctggcgcagcgcctgcgggccgcggccaatgaccggctggcggggcaggagccgctcctcctcgtcgccgcgccgctgctcgcgctcctcgccgcgcgcgccgtccacgccgccgccgccgacgtcgccgaccgcggcctccgcaccgtcctcatcaccctcgccatggccaccgtcaagttggtgccgggggtcagcgggtacatcgccgccgacaagagcaaggttgttgagcagttgcagtcatgcagtgcatccgccaggaagaacctgcgaaccgagcctgcccgccgtcggggat

SEQ ID NO: 65760 - DNA, 373 bp, Triticum aestivum
  Clone ID: PAT_TA_65760
cccccgccgccgccgccacgccggcgacccgccctcgccctccgccgccccccaccagccgagccgggcttctccccaaccccgagttgcctcccagaacacgagttcctcctctgcctcggcggcccaaaggttatcaaaagatccttctcggaaatggaatatagttcagacgatgattcggatattagcgattctgagattgatgagtatgaaggcaagattcatgcccgcctggtttctggagatttaaagttcaggaatggtgatagttacagctgcccattctgtactggcaggaagaataaagattacaacatgcaaagccttcttcagcattcctcaggagtaggtgctgcacctaatcgaccgg

SEQ ID NO: 65761 - DNA, 144 bp, Triticum aestivum
  unsure (1)..(144): unsure at all n locations
  Clone ID: PAT_TA_65761
aaggggggtgttaaaatatacggcacttgtgcgcatacgtgacagaagaggatcttcagaggaagtngtttagctagatattcagttgtaaccaagtctatctcctgcttttctttctccttttttcttatgccgattctccct

SEQ ID NO: 65762 - DNA, 519 bp, Triticum aestivum
  Clone ID: PAT_TA_65762
ttccgcgccgctgtttcgcccgcgagttggcgaaaacggtacgcgggcgcgcccaagtcgacgatggcgagccaaaaatggtaccagaccaaacgctagccaaatatcgtgggcgtgaccaattttttggtaaggctagtgttggtcaccatccaaacagcccctatgttttcaacttcatggaagctaacatgtaagtaccagttgcacatcttgtgctctacagattaagaactttgttgcatctcattttgctgactgtgtggcatctacctctgcatcaataaaatgagaccaggcttgcatgtgttgtgtcttgtgagtgtcccccacctgttggttccgttggttctgacggaagtatagtcttctgcgcattccagtaaaagtttgtggttccctaaatggtttaaaaaagatgttgtcctgtgataattttgcttgtgtacatgcattttgaaaaataaataacttttttaatttagtattcctccatactattctgttaatctcatttac

SEQ ID NO: 65763 - DNA, 515 bp, Triticum aestivum
  Clone ID: PAT_TA_65763
aactagcatctctgatgatgaattggatgaaaaattggttcggatcaatgcagccaatgcagccgtggtcaaagcgacaaagagcatgctggcacacagggatcctggtggatgcaccatccgcctcttgagcactgcgttctacttgagagatgatgcccccatatccattgggcatactgttggcaatgccatggctacacacaaggttgagaaagctgaattcacagttttgacagagaaggaacacaaggtcattcctgatgatgctctgaactttggggcacggtttgtgtcattttttaatgagtgcctcaatgcatttgctggtctcacacgccttgacctggcgaatttgagattcgttaagtcggactatgtctccagcatccttgtcacttgcaagcaattacattatttaggttttgacaattgcgacacatcggattggataacgctccaagttgaacacgcacagctcagcgagctcagtattgtctattgccgggttgaca

SEQ ID NO: 65764 - DNA, 395 bp, Triticum aestivum
  Clone ID: PAT_TA_65764
tcccagtcggtcgtctctccctccaaacgacgagctagctgcggcgccgactggacaagaatactatgagagactgagaggtatatagtccgacggccatatcccggtgaggcagagacgtagagagagggagcggtggtaggagatagtcggagggatggctgcggggacgctgcagatcaggccgaaggcgaagagcctgtggctgctggtgcgccggctgctctgccgcggcaacaagctgcacagaccgcccgcgggcgccggggaccagcagggagacggctgcggggagaagaggagcctcctcggccggagcggctcgctggaggagctcctggggccagacgtcgccggcgccgtccgccgcagcgcccggaaggacgtccaggtcg

SEQ ID NO: 65765 - DNA, 382 bp, Triticum aestivum
  unsure (1)..(382): unsure at all n locations
  Clone ID: PAT_TA_65765
cggtccacctccccaccgccgtctccgcgcgccggctccgccctctcctatccttgccgctgcgggcgtctcatagcgcgccggctctggccaatcctatttgcgccggtggtggatgcagcgcggccacctcgaagcggagtcctggaggcgcgggcggcggagggtgactggagatgatgtggacggcggtgggtgacatgagttgtcgcggacaacgggacgaggagaagtcttggccggcgacggactcgcgagaccgctcctctgacgacgtancgaagggcgagggggacagcagacgggcgggaggagcctgtcaagggcacggcaaggtgaggtcctggccagcgacggactcaccgagccactcctctgacga

SEQ ID NO: 65766 - DNA, 314 bp, Triticum aestivum
  Clone ID: PAT_TA_65766
agcgagcctcgccccaagacttgccctcccctagcgccgacgacgactgggcggcgacgcgatggattcgaggctgcgagaggtggacgcccccgccgagccggccgacggcgccgctgcgctggccaccgcgaaggctgaggtggaagtcaccaagccccgcaacgacaggcgcgggtaccgccgcgtggtgctcccgaacgccctcgagtgcctcctcatcagcgaccccgacaccgacaaggctgcggcgtcgatgaatgtctcggtggggtacttctgtgatcccgacgggatggaggggctcgcgctct

SEQ ID NO: 65767 - DNA, 406 bp, Triticum aestivum
  Clone ID: PAT_TA_65767
ttttcacggatctgaagtgcttcctctcggtacctacgatgccatcctagggatggactggctggaggaacacagtcccatgaccgttgattggcgcgcccgtttcatcgagacaatcaccctagcaggaccgatccggctgaatggacatgatgcagcttcggttgtctgtgaaaccatcaacagcatccaattacagagcctctgcagcaacggggctgtctcgcatatcatacacctatgtatgattgcaccagaccaggagtcaactgcacctgttccggactgcattcagaaagtggtcgatgattttgcggatgttttctctgaaccaaaaggccttcccccgcggcgtgcttgtgatcacaaaataccgctcacccctagagcacaactagtcaacatt

SEQ ID NO: 65768 - DNA, 388 bp, Triticum aestivum
  Clone ID: PAT_TA_65768
caccgtgcccgggagcgtcacgggggaggcgcaggcgctggtcaaggccgtggcggagctcgtcggtgcgttcaacgtcgaggattacatcgccgtgtgccgcggctgggacctccagggcctcggccgccgggccgccgacgtccaccgccgcttcgacgcgctgctcgagcagatgattcggcacaaggaggatgcccgggaggccaggaagatgcgtggtggagcagaaggagagacgccggagaagaagacagccacgggaacgacgacggagagcagcaaggacttgctcgacatcctgctggacaagttggaggacgacgcggcggcggaggtgaagctcaccaggaagaaaatcaaagccttcgtcatcgacgtggtgacc

SEQ ID NO: 65769 - DNA, 257 bp, Triticum aestivum
  Clone ID: PAT_TA_65769
agcgggcctgaggctgccgtattcgaccgacgagaaaccgtcggaaggctgcgggtcggtcctcgagccgtcggtgttcagagtcatatgggggaaggcttcttcaaatacggcggggacatccctagccccaaactactccccctacaccccgattgaagcagacatgtttgcccgcgcaaggaaggtgtgccacattgcgctcccgtcgctgaatccccatgactccttcccttcgcttctcattgggagcgttc

SEQ ID NO: 65770 - DNA, 538 bp, Triticum aestivum
  unsure (1)..(538): unsure at all n locations
  Clone ID: PAT_TA_65770
gaggcgcgtctggaatctcccgctataagtaccgaggccacccacccccgcccacgcgcgcgcggctccctcaaccagacgagacgagacgagacgcgaggcccctcctcgattgatccgcgtcgacccccgctcgatcgtcatacgtcaggcattaatcactcggagtttcatacgacaagatcaccgcggagatgtcgggctatgacgacaatgaaaccaacctagtggaggacgagtatgacgaccttgatgatttcatcgtcggaagcgacgatgagggcgacaatgtggcccaggaggacgaggaggagctgccggaggctgaggaggtagaagtggaagaagagtatgaggaggaagaggaagaagagccgncggctggcacgcaggaaatcctttccttcagggagcaattaaaggccaaattaaggaaacaacatcagtctaacggcgctgactacgggaaccctagctgttcgtcgtctgatcaaccgccggtcaggtccagatttggcaacttctttggcccgtccac

SEQ ID NO: 65771 - DNA, 264 bp, Triticum aestivum
  Clone ID: PAT_TA_65771
tccccaccgctcgagcttgatttcccctccctttctcttcgatccacggttgccgcggtgctttgtggtccaggaaagggaaaaggagcgtgggcgacaggttcaagagggttttgtgatatttgcatggttttgttttggttaagggagaactgggtcagatttttagctgcccgatctgtttttttagaaatgcgaacataaaatcgctgatggtattgggatatacaggtgtcaacacttatttatgatctgcccattact

SEQ ID NO: 65772 - DNA, 360 bp, Triticum aestivum
  Clone ID: PAT_TA_65772
tgctccttgtctgcgccgtttccctccagctgcagcagacagggaggcagaagagaggacatgctgaagaatgaaggtggacaaacgtgcacatgaacagcaaggcatgtttggcgtcttacttgaccgtgctgcagaacaacatcttgtggttctacccaagggttgacgccgagcaccggggcgtactgcaggagtagcgccctgcgtcctttgtcaacgtccatagcatcaaggacctcctcacgcccctgtgcagatggcactcgctcgtgatcacaggaaaccggacgacgcatgtgcccgttgtctgtcagcgccgacaaggttggttctatgttaaggccctgcgtcctcacg

SEQ ID NO: 65773 - DNA, 300 bp, Triticum aestivum
  Clone ID: PAT_TA_65773
cgcacaggcacagccaccgcagcgcaggcgagcgagacgcgcatgcccaaccctagcgaagcgagttgcgagcacatccctgcatcgccacgcctccgggctctggccccgctccgccgccagacgcctgacctactcgcctagtcgtcgtctgatctccgccgcatccggcaccgcccgccgcccaccggccctcgcgtccagggctccaggcgttctccatccccggctccccgcacagcctaaaaaaactgcaggatggagtcagcatccaaggagatggcactgaggtgcaccacg

SEQ ID NO: 65774 - DNA, 334 bp, Triticum aestivum
  Clone ID: PAT_TA_65774
aaaccaccacatccctttgctcttcctccccctccctctctcctggcaagaagaagctagcttgtagcttccctcacctgtgagagcggcattgctgcccgccctttcctccggccagccggtgtagttcttggttcttggcttggccggaatggcggctggattgctgctgccgcaggcggcgaggctctgcttctgcttctgcgtctgggccgtcgccgccctctcgctcgccggctcctcggccgccgcgaacggcacgagcgccggtgcagcaggcgcggccggcgaggcggtggtggtggacgcgcgggccgccgtggcggagacggac

SEQ ID NO: 65775 - DNA, 278 bp, Triticum aestivum
  Clone ID: PAT_TA_65775
tgcggtctatctctctttctggcaggatttgttgtttgtactcttgatccctgtgctggtcttctgcgtgttatcagttgcaggatatatttaggaagtctgggccgcaggatatttttggatatgttggttctccagaaattggaattatatggcttagcggagagacacatcttgctctgctttgcgtttggataattatcactccctctgttttgctctttcgtctccactgttctgttttggtttcccacacttctaatttgaactatttgttg

SEQ ID NO: 65776 - DNA, 368 bp, Triticum aestivum
  unsure (1)..(368): unsure at all n locations
  Clone ID: PAT_TA_65776
gctccggtccccaagccgcctccaggctcgcttcctcctccatcctcccgcatctcacccatctcgacggatacgaggcgtgcgggcacggaggcgaggttctccggcggcggcaggaacctccaggcagagagcgaccccatggacccgtccctgcaggagagaaggaaggagaggagacaggccatggagatgggatgagaacgtccatggccagccaatcgagccccacctccggtgcgcgaccccaggaaggattttgcgctgccgtcttctttcgccggtccgtgccctggaagagcgacaccagccangcattgtatgggaatgaagcaaaaagtctgccttccattggcgtgtgagtactt

SEQ ID NO: 65777 - DNA, 384 bp, Triticum aestivum
  unsure (1)..(384): unsure at all n locations
  Clone ID: PAT_TA_65777
agccggcagccggccccgtcccctggcgtccaagcggatcctcaagagctcaaggacctgcagagggatccccccacctcctgcagcgccggccctgtggcggaagatatgttccactggcaggcgacaatcatgggtccatcggaaagcccatatgctggtggtgtatttttggttactattcacttccccccanactacccattcaagccacccaagggtgcatttaaaacaaagggtttccacccaaatatcaacagcaatgggagcatctggcttgatatcttgaaggaacaatggagccctgccttgacagtttcaaaagggctcctttcaatctggtctcttcttaccgacccaaacccttaccaacccttgggtccc

SEQ ID NO: 65778 - DNA, 559 bp, Triticum aestivum
  Clone ID: PAT_TA_65778
ttggcgaggatccctcttgcctccccttggatagggtatttctccctctagatctggcgtgtaggccatcagagagacgatagcagggattgctgccatggccaagtttgttttctacagtcctaaacttccaacgagagtctctttcttccgtgctgcaaatggaggctactagcgacaggaccgccatgggtaggcctgggaattacaggcgtggaggatttctgggcaagccactcgttcctgggcgtgcctgtgccactgccgatgtggatttagccttgctgaaattactgagctctatcccccaggttgttaccaaattttctattagattgtttattttcattctgatccgtgtcagatttttgtacttgcattattttgtgccaggtaattagagcagcatgaccaaccattgccaaattccttcctaagtggagaagttcccaatccctaagatcaaggaatgaagataagcttttccactttgttgtatcaagtaatttaacttcccagttcactctaaattattgtgtattggcaacctgaattatct

SEQ ID NO: 65779 - DNA, 452 bp, Triticum aestivum
  Clone ID: PAT_TA_65779
ggccaatcaagtcagggagctggcatacgagatggagacttgttgaaagcttcctggtgggcgtccagggctttgagcctgccgctaacccagacgcttctaaggttcgtgaagaaggtgtggggggtgttcacgaaaggcaagaagcgccaccagatcgccgatgcgatcaagagcatcaacgaccaggtccaggatgtggcggaccgacgtgaccgctataagattgatgatcttgctgcaagtttggctgctgcaaccatcgttgaccctcggttgatggctcagttcaaagatcagagagagcttgttggcatcgaggagccaagagacgacctaatcaagaggttggcagatggagatgattgtgtgtccaagcagcagctcaagatcctctcgatcttcggatttggaggacttggcaagacaactcttgccaaagcagtttatga

SEQ ID NO: 65780 - DNA, 577 bp, Triticum aestivum
  Clone ID: PAT_TA_65780
cgtccctcctctcttctgtgaaaaatctcctctctcccctcttctctgtgccgccgccgccgccgcctccgcttcccccctccctctcggccgccttgtctcctccgcgtccaccgtctgcttctccccttgtctcggcacccgagtagcacggccacatcacgcctgcgccctcgctttgccacatcctctgcgtcgtcgtgccatcacaccgcctccacttcgcctttggttccccgccgcagcctcctgcccgtgcgcttgagaggggcatcgccgtcgttgccggtggcgacttcatcggccgcctcctctctccttgccaatcgtgactgccacgacctcggacctcgctgcagacccctcggctatcagggaaggcagccatcagtggagattgagccggctacatgggtggaagaggtatgaaattctcaacttaggagggagcatacacaaggtattccacgcttcccattctcctcatgtagcaaaggaacatccaacctgtcatgtgtcgatcactaagtaataaacaggactctgatgttggaaagagcaactggatatcaaagca

SEQ ID NO: 65781 - DNA, 518 bp, Triticum aestivum
  Clone ID: PAT_TA_65781
gggcgagcgggcgagccacgcaggcgccgcgacctctcgcctgatcgcctctagggttcggcgctctgcggcgccgccgccgccgccgccgcggaggaggcaggggccggccgtgcaggacagcgggggcgagctcgccagtcctcatcagctttcaagacctgaagccgcgcgtgaaggttatcttcaaagcatccatgatggtgggtttcacagctggagagctccgagaaatgatggacaagcagaataacattcgtaatgtgtctgttattgctcatatgaaccacggcaagtctacccttacaaaatctcttgtggcagctgctgggattattagacatgaagctgatgttgaagttcccatgactgatactcacgcggatgtagcagagcctggtagatccgtcaggtctgctggaacctctcttttgtttgagatgaacaaggaattgctcaaggctcacaaaggtgaaagagatggggacaaatacctgatcaaccttattgattcacct

SEQ ID NO: 65782 - DNA, 369 bp, Triticum aestivum
  Clone ID: PAT_TA_65782
tttttttttttttttttttttttttgatcgaaatccattcttgaacaacttgaacgaacaaactatatgcgctgatgctgccaatcaatgattattatggacgaccttgactaaaagggtggtaaatcttttccaagaacaaagaatgtgatgattattcttcgacggtcttaactaaaccgtgtcaaacatgataggggggggaaatttggggaataaaaaagagacagaaaaagcatgagggggggggaaatcagatatgaccgcaaactgctttaatgtaatctgatgtcgacgacttgccaccaagatcagcggtcctgtacttgccgtccgcgatggtgcggaagatggcgttgtggatgccgt

SEQ ID NO: 65783 - DNA, 187 bp, Triticum aestivum
  Clone ID: PAT_TA_65783
ggcccaagggggcgccgagcggcgcggtggcgtgccccgccacgttcccggcgtcggcgcccaccttcgtcggctccccttccgccacgctggggcgccacctggcgcggcgcctggtgcagatcggtgtgagcgacgtgttcgccgtgccgggggagttcaacctgaccctcctcgaccacctcat

SEQ ID NO: 65784 - DNA, 354 bp, Triticum aestivum
  unsure (1)..(354): unsure at all n locations
  Clone ID: PAT_TA_65784
atgcaatgaagatcattgagggagaatttgagcgacctgtttcgcaggttttcagttacatttctgatgagcctgttgcatcagcttcctttggacaggtttatcangggcgtacatttgatggtgcgggggtggccataaaggttcancgaccgaaccttcttccttctgtggggagggacatctatatactacgccttgggctttcttttgtgaggaaagttgcaaagcgaagaagtaacatttccctctatgctgatgagttgggtagaggatttgttgatgagtcggactacaatattgaacctgatcatgctactaaattcctggacactcactccaactattcatttg

SEQ ID NO: 65785 - DNA, 449 bp, Triticum aestivum
  unsure (1)..(449): unsure at all n locations
  Clone ID: PAT_TA_65785
ccgatgcctcccattccgaccaagttcggaatggaggggaagcgacggatgaggagaccgccgctcgagcgttagcggcaatggcggcggcaggagatgagcctccaaaggcggccaagccatcggcgacaccgaggccctccgccgctgaacggagcgaagaagaagacggagttacctcccgcggccannangaggtgggggagaagttgtctccatcagccaaaaatactgtttctcggaagggaaacgaagaggaatcgacgaaggctccgggtccaaatcccctgcccaagaggaggaaaagggcgtcgggcagcaccagtaggtcgcagcagccaaaggtaccggcgcctgcacagcaacgggagagtgagcagcttatggtttctttttttttcgaaaagggggactgacaagcccaaatcaaagaagatcaagcgagcacc

SEQ ID NO: 65786 - DNA, 495 bp, Triticum aestivum
  Clone ID: PAT_TA_65786
acggcgagagcggcgacgacatgtcggagcagtacgtggcggtcaccaagcaggagaagaggcggcgccggaggaggatggcgtgcaaccggtgtgggaagcggaaatgggagagcaaggaggcctgcatcgtctgcgacgcgaggtactgcggctactgcgtgctgaggatgatggggtcgatgcccgaagggcgcaagtgcgtcagttgcattggggggccgatcgacgagtcgaagaggtccaagctcgggaagagctccaggacactcgcgcgcttgctcagcccgttggaagtgaggcagattttgaaagccgagaaggagtgccaagcgaaccagcttcggccagagcagcttatcgtgaacggctgcccgttgaggccggaggagctgaccgacttgcttagctgctcgcggccacctcagaagctcaagcctggaagatactggtacgacaaggagtcgggcttatggggaaaggatggacaaaagc

SEQ ID NO: 65787 - DNA, 487 bp, Triticum aestivum
  Clone ID: PAT_TA_65787
acaaaacaatggaggaagtggcagagggctatttgtaccaacttgtaaatcgaagcctattgcaggtagtggagaggaatgaaagtggacgtgtgcggagttgccgaatgcatgatatcattcgccttcttgctctggctaaatcaaatgaggagaggttctgtatagttcatgatggcccaggaagttcttcagcagaaaatacacgccgcctatcaatccaaagcgccaatattgagcagttgactctttcaagtgaagttcagctccgttcaatctatgtttttgacaatggtctgacaattgattcactggagtctttgttgaaatcttttaagttgctatcaactttagatctacaaggttccaaaattaggaggctaccgaatgagattttcaacatgtttaatctgcggtttctgggtcttagagataccgaggttgaggatattccgagaacagttggaagactacagaaattggaagt

SEQ ID NO: 65788 - DNA, 517 bp, Triticum aestivum
  Clone ID: PAT_TA_65788
agctgtaggcaccgttattttctgggctccaagatgaaggtgcaaaacctgaatctgtgggtgagcgagcctacaagattctgtcaaatgtcgttgaaaattccaatgaaattatgaaagcacatggtgctgagcgccttggtgatgtccaagtctaccctgagacctcctctgttgcctttgcttcttgtttacatggttgggcatttaccggtggggggctttgctaagaagtatgccttaaaatgtggagtcgatgaggggggtgtgcaaagaggctttggggtgataatttttatgactctgccaaaaaaaaatggaccaggaagaacagtggctccgacaattgtattagaggcttcgtacggttctgctataatccaatcgacacagttctcatggcctgcatgaatgacaataagggtgaattgtgggatctctgccagaagcttgaggtgagcttgagggatgatgagaaggacctaacacgcatggctcttgtgaagtgtgtcatgca

SEQ ID NO: 65789 - DNA, 485 bp, Triticum aestivum
  Clone ID: PAT_TA_65789
gatgtaccagctgaagcggttgatcagatgacagccaattttgtcctgccactgtcaaaggacatgcctggttcaaaggagcctttcgatgaggtgatttttgtggagctttccagggatgatgcccatttttcctagacgagatgaaacgtgtggggcggagagcctcaactcccagccatggcaatgtcagtaaccagatggggggaccatctccgttgtcaggctttgaaccaccaatgaactactcatatggacaaggtgtgcatgctcccggtgcgccggctggctactcaaatgctccatatcagacccagcccagctactcgaatgccccatatcatcaacagacatatgcaagctacccgaatccgagctatccaaacaccgcagatcagcatcaagttcatgcaagctacccaagcaccgcagaccagcatcaagttcacacaagctacacgagcaccgcgaaccaacatcaagcc

SEQ ID NO: 65790 - DNA, 329 bp, Triticum aestivum
  Clone ID: PAT_TA_65790
ccccgtggcgggctccgtccctcctccagccggccgcgcccgggagctcgcgtccatcgccaccgagctcgctcccctccgagccagcgcccgtggtccctcccgcatcgacgttcgccgccgccgcactagccgcggctgcacttgcttgccgcagatcggacccggccatcggagggcagaaggctcgttcccaggagggcctggatacctttgcttcgccgcctgctggacgcccttgcctgcccggcggccaacctcctgcactcgttgctcctggttggggggattggcgtggatgcttccatcgtgatgaggcggctgatgtt

SEQ ID NO: 65791 - DNA, 608 bp, Triticum aestivum
  Clone ID: PAT_TA_65791
caacacatgcacacacactggcatataacgtatttgctgtttatgcttcttcaactcacggtgatacaacctaggagctacatgtatcacctggctaagtagatttgggatttctacactacttggacaagcaatcgttggtgaactctgacaatctttgagatctataggcaacctaaagagggaactagcaagctggtgagggcaccattttatcttgattaattgtgctaatttaagtagttcttagctatcatctaacacaactattacaagattaataattgatatagtccatgttttacctttccattttcggcgaatggagtggattctgaaatcgcatatttcaatttgtttttggtcgatcagcttgagtaccaattctttttagtgtcccagttgttatttcatataggctaccttgctatgttgcaagggactatgagatacttcatataggaggtcaagcatgaaaaaggtacaattctcgacttgtcgataatcatgttaatcgagctgtcatgatattttccctgcttcaaaatgctccctgaggtgttagttaacagtcctctgaatattgatccttttttacagaatttgac

SEQ ID NO: 65792 - DNA, 501 bp, Triticum aestivum
  Clone ID: PAT_TA_65792
ctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccactgaggccctcctgaagcaggtcgacgtacttgatccgctccaagtgggtgccctgcctcgagttcagcaagggtggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaacta

SEQ ID NO: 65793 - DNA, 560 bp, Triticum aestivum
  Clone ID: PAT_TA_65793
caccaccaccatggcagcatcgccgccgcgccgccgcgcctggggcgccggcgatcccggacgagctattcgaagagttcctcctccgcctcccacccgacgaccccgcctgcctcctccgtgcctcccttgtctgcaaggcctggagccacaccgtctccagccccagattccgccgccgcctccatgagctccaccgggggggggccgtgctcggcgtcctccacaactgggaagacgatgccatgccccgattcatccacaccaccgcatcgtccttctcccttgccgctccggactctcgctcctggcgggccctcgactgccgccacggccgcgccctcttcctctccaagggccaggacgccgaggagctccttgtgtgggagccaatcacgggcgcccagcagcgcgtaccggtgcccgcggcgttccagggcgactacccgacggctgccgtgttctgcgcaatggacgggtgcgaccaccgcgactgcttcgggggccattttcgggtggtcttcgtcttctgtgtcgatgaagaagacactgagcaagat

SEQ ID NO: 65794 - DNA, 547 bp, Triticum aestivum
  Clone ID: PAT_TA_65794
tatggcaatggcggaggccggaggcgatgggtcaggatccaccactgcccgtggaggtgaggccgtgtcgcccggatccgccgtcaccgaagcagagcagccctgcgctgcgccgcggggatctgccacctccagacgagcagcatgaagtaggccgatggctcccgagcaggagacgcgccgccgcgagacgagaccgcacagccgggaaccttaccacccttagggtggcgaggccgacgccgccgcggctcctgccggcggcgaagtagaggtgctggcgggaggggggaggctgctggcggcggcgctacgttactcccaggtcacttgctctggagcgacacgggagtcggaggcaagcccgtacaacttaaacttgcacacacgtcatgatatcagaggataccagatgatcatgggtgtgctgcatacatgtgggatatgctgaagaaggagattcatgttcttgagtcattgtgcactcaagttcctggaggagtgcagcggcatatgatccacaaggagtctgtctcacagattcagt

SEQ ID NO: 65795 - DNA, 115 bp, Triticum aestivum
  Clone ID: PAT_TA_65795
ttagatccgcactcacgggttagatccgtaggcgatgtgtttgtgtccgcttggttctagcggttcggttgttttttcaaatcgttctaggcgctggcagttggatcgggtgcct

SEQ ID NO: 65796 - DNA, 122 bp, Triticum aestivum
  Clone ID: PAT_TA_65796
ctgcctggaggttgatcaccgcatcagggtgagcgacggcgacggcgagacgacggccggacaaggaggcgttgtcggcgtcttcttcgcgcgctgctggctgcggctccgctcggtgctcg

SEQ ID NO: 65797 - DNA, 488 bp, Triticum aestivum
  unsure (1)..(488): unsure at all n locations
  Clone ID: PAT_TA_65797
atttggtctggataaggacaacaaattgaagaatggaatggagttgaaacagtgaagaacagcatgttcactcacactactgacgtcttttctggcaagatcttccaggcaattgtatgagggggaagctttatcgaagcgctggaggaaagtttgtctggggggagaaatttatttgacaattgattgaaccttgaagtccttagttctgtatttttcttgctctaaatctagtatgcatgacagcttaaattctggtatatgttagcacctacagttncaatcaaacataccacaaaaactttagtctgggtctctgggtacagcagacgtttgaatgattaacatgataaaatactatacatttttgaggcgatgaatctatatatagatgaagttcttccgtgaagcttcctgcattatgttaatcaccagattgccaaaatgctatgttataaatacccaacattcacaatttcttgtttgct

SEQ ID NO: 65798 - DNA, 104 bp, Triticum aestivum
  Clone ID: PAT_TA_65798
ctccttacaatctggtcccacttgtcagaaagtgatgaaatgagccaaatcacctgatcagtgctatttgcaaaatgtttaccgaatccgcggtgatttttgca

SEQ ID NO: 65799 - DNA, 493 bp, Triticum aestivum
  Clone ID: PAT_TA_65799
tcacgtcaggctcggtggatcacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaagggaggaggccgcgcctcctgccgagccagaagcaccggccgtcgccgaggaggcaccggctgcacc

SEQ ID NO: 65800 - DNA, 497 bp, Triticum aestivum
  Clone ID: PAT_TA_65800
atgtaagtacatagtatgcatgtgttttaaggtgtattatgtccacaccaagtggaaacctatagtccgagtaggattgtagggggtctcgggaaatcaaatgtcttttcaaagtcattttcctactgagctatgagaaaagcaagtctttttaccatcatggccaaaaggagcaaatcaaaccgctgtagcttcacttctctctgtatactaatttatttcaccgagtatattcattttgtgcccacttgatagattcagagttcattctcttacattcaacacgtcaaatgtacagtttgcaccggatctctacactgcactccatttgtttctatacttctaaattttgagtttgattagttgatcatttgtttgagatgttacatgactatatccttaattaggaaatacatgctcgactatgtacacctaaattgcttgacagtgatcaaccccatgtttgaagtgagatgaatcaaaataaaatactatgg

SEQ ID NO: 65801 - DNA, 674 bp, Triticum aestivum
  Clone ID: PAT_TA_65801
cccacccacctacactgcactaaaccctcgtaaaacctccgaccccatcccaccaaacgaccgacttggggggattcccctggggagcagcgagccaatttcttcttcatcttttctcgatttggcttctactctcttggggaagaagatccacgcccacccctagttcctctttagtttttccaccaagaaatccccaggaggaggggagaggttccctctgatgagcagcagcaccgccgcttgtcgatgactgagcgctgccaccgatgctttcggggtgctcggtgtccagtctcgcggcgaggtttgccttcttcccgccggacccgcccacctacgccctccgcaaggacgaggccacgggccgcctcgtcgcctccggcgtcccgcgggacaacgccttggatgtgctgctcctcgacaccaccagggggaccaaggtcgtcgccttctacctcaggaacccctgcgcgcgcctcaccctgctctactcgcacggcaacgccgccgacctcgcccagctctacgatctctttgtgcagctcaaggtcaatctcaaggtcaatctgatgggatatgactactcggggtacggagcatctactggcaagccaagtgaagagaatacatatgcagatattgaagcagtttaccagtgcttagaaaccgag

SEQ ID NO: 65802 - DNA, 521 bp, Triticum aestivum
  unsure (1)..(521): unsure at all n locations
  Clone ID: PAT_TA_65802
tccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcanacgttaacattgtctcaaatgctagctgcaccactaactgccttgctcccct

SEQ ID NO: 65803 - DNA, 570 bp, Triticum aestivum
  Clone ID: PAT_TA_65803
ctcctcactttcagcagaatctgtagttacatttgttgaggttggccttgtccagtgtttaacgaaaacccttcaggttcttgatttggatcattctgattcagcaaagattgtaactggtattgtcaaggctcttgaagtggttactaaggagcacgttcatttagcagattttaatgctaaaggagagaactcatcaaagactgttttggagcagaacaatgtagattcatcatcaaataggttccaggttcttgacacaacttctcaaccaactgcaatggtaactgatcacagggaaactttcaatgctgttcatgcttcaagaagttcagattcagtggcagatgagatggatcatgaccgtgatatagatggaggttttgcccatgatggtgaagatgattttatgcatgagattgctgaagacagaacaggaaatgagtccacaatggatattcggtttgatataccacgtaatagagaggatgatatggctgaagatgaagatgacagtgatgaagatatgtcagccgatgatggtgaggaggttgatgaagatgatgatga

SEQ ID NO: 65804 - DNA, 450 bp, Triticum aestivum
  unsure (1)..(450): unsure at all n locations
  Clone ID: PAT_TA_65804
attaattttgggtgttgggttctgtttattgaaattttgaaaatagttggcctggtaaaacaccactgtttgccctgtgggtcaatatggacttaacaaacaaaagatgcatcactctccatttaatggcctaaaaatactggcatgtttggatgaaattttcatctatatgtataagccgtgggctattccaagaagagggtgactatgcatcagttgtacaatcatgtgtccatctgctgcttttttgaatcgtataaaatctacagctaccttacaaaactgttatgtttactatggagtaaaatctagagctagcttataatactgcttgaaaatagctttggctcttcacacctgngagtaatatgacagtttgcattcctatttttgttttctctgtatatatatacagttttcatattctatttgtttgctcctgaagcttat

SEQ ID NO: 65805 - DNA, 561 bp, Triticum aestivum
  Clone ID: PAT_TA_65805
gaacgttcaatgaatttcttgaagaaaatgtatggagtcttttgttgtgtgcttcaaccagggaggtaactacatttcttccgttgctgaaaaagctgaggtgaattctatgacagtgagggttgatgataggagcacaagtaattctgatgtaagtgtgacaaccttgtgtactattctatcctggtcttgcttttattgttgcacaacttctctgatcttccagtagatttgttcagtcggtgtggtcgttagtcttagtttagacatctttctattttgaatctgtgcttatattgtttgtcatctgaaaactacactcagtatacattatgtccaggaaataatcatcacgtactgacatcactctgtactccttccgttacataattcttgtcgtggttttagttcaacattgcataaccttctggttttcttgaggtactgctcagtaactttttttacctcatgcctacaaagatagaacaagagtcactggattaagaattcgaactttcagaagttcaaaaaacaaatctgcatagtctgtggatggggatg

SEQ ID NO: 65806 - DNA, 585 bp, Triticum aestivum
  Clone ID: PAT_TA_65806
gtggtgatttgaaaagcgcaaagacaccacaaaccttgtcggcaaaaaacggagggatcctggagacacaggaaataaaagcacacctgattcaaatggagagaacggctccgttgccccgatgactcaatcgggagcagaaaataaacccaaagacaaggatgagattggcttgctgcgtgagcaggtcgatgagctccaaaagcaacttgtcgaaaaagaggaggcattgaggtctgccgagagtactgtgagtgagatgaatgcggtgtattcgacagttgatgggttgaaacgccaagttgctgagaaagaagctttgatcaaatatgctaattctcagttacaaaatgcaaaggtgaattgcccgcctgcctgcaattacattgtgctatatatatttctttagtggaaattgtgctatattctgcttcagtgagccagagtttcctctcttgttctgaagcttatttgtcgttatcgttttaaattttgttctacaaatggcacactacttgctacgctttatatttttggtgttcaaatcacaatgatcctaacaaacacataaaatacattttttaa

SEQ ID NO: 65807 - DNA, 473 bp, Triticum aestivum
  Clone ID: PAT_TA_65807
ccaaaccctaacgaaatccgcaagccgccgccgtcccccgtccagcccggtgcccggatccgatggggttcgtggatccggcggcgccgctgctcgccacgtgcggcggcgacacggtgaagctcttcgacgtcacggtggagtccggcgacccctgcgtccttgcctactcccccgctcccggccaccccgtcaacgccgtcaagtggaaccacaccaatctaatcgtagcaagtgctggggatgataaaaagatctcattgtggcataaaaagggtcaaaatgtaggacagctaccaacatcaactgttgatcgtggggatgacattgaggaatccatatattccatcagttttagcaacaaaggttctcgatatctttgttctggtgggagtggccatattgttaggatatgggatttgcaacggaagagatgtatcaaatggctaagtggtcacactgacaccattact

SEQ ID NO: 65808 - DNA, 471 bp, Triticum aestivum
  Clone ID: PAT_TA_65808
cagccatcggagggtggtcacgatctgttgaaaggcgctgatgcgccgaacctgtcgttgggcgacgtccacggcaacatcgaattccccgccgcctccagcgccaccaagatccgccgcttgatgtgtgcatctcgtggccggcgtcgtcctgccgtcgccgccatcggggacacagcaggtggcgagcttcgactggtgaaggacgcaccgatgtgcagggatgcgtgtgccggtggacctggcaccggcggctgccagcaaggagagggcaatcatcttgtataggcccgaggctgagcacaatctcctactcggcccgttccggctgagtgtccctctccacgtcagcagtggcggagccaggaaaatgaaatgaggagggccgaaagctattaagctttgttagggaaggccaacacatcaaggtacaccattttaacagcagataattacttgctcacatgcata

SEQ ID NO: 65809 - DNA, 550 bp, Triticum aestivum
  Clone ID: PAT_TA_65809
acggcgtcgtcgactccctcgtcgccaggagccccgtcctggaggtcctcaacatcctgggatgcatcaatgggttgcgtctccgcctcctcagccagagcctacgctgcctgcagatcagctgctcgaaaatggagcacatcgccgtggtgaaggctccatgcctcgagcggctcatcatttttggatctggcgaaatcgctcgtggtttgtgcagcagactcaagatcggcgatgtccccaagctgcacgcttttggatacttggatccaggtcaggtcctacaggtccgagacaccatcatcatgcccgggatagcaagcacaagtaccatgatgagaagcgtcaagattttgagcttgaatgtgcgtttcggagttcgcaatgaggtcaagatggtgcccaactttctgagatgcttccccaacgctgagagactccatattttgagtgagaaatgtgataaacccactggcaaccacctgagcctcaagttctgggaagagtccggtcccattgagaatgtcctctcacgcatcaacgtgatgag

SEQ ID NO: 65810 - DNA, 619 bp, Triticum aestivum
  Clone ID: PAT_TA_65810
gtagatagttctccctggttagcttctcagcgatctgaacatgggcgaaggagatggctgccggagcggaggaacctgccatggctagatgtgtttgtggaagagatagaggctctgattaccatgtaaaatatggttgaaacgtatgcatctctgcagggacgcgtgcgtgtatatataggctcaaggccaacagaagattacatggttgagatacgggagttaggcttgatctccacgttacaataggcttgatctccacgttataatatacagctatacagagaatagaatcaagcctaactcaaccgctgattacaactaacacaaaacaaacgcacgcgctaatatccctacacacatatttcaacacacgtgctcaccgagttcgacgagtcgaagaggagctgccggaagaggctggccgagcacaaccgccgccggaggaagccggcgagcagcagcacgactgcgacgtccaaggactcggcgccgccttccaagaaacccaacccgggcgccatctccagctcctacgccgccgacaacaacaatttgagcgccaccaagtccaacatctcgtccaacacgagcgccatcagttgcctgcagcagcacg

SEQ ID NO: 65811 - DNA, 524 bp, Triticum aestivum
  unsure (1)..(524): unsure at all n locations
  Clone ID: PAT_TA_65811
ttgtccatcgtgctggtcggggtcggggatggcccatgggaggacatgcagaagttcgacgacaagctccccgcgcgcgccttcgacaacttccagtttgtgaacttcacgtccatcatgtcgaggaacgcgacgctgcagcagaaggagtcggcgttcgcgctggcggcgctcatggaggtgcccatccagtacaaggccaccatggagctcggcatcctaggccggtccacggggaaggccaagagggtcgtcccggccccgcctccgctgccggggtctgcgcagaggcagccgtcgtcgttcaggcgggaggctagcggcgcgaacgccgcggcggcggagccaagagaggatcaggtgtgcccaatctgcttgaccaatgccaaggatctagcatttggctgcggccacatgtgttgcagggagtgtggggagaacctcnacagatgcccgatttgccgagagacaatacgctccaagctgaggctgtacacgggatgattgattcaaaccaaaatttg

SEQ ID NO: 65812 - DNA, 298 bp, Triticum aestivum
  Clone ID: PAT_TA_65812
gtggggaaagtggggtgttgtaacggctagttcctcgggcgcggccttgaatggatccgcgctgagctggcacacggccttccgggctacgatctgaagagggcccatgggtctgttgaggttggactttgcgtgagccctggcgccagctatataataataataataataataataataataataataataataataataataataataataataataataataataataataggatactctctccttttatcttcgtctcattttaagatttcgaggcgcattaaatctttgcatg

SEQ ID NO: 65813 - DNA, 442 bp, Triticum aestivum
  Clone ID: PAT_TA_65813
ggagggagcgcgcggattccggttgctcgctgtttgatgcgctgcgggcgcggctgcagcttcctccgtccaggcgtccacccgatgccgctcctcgccaccccaccctatataatgccgcgcacgtcagcggccaccgcgggccccgccactgccacctcttccggtacctgctccctccgggtccgcctccgcgcaccagggagatccgccgccgccgcctcctcctcccggctccctcgcgccatggccgccaccggagccgatgccgccgccgctcccccgtccctgctcgtcttttcaggtggaacagcatttaatggcgtcgtagaagagttgaagaaagtgactacccgggttgcgcatgtcctaccagtttctgatgatggtggaagcacagctgagattgttcgtgttcttggtggacctgctgtgggtgaca

SEQ ID NO: 65814 - DNA, 470 bp, Triticum aestivum
  Clone ID: PAT_TA_65814
tgctaccatgggcaaaaaagtttattttaccttacaatttatggatctgtgttgggtgttggctcctacgctgcacactacttctcctcaatggttgcctctattctggaaaactttggcttgagtgaggagatgcacaaccctgtgtcaatctttctgctggtagcagttgtcttgactggagctggttttggctattggatggtgaggagatttatcatttcaaaagatggcagtgttgatgccgggatagcacagtttgtgaagtgggctatgcgtgttgtttcaatgttctttgttatgcagagcacactggaccctattctagcatcggctgctctagctgctagctggtggatttgctctgtactgacagcaaagaaagttcacaagccaacagcaccgaagcgaaaacaatcaaatgttcccttctcatccaaggtttactcaagtatcacccaacactcgcc

SEQ ID NO: 65815 - DNA, 578 bp, Triticum aestivum
  unsure (1)..(578): unsure at all n locations
  Clone ID: PAT_TA_65815
cctcgcccgcgcctccgccgcctgcgttacctttcgccgcgtcgtcaccgacggctcgttcctccgccgattccgccgcctccacccaccaccagtcctcggctttctctgcctcggcgggttccaccccgctcagccgcctcacacctccgcgcccgccgcccgcgcgctcgccctggccgctgacttctccttttcgttcttgccttcgcgccgccgatgggccgtccaggacatccgcgacggccgcgtcctcctcgtcggcaagcaaaacatgatggctgaagggccctcgatctcgatgttcccggagctcgtggtgtgcgaccccttgcaccggcggtacatcctgcttcccccactgcccgatggcctagtggcatcggtggagaggcaagatgacgaatttttagggtggtcttgcgagcccagcctcattccactcancgatgaggaggctgccctggtggaagagacgacgctcanagtgatctggtcggcttcttgcaaaaccaatatggccgtgtttgtcttctcttcgaccactgggcaatggcgagctactgcatcccagacct

SEQ ID NO: 65816 - DNA, 658 bp, Triticum aestivum
  Clone ID: PAT_TA_65816
atctgttgccctcgcccttcgcaatggcctcctcctcctctgtctcccgtccgcggaagcgtcccgccgccgtcgccttttcttcctcgcctccgccgccgtcgccttttcttcctcgcctccgccgccgcctcaggggctaaggactctgaaattgacaccaaagaagaattttcccctgatctggcggacctgtgatgttcttcagctttatctaaagtcttttggcaggacagctcgtttgacgagtccagagggacgtcagcgagactactttgaggcagagttcttttttaaagaagaagctgaagatgcattgcagaactgcaaaatcccaaacatgaccattgaatgggctgaagcaaacatatcagacaatccacttacaggaccagcacaaatttcgtatgacccaccaaggtgtgactacgatgattttaacattctggtaaacagctcgagcacaacttttaaataattcgcttattggtctgaagcaaacatatcagacaatccacttacaggtaatgataagtataagtaaatcttgagcctgcttattggtttcacgagaaataattcgcttctgtcaatacaggaccagcacaaatttcgtatgacccaccaaggtgtgactacgatgattttaacattctgc

SEQ ID NO: 65817 - DNA, 308 bp, Triticum aestivum
  Clone ID: PAT_TA_65817
ccgccgagtggagcgcaagtgaggctggtcatggagtccgaggagggcaggcagctcatggcgcgcgcggcgcagcaccaggagggcgcggccgcggcctggagcgacggcgggtcgtcgcgcgcggcgctggctttgttcttgtcggacgtggaccgccggtggcaggctcgggctcgcggcggggaagctgcgtgaacttggcctacgacacgtgatttttttttttcaagttggaatgcgtggtcagcaatgtcaccagacatgtttgacagcggccatttccgaaataaaagaaagggtgtgtc

SEQ ID NO: 65818 - DNA, 482 bp, Triticum aestivum
  unsure (1)..(482): unsure at all n locations
  Clone ID: PAT_TA_65818
cgcctccctcccttcctcccacgcagccgcctccctccctcactcgctcctcatccggcgatcgcttccactcctcccacagccgcctccctccctcactcgctcctcatccggtgacggcagcagcggtcacagaggagggcggcggatcaatggcgtcggcgatggcgtccgtggcggcggtggacggcgcggccgcggcgctccgttcggtgatgtcacgcgcgcggcaggtggcggcgcggtcggggcgggcgccagagcaatttgggcttctatcctgatttaatcctttgcctcctcttgctcgtacgccaacatgtgagaactangagaaaggggtggaggccatggaggtcacggggcaaggaagaagaggaggccatggaggtcgtgggggagatccggagaggaacaggaggccacgatggaggaccacgatgtcgcccccatcttcccactccttgaagaatagcaccccc

SEQ ID NO: 65819 - DNA, 575 bp, Triticum aestivum
  Clone ID: PAT_TA_65819
ccatcaactctgctggcatttcctcctattatcctttctgatgtcaaaaaggatatcaagccaaggattcatgcatgggagaaggtatgctaaaagtacatgattcaaaactgaacccttatgtttgtgaacgattctggaacttgcaatattatttttttctctagacaacaagtgtagtagtgtaatattatcctttttccctaggctggcatagaacaagagtatattggtcggatgttgttgaagtatccatggattctttcagcaattgtgatagaaaactacaagcagacccttttgttcttcaacagaaaaaaagtaactggaggaaaaaaaatcctactatgccaacatggcttaagatatctgttttatgctgtatttgtttgtagtctatcataattggatatgatagtgttcgtaaatccggtttttgatttcagatttccagacatttcttggtatcgctgtcaaaagttggcctcacattctgggttgttcaacaacaagaatgaactcaattctggtgctgtttgatgatctgtgctttccatataaactccatttgtagt

SEQ ID NO: 65820 - DNA, 326 bp, Triticum aestivum
  Clone ID: PAT_TA_65820
tgggtgtcggatgcaggtgccgtggcggttagcttgattccgattctgctgtaatcccgacgggattttcagctacgtttgtgtttgtgcggttcaatggcgggatctgtgggcacaggcagggtagcacctcggtcgtccccaaagcggtacaacggcatggatccgccgttatctttgaccaggccgaccatgttcgatctgcagaagacggctgagctcgagaagttcttggttgaagcgggcctttacgagagcgaggagcagtccgcgaaacgggaggaggtgctacgggagattgatgggatagttaaggaatgggtgaa

SEQ ID NO: 65821 - DNA, 262 bp, Triticum aestivum
  Clone ID: PAT_TA_65821
tgcattgcggcggatgggaggacgaggaggaccactacgcgtcgacgaccacgtcggagaccagatcggaggaaggcgaggtggggaatagatccgagtgcgggttcgcggccagatcggagtacggcgggacggcgccgtccgagtacgccgccgtgccaatgcagctgcggagggccgagaggtcagaggtcggggactccttctccacggtcacgggggcgaccgagatgcggatggtggtgcgccaccgcacgctctc

SEQ ID NO: 65822 - DNA, 514 bp, Triticum aestivum
  Clone ID: PAT_TA_65822
cgatctcttgcagtggccgtgctgcggccgtggtactctcctactctaagacgagctccttagccgaaaggtgccccagccagccagatgcaggtagtggagggtcgttggcaacttccccaccgcagcaccagggatcaaggccaccgatacgctcgcaggagcgggccgtgtgtcaaacttctctagttttagagtttttttttagcatcagtacagacacaagcgcctatcatcttgagatttacgaggccatagtaggcgcctcgtcgtcgacatgaacgtctccttccattgaaaacgcatcgccaaaaatcctgaaataaatccaggaataaagcgagcaccgggatttgaaccctggtggcttggaaatatcactgtccacctaaccatctcaaccacaggttagttcacctctagttatagagttgacggacgaaatccacgcttatcaatttgtcgagggaccaaaaatagacttttctcattagtaaaagctcaaccttctctc

SEQ ID NO: 65823 - DNA, 596 bp, Triticum aestivum
  Clone ID: PAT_TA_65823
ttttccgtcctgataaccaagagggattgaggcacgtaatgaggtggctactttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtacgcctgaaaattcagcaaagccctgattatgctgaccagttagaaaccgacaatccctcaaaactcgccctgtacttacaaatataatatgcataagcttatttctgtgtaaaattttgtaggccggattatgaagctggattgcaggacttccttgaacgtttgacaaattatgaaaaggtctacgagccagtgcaggaaggctcatatatcaaaatgattgatatggtaaaaggggagggtggccagttacaggtgaacaatatcagtggctatctccctgggcgtattgtctttttcttggtgaattctcatcttgcgcctcggcctattttgcttaccaggcatggtgagagtttacacaatg

SEQ ID NO: 65824 - DNA, 586 bp, Triticum aestivum
  Clone ID: PAT_TA_65824
ctcgtgccgtgctagccgccgccgcctcccctccttccacctcctcctcctcccctctctcgccagtgccgcctggccgctgctgccttctccttggtgctcaaggggacgagcacgagaggtcgccacactgcactacctcgtccatggtgggtgctgaggacctacagatctctctctccctgctacctctttccccgacccctctgcctcccccaccatgagagatagggagagggatggacaaataggagacgggggcaagaggagaagaggaaggtgacggggcaggaggagaagaggaaggagagggtctgtgcgcgcgtggccattggctggccgggctcagctcttgcagattcttttgtgtatatgcctacaaggtgtttggtgaaaatccaagcagccccttgatttcgtttcttacagatatttctatgggtttctccattagtatgcttctcctcaactaccatatcaatctggcagccattggcacatgtgacctaggttgaggaatttgttccacatctccttgtaccaagagcggatctgcgccccacctctccagtgttggctcactggc

SEQ ID NO: 65825 - DNA, 534 bp, Triticum aestivum
  unsure (1)..(534): unsure at all n locations
  Clone ID: PAT_TA_65825
cctctccctcctcctgaccacccacccacccaccagccaccaagcggccgatctcccctcaccgccaccgctaccgccgacgccgcagctccggcagccgttcgtctcgaggaactaaaaacagctgcatggcgggggtccaggaacggcaatacgaagagttctttggtgggttttacttcgatgaagatgcgttaagcaaggatatatcactggatgggctggacaaggaacttgaggagcacaagaactatgatgtgctaataagtattctaaccaacggtgaaaaacagcgtgacatggcaaccatggtggaaggcaacctangccatattgaacaggatctgattcaagattatataaaagataatgacagcctagttctgttgcatgatcagattcatgactgtgacattgttttatctcaaataggatcacttcttagtggatttcaggttcacattggttctttaagctcggaacttataagtctccacgagaaatccttggacttgggtgtgaggctgaacaacc

SEQ ID NO: 65826 - DNA, 491 bp, Triticum aestivum
  Clone ID: PAT_TA_65826
ccgtcccctgttttacctttacatggctcgcagcataaatctcactaaacatagttattacagtaaactcaaatgcataagctgaaagttccatgtcctccagggtgaaaaataaaacaatccgtgtgtgtcaaaaaattctgagaaatgtcctttctacacttgtaaattatcatggaaagaacatttttgcgtcctgtgcaaaaaaaaaaagtctgttgtaaaaaatggcttctggatcaccaaatttattgaaagttgtaagcatacaaaggactcataacatttgcaggtataattttttacgtattctatgacaatctgaacttttcgtactatctcctttcatgggagctaaaatgctgctcctgactcagatatgtttctttcactcttttgcttcaagcgaagaagcatgtggaacaataaatcagggataagtgtctctgactattaatattctttgtagggaaaggttcatcgctgaatct

SEQ ID NO: 65827 - DNA, 405 bp, Triticum aestivum
  Clone ID: PAT_TA_65827
tcgctctcgcctccttgcgcagccatcgtcgagaggagcaagagaatggcggcgagcaacggcctcgagggtgtgctcctggggatgggcaacccccttctcgacatctccgccgtcgtcgacgaggccttcctcgctaagtatgatgtcaagctgaacaatgccattctcgccgaggacaagcacttgcccatgtatgatgagttgtccagcaagggcaatgttgaatatattgctggaggagccacgcagaactctatcagggttgcccaatggatgcttcaaactcctggtgcaacaagttacatgggttgcattggaaaggacaagtatggtgaggagatgaagattgccactgaagctgcaggagtcactgctcactactattacgatgaggctgctgct

SEQ ID NO: 65828 - DNA, 405 bp, Triticum aestivum
  Clone ID: PAT_TA_65828
tgtgcacactgtatattctgtagtctgcacacatctcagaaactttcgggtgcctgtttactactcctcctgtaaagaaatataagagcgtttatctaaaagcttccttccatgtacttttggcatagcttagattttcgttgtcacctctcattgggaattaggggatgtccgacaggtcaaagcatttctgtactgatctgtgttttggagattatgaattttctaaaattcgtttacttaagaatccaatcttccagtgtttactgaatataatgtgatgtcatttgcatacttttggtagttttagtaagattgatcacatagatggttctacatggatagagatatccacttagtgcacattgtgctaatagttttgtcttataggacactacttatggt

SEQ ID NO: 65829 - DNA, 221 bp, Triticum aestivum
  Clone ID: PAT_TA_65829
ggcgcacagcccgacgacccgagcgatcctgcggaggcggcagccatggtgcacgtcaacttctaccgcaactatggaaagaccttcaagaagccaaggcgtccgtatgagaaggagcgtcttgacgctgagctgaagctggttggggagtacggtctgcgggccaagcgtgatctctatcgtgtgcagtatgccctcagccgcatccgaaatgctgccag

SEQ ID NO: 65830 - DNA, 377 bp, Triticum aestivum
  Clone ID: PAT_TA_65830
ctcacccgttctgtgttttttgatgtttactactcctgagaataaaaaggaggagttgtggtatgaacttgctgcgtcaaatggttatttagaaggactgtgctaacaaccagtcgactggtcgttagcgacagatccgcacgacgttcgatcgatcctccggctgcgtcgttccttcgatcctcccgtttcccgattttctttcttctagattttctttccaccgatttttatctcacctcggttcacagattttttttttcactcggctggttctatatcaattattctagatggcggagaaaaagaaataaagtgctttgctcactgccaatctggagcccaggactcggggaatgccgacggttccactttta

SEQ ID NO: 65831 - DNA, 348 bp, Triticum aestivum
  Clone ID: PAT_TA_65831
gtaactgaattgggggagaatgaatggggtttctgaaggtctgatcatcggtaccacagttggtgtggtgataggggtgctgctggcagttggaatactcctgtgcatgaggtatcggcgttctcaggcgcaaataaggagcagtagctcgaggaggtcatcgactatccccatccgcgcgaatggtgttaatacatgtgcagagctgtcgaactcaactacagggcaggaatcgccgagagagtttgaagatcgtggaccatctctgtggattgaagggcctggaaggaagagcctaatatcagcttctgggatacccaaatatgcgtacaaggaactgcataaagc

SEQ ID NO: 65832 - DNA, 266 bp, Triticum aestivum
  Clone ID: PAT_TA_65832
cgccgcctccccgtcgcgagccctgacaccgccacccgcgcgcctcctcgccgtcgccgctgcgggagcaagcgtccaggacgcagtgatgtcagcggccgcgaccggggattacccgtgcccagtgtccccgccctacccggccgtctccaaggacgtggagctacggcgcgccttgacggcctccgcccgctccggtgcctactcctccgccggcgtcgtgttcgaggacgagtggctcgccgtggtggacaagcccgccggcg

SEQ ID NO: 65833 - DNA, 228 bp, Triticum aestivum
  Clone ID: PAT_TA_65833
tccgctcctgtcatctgtccttggtggtcgagaaggcgatcgatggcgtcatcgttggtgtggtcgaggcgcgcgctggtcgtgatggcggtggctgcgatggtgctggcggcgcagtcgtcggaggcggcggcgaggagcggcggggccgacgaagacgagcttcggttcccggggttcccgggcggcaggcagcgcaaccctggcttcccgggggtgcccgggggc

SEQ ID NO: 65834 - DNA, 394 bp, Triticum aestivum
  Clone ID: PAT_TA_65834
aaagaaaaatcgaaaaagacaaaaaaatgaatagaaaaacgaacttgctaacggcagcacgcgttcacatactgggtcgacccacccatgggcgaagccagttatgtttccgcccgatctaacggatttacgagtcttttagttacaaaagagaagaaacagtaaatgttgttgggagagatgaagggagcaactagttgaagagcgcaccttcggaagcttccaaatgatcacttggacttggcgcagtctcagccgccactggaagagctctgggcactcccttcagatattttcttttttatttttcgtatgcattttcagctttttagacggttttttctgtttttttgtcttttttgttttttcatcggtcttagcttttgaacgaaac

SEQ ID NO: 65835 - DNA, 481 bp, Triticum aestivum
  Clone ID: PAT_TA_65835
gatgccctgcggcgacaactgcggcgtcagcatcaactggcacgtcatgaacaactacaagtccggctggtcggtgcgcatgaccatcttcaactggcaggactacacgttcaagaactggttcgccgcagtcaaaatgggccagcactatggcggctacgagaacgtctactccttcaatggtaccaggctggacgcgcccttcaacaacaccatattcatgcaggccctgccggggcttgaattccttgagcccatcaccgacggcagaacgtcggcgtacccgaagctgcccgggaagcagcagtccgtcatctcgttcaagaagaaggacgtgccaaacatcaacatccccaaaggaggaggcttccccaagcgggtgtacttcgacggcgaggagtgcgcgctcccccacaagttaccgtcgagtgcacgccggcgggcaggggctcccagcctcttgcaggctgtcaccggggtg

SEQ ID NO: 65836 - DNA, 104 bp, Triticum aestivum
  Clone ID: PAT_TA_65836
aaaaatcgcacataatctaaaactaccagccatacaaagcaatatttggagcatattttggaatatctgatgtcatttctgtatcgtacagaaccgttgcaaga

SEQ ID NO: 65837 - DNA, 259 bp, Triticum aestivum
  Clone ID: PAT_TA_65837
ctgtggtcgtcctattctcgctcaccatcgcatggcggccccgctgatcggcgcgcagtccgtaatcccgccacacctatacccggcgccgttgcgggacttcaagcggtggtacgccgccgagttcgacgactacctcatggcccagccgccggccttcctccgcggcatcttctggctcgagatcgccttcctctggcccctctccgtcgccaccatctacggcgtcctcgcccgccgccgctgggccgccaccacc

SEQ ID NO: 65838 - DNA, 451 bp, Triticum aestivum
  Clone ID: PAT_TA_65838
tcatggtgtttggagactggatttattgcagcaacacttccttcctgctgatgttgtggccattcataaaatccgtacctcaccaccgcagcagcaggacttcctcgcatggcaatcagatcccaaaggctgttcagtgtccgtagtgcggacaagctagtgatggtacatcatgaggaagcttttacagaaggtgcgtcgagcgcaagtcctaatggtgagaggaaaatctggaatttaatttggcatgcggatgttccgcacaggatgaggttgaatgcctggaaggctgcagctggtgcgctagctaccatgcaatgcaaacgggcttgtcacctgcagtgccggcttacatgtcaactgtgtggcatagctgacgaggacacttaccatgcacttgttgcatgtgagaatgcttcaaagttgtgggatgctttgggggagatttggc

SEQ ID NO: 65839 - DNA, 369 bp, Triticum aestivum
  Clone ID: PAT_TA_65839
cccacccacatcaccgccgccgctgccgccggcctacgccatccccccacactgccgccctgaaaccccctcctcaccttctctccccggtcgagccgtagcaggtgaggcagaggcggcagccaaatccgccgtgttgcttccggattcgcgccctccccaccaccggttcatctccaatcccgccaccgacacccacccccacccccacatgcgacctcccctaaccccatcaccaccggtgacctccctcccttgctcctcaacccaacccaatcccgattcgattcagttcagagacgaatcccctcctacatcgccgctgcggccatgaaccccttctgcgatattgccgtggaggaagcgctg

SEQ ID NO: 65840 - DNA, 373 bp, Triticum aestivum
  Clone ID: PAT_TA_65840
actgctgccttctcatatcttggaacatctccacatcgtcagcatctttaatctctacttcgtggaatacccttcgacgccggtaacttgctctagaggttgtaatatggtggctcacattctagcaacatatgggataaatctaaaatctagcgatggcgtccacaaaaccctctgtcacagatctgatgctgctggtttgaaaggttgaaaggaaattatcatctactctagcgatggcatcctatggtgctaaactgaggctggtggactcaatgctgatctcgtttgcagtttatgccatgtgctctattagaatccctcccaagatcttggcatacctctcgacaaactacaccacctatgcctctgg

SEQ ID NO: 65841 - DNA, 230 bp, Triticum aestivum
  Clone ID: PAT_TA_65841
gcgtcttttcgcagcccgcttcacgctttcgccgacttctgcttcaaaacatacggcgaccgggtgaagaactggttcaccatcaacgagccgcggatgatggcctggcacggctacggcgacggcttcttcgcccccggcaggtgcaccggctgccggttcggcggcaactcggccacggagccctacatcgccggccaccacctcatcctcgcgcacgccgtcgctgt

SEQ ID NO: 65842 - DNA, 367 bp, Triticum aestivum
  unsure (1)..(367): unsure at all n locations
  Clone ID: PAT_TA_65842
ccaccaccccatcccatcgcccgcctccgcttccgaaggtcagagatggcggaccgagctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatcatgtcatcttctccaatgtttgccaatgcaccccctgagaagaaaggtgtcaagaactttgcgattgatttcctcatgggaggagtgtcanctgcagtttccaagactgctgcagctcccattgagcgtgttaagctgctta

SEQ ID NO: 65843 - DNA, 267 bp, Triticum aestivum
  Clone ID: PAT_TA_65843
ctgggtgaaaacctgctattggctactgccaaggctgacgatggcgacgctgaaggcatcgccgtgaagaagttcaaggccactctctgctacctccaggggaaaccctagatcagtagatcggatgacggcggctctctggtgtcgttttcccccatgggggcgtcatttttggaggtgcacacgggctcgagggactagaggacggcgactttggtggagcggtgcttcatctttcacattgatggtggcggatctcggcgacgt

SEQ ID NO: 65844 - DNA, 173 bp, Triticum aestivum
  Clone ID: PAT_TA_65844
cccgttcgccatggcctaccccccaagctccacctgtcgctgctcaaggtcctcccgtccaagtccctccgccatggcctgaccccaagctccacattgctgttgttgaaagtcctcccatccaagtcccgtccgccatggcctgcccccaagctccaccttgctactgctga

SEQ ID NO: 65845 - DNA, 668 bp, Triticum aestivum
  Clone ID: PAT_TA_65845
aacaccgtctcaacggcggcaacaacgggtacagaacaactgatgcggcctgaagtggacctcattcaaccttaattccaggtatagtaataactatcttgctgcttaattacctccgctactatatagccattagaactgatccacgtatactgtataggtaattagcttttgttgggtccagttgagtatctcctggtcttttgaacttcttttttcatgcacattattcgatggtgttttgaaaaggcatacggcagttgttgttttggagttttgaaactatttctcttgctattcttgcctcgtagaaggcaggcaatgcgcggcaagctatttcacctacttgttagatattgcatccttatttattctcaacacatgacaagttgtgttgtttctattcatatatactgtagtaggatatacacacggatattttgtaatgttgtagccaacaaagaggcacaaaagagcagatgcaagttgctgtcaactggcgctccatctggattcggaattcattttcatatgggatgcattttgtgcagtaaaaaaaccattggctaggaagaaataaaatcatgaatttccagccaatcaactaccaaatataggcccttgacagcagcattaattctgtctcatacttaaatttagttacggca

SEQ ID NO: 65846 - DNA, 501 bp, Triticum aestivum
  unsure (1)..(501): unsure at all n locations
  Clone ID: PAT_TA_65846
gggcgcatccactgcagcaggaatggacttcggtactgatgagcgccaacacagccatggcgacggcggcgacgcggcggagtggaagaaggtggtggagctgagggccgtcgccgaggcccaggaccccgcggccaaggaggaggacgatttcgtgctgcgccggttcctgcgtgcacgggattacaacattggtaaggcgtcgatgatgctcctccagtacctcgcctggaagcgcgtcgccaagccccatggctccatctctgacgaggaggtgcgcggcgagatcgcaaagaagagggtcgacatgcagggctttgattgtcttggtcgccccatggcgtatatctatggcgcacgccactttcccgcccggcgagacctcgacggattcaagcgctatgtagcctatgtcctcgacaaaatctgcacgatgttgccggtggggcangagaagtttgcggcggtgatagacttgaaagggtgggggtatgcaaactg

SEQ ID NO: 65847 - DNA, 154 bp, Triticum aestivum
  Clone ID: PAT_TA_65847
gacaagcgcggacagagccaagaaccatgggctccttcctgtcgtccttgtggacccctccgccgctccccggcgacgaccccgactccgccgtcgtcgccgtccactccaagcccgcctgggaccggcactgggaggcgcaccggaacgcgtc

SEQ ID NO: 65848 - DNA, 358 bp, Triticum aestivum
  unsure (1)..(358): unsure at all n locations
  Clone ID: PAT_TA_65848
tacggccacgacgagggcgagacgaaagcgtccgtggcggcggccgaggagagggcgccaaggagtggtggaccttggtgaggttgtccgtgcacagctgcatgtcggtctgcttggagtggtggtggtacgagatcatggtgctcctctgcggcgtgctcgccgacccaaaggcggcggtggcggccatgggggtgctgatccanaccacatcgctcatatacatcttcccgcactccctcggctgcgcggtgtccacgcgcgtcggccacgagctcggcgcccgccggccagaacgtgcgcgcctcgtggcgcgcgtcgggctcggtctcggcgcggtgctaggcctcgtggcttg

SEQ ID NO: 65849 - DNA, 265 bp, Triticum aestivum
  Clone ID: PAT_TA_65849
cgcacccgtcaacccgcccccaccgccggccgccgcgggtgaggcggagatccatccgtccatctgagctcctactgactcgacgccggtaaccaaccccagccccgcgcgctcgatcgattcccttcttccccagcttcgaggatttgtttcgggggttcaatcaggttcagctgagacgctggaccccgcatgccgcacgtgaacgccaaggtgtcggcggtggcggcgacggggatgtccgccgtgcctgcggccgcggcgc

SEQ ID NO: 65850 - DNA, 437 bp, Triticum aestivum
  Clone ID: PAT_TA_65850
acaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaattcccccaacaacaattcccccaacaacaacagttcccccaacaacaacaattaacacaacaa

SEQ ID NO: 65851 - DNA, 504 bp, Triticum aestivum
  Clone ID: PAT_TA_65851
cggcggcgcgcagcgaatagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacacaggaagcaa

SEQ ID NO: 65852 - DNA, 489 bp, Triticum aestivum
  Clone ID: PAT_TA_65852
gtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactg

SEQ ID NO: 65853 - DNA, 147 bp, Triticum aestivum
  Clone ID: PAT_TA_65853
tttctttgccactgactgggttaaaaactgcccgtgtggaggtatcatcattccaccactgtgttcaagcttcagagcctactggtgataagcaatctctgctatttcaaccaccactaggaaatttcgttttgatgcactatcaag

SEQ ID NO: 65854 - DNA, 427 bp, Triticum aestivum
  Clone ID: PAT_TA_65854
tgcgtttttttgtgttgatataaagcttatttatgaataaatatggttggtactcatctgacgtacttgcatgtctatatgcagcggatatttcgtttcgtctgctcaaaactgtcccagcatgcctaccagcagactccatcagatcctctccctttctgtgcagcaaatctgacatgggcgtatcagctgccaactgccaactgtctactgtcaactcctttcaggcagttgcaatagtgaatcaaaaaccaaaacaggcccggtcgggatgcctcgacaggagaggaattaatgagacacgagctgctcacttaaatgatgagatccagacacctcatagcacaaagaaaaaacataaatcaatggacctgtcacatactggcgtgctgctctgatccatgcgcagacaggcccatggagactc

SEQ ID NO: 65855 - DNA, 283 bp, Triticum aestivum
  Clone ID: PAT_TA_65855
cacccctccgtcgtcgtttcgccgtggtcccctgccctaccgtcggccgctgcggcggcgggagggtgggggagctttgtttcgcgtgtgtgtacagggtacgctctgtttggatcttgtccagaggcttcttggagtgggcggcgcggtcggtcttccttttgcaggtggtgctcgtcccctccggcggtggagttcttctgagcgctactgcggagcgcctcctcgtccgcgctctcggtccccggtggccgatgcgtgcgtttatccccctctggatctc

SEQ ID NO: 65856 - DNA, 458 bp, Triticum aestivum
  Clone ID: PAT_TA_65856
gattgattctctggacccgcgacgagatcgagtctctggctcatctgtatgatggttcttgaggttgcagttcgccggcggcgaatttaaccggattctggcggcaaatctcttctccgaccctgcgtgctgttccttggatggtagtggagagaaagatgcagccatcgccgccgccggagcacaggagggtggtccgcttcgtgaccttcctggccctctccctcctggctttctcctgctgggctctcgtcaactcccggatcaacaacgccatcctgatagccgatgccgacaagacgccattgctcgccggcggtgatgatgacagagacagacacagtactggcggcgaccatcctgcgtcgatcccggtggctgtgccatccagtagtgacttgatggcgggcgccgtcaggatgggcggtccggttgttcgagagacgccgttggcagaa

SEQ ID NO: 65857 - DNA, 596 bp, Triticum aestivum
  Clone ID: PAT_TA_65857
catcgcgacaaatacggagttagtacacaagatgcagccttcaaaacagagctctgtgacttgtatggcagctttctttactcagtacttcctccaggagatgaagatctcaaaggtaatgaggttgaggtcattgcaaaatttaaaagaggccttggactcgatgatgtagatgctgcaaatatgcacatggagattggtagacgcttatacagagagaggttggaaacaagggaccgtgatgctgacattgaacagcggcgggcatttcaaaagttgatatatgtgtcaaatcttgtctttggagacgcatcagccttcctacttccatggaaacgtcttttcgggatcactgattctcagatcgacattgctatgcgggataatgccaaaaatttgtacgcgatacagctcaagtctattggtagaggtctggacataggcacactcattgaagtaaggagagcccaacttgcgtgtaaactttctgatgagattgctgctgacatgttcagggaacatgcgaagaagttgattcaagaaaacatttcatcagctttagacatcttgaagtcgcgtaacaaagccacgaatag

SEQ ID NO: 65858 - DNA, 554 bp, Triticum aestivum
  Clone ID: PAT_TA_65858
atgttctcaaatagcttgggtgtgtggttattctattagcaagaatatatttaccatcatcttaagttgatgattttacgtttgtttttaataactgattctaggctactgacctccagatgatttatttttttgctaacaacatgcaatcactagttaatgtgttgttctttttgggcatgtgcctaggattagttcttatcattgcctgttgccttatttgttctttagcagaatgacactagaccattaagtaggtgtgtgaacatgggtgtgttatatttatgtctactgagtgttgaacatgatgttgaacatgggtgtgttatatttatgtctactgagtagtactccctctgtatacttttaaaagacgttttagatcgctacttccggagcacatgccagtcaggaggctggagcaatgaagctaaaggaaactgtatatgctggttactactgtattaattttgtaattcttacttcaatcgacatggtttcttttcttgtagcttctttctggcgcaactttcctaggggcgatattttgtttc

SEQ ID NO: 65859 - DNA, 631 bp, Triticum aestivum
  Clone ID: PAT_TA_65859
gttgaaatgagtagtttcttggtttcacttagtgcttttatttatgaatttatgggacgggtttttatgctagggatcctataggagaaacatctgcgtgcgtagttctctgtgtagcccagagtggcatttcaatgagaaccttatggccgtagagaagtgttcccttctggtggaactgcctgggaagacgattggaatttaccccataaatttgtaattaaaactgctaagtgaatgtaactagctacatctgatacaacataatgataaatatggtgagtactgagtaggattttacaccactacgtacattcgtcggttgatttgttgccctcgccagcctagaatagatcctgtatcaaataaataatctagttagaacgtgaagataatcatattgaattaaatactattccaaatagtgttttaaatagtaaagcactttcgtgaatagtgccctacctagtgaatagtaaatactatttaagataaaaatagtaaatactatttaagataaaaagtacgtcatgtctaccactttcacctaatcacatattaacctaatcaaaatcttaattaatattgattagaatatattagtaaaattttatatcatatatatatgtat

SEQ ID NO: 65860 - DNA, 639 bp, Triticum aestivum
  Clone ID: PAT_TA_65860
taagtttccctccgatcgtcatcactctgcgctgtttttttccgataaagggtggattttattgactcgaaatgaagcatcaagtggatataaaaatcttggagaaaacaactcatggactttgcaagttagtatgcatgatgtcattcccagacgaatatctgctatttcgcgcagaaggaaagatttggaatggacccgatggggcgcaagtgagtcccgattgcccatttgtggtcaggcaggtggcggagctgaagaacaaatcgttcgaacaagtgcggcacgcggtactcaagaattttcagctcaacgaagccacacatgaactcactttgcagcacatcctgtatgtgaggaccgatccttccgctcctccatacaatctgctgattgacatagtaggcgaggaatcatggagggcgtttttcaaggtggcatgccgccatgtccgctccttcaagctcttcgccaaatggaccgtcaagaagacaagctctgcctccaatgcgactgacagcaatatcacaacagctctagacgaagatcccgccgtaacggatgaatccgatgatgggagctggccggcttgcaagcacgataagccatgcaccattgaaacttcgtgggaccgacaag

SEQ ID NO: 65861 - DNA, 587 bp, Triticum aestivum
  Clone ID: PAT_TA_65861
ccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtgccccgtgctgtcttcatagatctcgagcccactgtgattgatgacgtgaggactggcgctgaccgccagctcttccacccggatcagcttatcagtggcaacgaggatgcagccgacaacttcggccgtggtcattacaccattggcaaggagattgttgatctgtgccttgaccgtatcaagaagctgtcagacaactgcactggtctccatggattccttgtcttcaacgctgttggaggtggaactggctctggccttggttctcttctgctggagcgcctctctgttgactatggaaagaagtacaagcttgggttcacagtgtacccatcac

SEQ ID NO: 65862 - DNA, 503 bp, Triticum aestivum
  Clone ID: PAT_TA_65862
cttctcatccaacgacgacaacaaaacacgacggcggctgctctggccgccccccgcgcattccaactagcgacgccccctctgctcgcgcgcccctcggagatcccctacagttcaactccctggccgcgcagtacacggaggatcctctcgtccatagcgttgcctgtaggggtcatgtggacgacggcgcagaagcacaacgaggtggatgtggtgcagtaccttacagtagatgtccctcccgctcttcatccacaggaaagttgcgtgcaatatctgtttttgggcatatgattggcggcaactagacgacacaggggaggagagaggtatcggagtatcgacgactagcaagcaaagcaagacgaaaagccaagggggcagctccatccgtgcgccgcgaccacctaacagggtggtgctagatctgggaaacatcgtcacgagtgatcgaggaactggaccgcatcaccgggtctcactaaattctaaaatgatgt

SEQ ID NO: 65863 - DNA, 583 bp, Triticum aestivum
  Clone ID: PAT_TA_65863
tgccccgctcacacggaggccctcctcaagcaggtcgactacctgatccgctccagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggacgcataatattatacaatatgtcaactatatacgttttaatggtaaccaatgga

SEQ ID NO: 65864 - DNA, 518 bp, Triticum aestivum
  unsure (1)..(518): unsure at all n locations
  Clone ID: PAT_TA_65864
cacagtagcactagcttgagctagccaccttctgccactccgggcattttcttgcatccacgaaggcaatggccactgctgatgtccagaacccggcggtcgcgctgacggaggaggcgcccgcggtggagacacccctggtcgccgaggaggtcgcgaagacggaggaggcccccacgccggcggtggccgaagtcgaagcgcctgctgcccccgtcgaggttgaggagactaaggaggaggcgccggccgccgctgagacggaggagaccaaggagcccgagcccgcagctgcggccgagccggaggccgaggcgccagccgtggtcgagacagagaccaaggaggccgtggctgaggcagagccggcggtggtcgaggaggtgaaggaggaggcggcgcctgctgccgagccggaggttgcggccgtcngccgagaagcaccggctgctgcggaggaggcacccgcggccgcggcagaggagccggccgccgcggtggccagcgtcagcgtgtga

SEQ ID NO: 65865 - DNA, 185 bp, Triticum aestivum
  Clone ID: PAT_TA_65865
aaatggtcaagaaccacccgggcagcggcactagcaggtgcgacgctgcggcggctatggcagagagcggtggtgggggtgggacggcagcgctgtgcggcggcgggagtaggcagccggcgatggcggcgaggcagttcaagggggtgctgtttctgagctgggggtcgtgggtgtcggagatc

SEQ ID NO: 65866 - DNA, 434 bp, Triticum aestivum
  Clone ID: PAT_TA_65866
tccgcgccgcggggcacgggcccgcccctgccactcttgacgacgcgctcggctccgacgacgacggttcggaggacgaggcggaggtcgcggcccaggagaaggcgatgcggcgcgaggtcgtggatgacgacgaggactccgagtctggcgagtcggagggcgagggggtgccgttcgtcaccatcgctgccgccgccaagaggaagcgcgtcaggaagctctccgacgagttcgaccgcatcgccgccgcgcagctggagggcggcgggaagaagaagcccgcggccgcggctccggccaaggtcctgctgaggaagaaggcagtcgctgcggctgctcctgccccggccactgatgcgccggcgaagaagtcgttgaagaggaatgcggtggcgccggctgctggtgctgtggcgaggacgtctccgaat

SEQ ID NO: 65867 - DNA, 484 bp, Triticum aestivum
  Clone ID: PAT_TA_65867
ccatcccatcgcctccgtttccgaaggtcagagatggcggaccgtgctaaccacccgtctgtcatgcagaagtttggtggacagttccaccttgcctccagcttctctgagggtgttcgtgctcgcaacatctgcccttctgtgccatcctattataggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctctggctcactgtggagaggaaacactgctaacg

SEQ ID NO: 65868 - DNA, 480 bp, Triticum aestivum
  Clone ID: PAT_TA_65868
cccatcccatcgcctccgtttccgaaggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaacgctttggctcactgtggagaggaaacactgc

SEQ ID NO: 65869 - DNA, 217 bp, Triticum aestivum
  Clone ID: PAT_TA_65869
ggtggtggtggtggcaggcgactgtgactagcaggagcgcggaggaggggtccttcggttgccgccatggctcagatcttgctccatggaaacctccacgtcaccatcttcgagcctctcctctcccaccccgccgcccacggcggcgcccccaattcatccgcaagttgggagggattgagaaaccgttgggtggcaaagcactccaagctatatg

SEQ ID NO: 65870 - DNA, 347 bp, Triticum aestivum
  Clone ID: PAT_TA_65870
caaaacatctatcgaagatgatcctaagttcacagtgttgttgagaagttgctagatgtacttaacaccccatcagagcagttcagagagcggtgtcagatgtctgtccccacttatggtctcaaagcagaagagcccaatctcttgtatctagacttcttttcggatgatgaaatgtgaaaaggtggtgagcggcgtggtgcagcctttggtcttgctggggtggttaaaggatttagaattacttcattgaagaagtatggtattgctgcaacattacaacagggtttggaagacaaagcgtctgcaaaatcccgtgaaggagcattacttggatttgagtgcct

SEQ ID NO: 65871 - DNA, 202 bp, Triticum aestivum
  Clone ID: PAT_TA_65871
gcaagcactctaaccgggcgcgacacacgagcgagccagccagacggtcgtggcgcacaacccgcctgttgcaactggaccatcccggcccgtcgtgacgacgttgaacatcgtgcgacagggcaacgacagggcctttgggagagcgtccgccaccgcccaatgacgggtgcccctgggatgcctggcgatccgagccatc

SEQ ID NO: 65872 - DNA, 104 bp, Triticum aestivum
  Clone ID: PAT_TA_65872
ctggtggtctacgtgatcatgggaagtatgatgaatgctctttctgatggactctgtttggctgacaacagtgggttgagcccccagacgcttgttgatgtcct

SEQ ID NO: 65873 - DNA, 453 bp, Triticum aestivum
  Clone ID: PAT_TA_65873
tggcattataactcgttgcacactccgcagcacgaagcgcctccattccatcgaccgaggcatgaccatgatgaagtcgcccacgtccacctcctacctcatcctggctcccgtcgcgatcctgctcctcctcttcctgctctcctcactcaaccgcaccggcgccggcggcggctccgacggcctcggcgtcctctgcgcccgccgcgccgggacacgccaccccaccgccgccgtgtcggcgcgggccgaggcggcggagcccgagctgagcctgctggtcggcatcctgacgatgccgaagcggcgggagcggcgcgacatcgtgcggctggcgtacgcgctgcagccgccggcggcgggcgcgcgggtggacgtgcgcttcgtcttctgcaacgtgactgacccggtggaggcggcgctggtggcgctggagatcatgcaccacggcga

SEQ ID NO: 65874 - DNA, 176 bp, Triticum aestivum
  Clone ID: PAT_TA_65874
gtacgcctcggcagcctcctggagcgccggcacggcgtggctctggaaccggaggtccgtcttgaagtcctgcgcgatctcccgcaccaggcgctggaacggcagcttgcggatgagcagcttttttctcttctggtacttgcggatctcacgcagcgccaccgtgccgggcctgt

SEQ ID NO: 65875 - DNA, 225 bp, Triticum aestivum
  Clone ID: PAT_TA_65875
ctcgccgtaccagcgccggctgtgggtcaaggaccggtccagcgagtggtgggagctgcggagcagcccggggtacccggaggcggagttcttgcgggagttccggatgggccgcgccacgttcggcatggtctgcgacgcgctcggcgccgccgtcgccaaggaggacacggttctccgcgccgccatcccggtgcggcagcgcgtggccgtctgcgtctggcg

SEQ ID NO: 65876 - DNA, 234 bp, Triticum aestivum
  Clone ID: PAT_TA_65876
gctgctgcgctggaggacgaggcgttgatgcacattgtgacggtctaatggacctctgcaccggcccggacctgtcgactgggttcgcctccgccacggcgctcccgtaccggagccggatgtcgccgctgttgccgcactgctcgccgaggccctcgagatcttccaccgctgagactccgtcgactcaccatggacacgggagggcagccagcccagttgaatcccaccttc

SEQ ID NO: 65877 - DNA, 470 bp, Triticum aestivum
  Clone ID: PAT_TA_65877
aagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaatggtcgcttccgccttcactctgtcagggatgaggatgctaagttcaagctctgcaaggtcaggtctgtccagttcggccagaaaggcatcccctacctgaacacctatgatggccgcacca

SEQ ID NO: 65878 - DNA, 441 bp, Triticum aestivum
  Clone ID: PAT_TA_65878
gcttcctcttcttcaacttccaaatcgctggtcttctctcctctattaatccctcgacagcaatgggaggaggcaacgacgtcatgggtacccacccgggccagggggataccctcccaaggtacccgcccacaggaggttaccctccacagcaatgattccgcctgccctggacttacccacctgcacctggggcataccctcctgcactgggcataccctctgcccggacgggtggcagtgacggagaagggctccttcaactatgcacggttgccggctcatggtggggccatggctacccatctgtggccacgggtccccccgcagcagcatggatcctctacaagctccctctcacatgctcccaccgacagcatggctaccctccacagcagcatggctatcccctgctggctccctggctatctggtcacagtg

SEQ ID NO: 65879 - DNA, 463 bp, Triticum aestivum
  Clone ID: PAT_TA_65879
tccggcaagcaacaccttcgctctcctctcccctcggttccccgctgcaatgtcgactgacgtggtcgccgatgtcccggcccctgaggtggcggcggccgccgaccccgtcgtggagaccacggcagagcccgccgccggcgacgcgaagccggccaaggagaccaatgccaaggcggccaaggcctttttgccgtccgccccgaggaagccccgcgccgcccccgcccacccgacctacggggagatggcgcccgaggccatcaccgccctgaaggagcggacggggtcgagcccgtacgccatcgccaagttcgtcgaggacaagcacaaggcgcacctcccggccaacttccgtaagatcctgtcggtgcagctcaagaagctggtcgcctccggcaagctgaccaaggtcaaggcctcctacaagctgtctgccgccgcggccaagcccaagccggcg

SEQ ID NO: 65880 - DNA, 562 bp, Triticum aestivum
  Clone ID: PAT_TA_65880
catacaatcgctgtcctcgggccgccccctcgacatccagccgtcgtcctcgccaatccccgtccctgctgctgccggggccccatctcctggccccccctgccgccgcccctgctgttgccgcggctccatctctgggctctcgctgctgccgcacctgctgttgccggggctccatctctgggctcttgctgctgccggacctgctgcaacgggacctgctgctgctggggatccatccccttcgagccgcgcccctctcgaagccagccgtcgccatgcccgagtgtcatacaggtggatagttgttcaacaaaatgatatctgaacttcaagctggtaccataaaaaaaatatttgcttcggtgttctgaagtttctcgatgaagtgtaatatatttgaccattagcgacacccttcaccataaggcatagatgtaccaatgatgttatttcttgaagccaatttgaaattttgtatctcttgtgagtagcaagtaaactgctcaggttgatcttatttgtatatcttggaattgtttcctggttgatatattggaag

SEQ ID NO: 65881 - DNA, 339 bp, Triticum aestivum
  Clone ID: PAT_TA_65881
aggcgatgccagcccagccgcaagttgccaagctgtgaatctgactcatcaaaaacgcaagaaatccgcacttctgtgacatttaccgccccaagaccctgtcaagccaggaccccaatccccagatcaccccctgggagaacaagctcatcaatatcagatcctcagtccccttaccactgatctgcatgaaaaatcgagacacaacacactctcttcatcgtcactgaagccgcaagaaaagattagccgctgtcaaaaatgtacgacattcagccaaaagttacccctcatcagcctgatggcaaaaagcgtcgtgaactgacccagactacgatg

SEQ ID NO: 65882 - DNA, 555 bp, Triticum aestivum
  Clone ID: PAT_TA_65882
tgtggacacattcaataaggctggtgcaactggagcagcccagtcttataacaggccagctgctccgtctgtgacaccacctaccataggtgctaggttctttgtgcccacggcgactgctgtcgctgcagagcagatgcctagccaatcagtggagacacgtggtgaaaccttccaacgggatgagcgctcatcctcaccgccagcggaaacatcattttcatcacccccaccagcagcacaattttcatcaccaatgtcatctaccattcagcggtacccgagcatggacaacattgctacaccgaaccaggcaccctggatgtccccgggaagtaacagcagctcattcgcatcaagatcacgagcagcatcatggagtggaacatattctgaccaattcagttccacggcaggggctaggtcacctgacggaccgactgtgccctcgccacaaatgcctggcagacccccctcacacagtcgttccaacagcaactcgtccgtgcagtttaccggcttgacggaggatcttcacgaggttgagctatgaca

SEQ ID NO: 65883 - DNA, 284 bp, Triticum aestivum
  Clone ID: PAT_TA_65883
cctccgccgccgttgacactctccgcgaatctccttccgagtcgttccgtggataggaggcatggcaatgcggaggctgcttcagggggtcgttctgccgcgggcgacgggccggtgcgtcggggcgtcctccttctccacgtccacggaggccatccgcgcgaccctctttttctgcgatggcatcgggccggagatcgccgagtcggtgaagcatgtgatcaacgttgcaggcgtgccaattgaatgggaagagccttgtgtgggcacggaggttgatcccg

SEQ ID NO: 65884 - DNA, 335 bp, Triticum aestivum
  Clone ID: PAT_TA_65884
gtgcgtgtcaactagcgagcacccagagacagggccggctgcgtctactacaccgagaacgatgtggggccgtgcaatgacgcgtatgatcagagtggcgtcggggtgttcaacctcaaggatggcagggcggagaaggtccagggtctctggcagcaccggaactggccaccgccggcatggttcattccttccttccaatgataaaaagatatgatgattgatttggtaggttggctacagattacagaagtgcagatgcggtgaaacggattgagaattaaggaaacagtttggtttgcaccttttctcttttttcgcctttcaaatcgccg

SEQ ID NO: 65885 - DNA, 474 bp, Triticum aestivum
  Clone ID: PAT_TA_65885
agggtagatgccagaaaaagcgtgcatgctgctaaagcacgcagggagcggattcttcggactctcgcaaagcagagtacagcgcagctaaaagaacaagaacagaaaggacccttagctttcgtccaaaaccttttttttcactccatggtcaatctcatcttggccaaaagtacatggtagctgcagctagcggcagcaggagagtactaccctgtatatatgtggcagcaccgttggatatccatccttcctcgaagagaaggcacgaacaagaattacgttgcttttcttgttcttcgttcagtaggtgcgaccggtggctatcccgcctgccacgtacggacctccggcgtgcaacggtgcaacatgagcgcgccggtccggcaccctgacgctgacatcgccagcgcccatccgtcacctgtcaagcggagtagcagcatgtttcgcactcagcgcatcggcgtaagt

SEQ ID NO: 65886 - DNA, 564 bp, Triticum aestivum
  unsure (1)..(564): unsure at all n locations
  Clone ID: PAT_TA_65886
tcactcctcacagtcgcagcattctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgcaactgagccggcgcccangaggccggccggcgaggcgagcacgaggatgaggaggacaactggacaagcaaccaccaccaccaccaccaccatcactagccgctgcatgcgcccgcccgcgcgcgcgctgaataaaataaaaccgtcgtgtgttccttaactctgtacctgtacgcccgtgttttccaccagcagtgtccttgctcatgcctccaactctaatacatggcgcctcctctaaaaaaaaaaa

SEQ ID NO: 65887 - DNA, 358 bp, Triticum aestivum
  Clone ID: PAT_TA_65887
ttcctccctgcaggcaccatccgcccagaagaacagctccgtccgccacgccgaggaacagtagcgccgtcaaccgccaccaaggatccactgctgatttttctccatgtgcgacctctgcttcggctgatctcctttcctctgccccgcctacagaatacaagaggtaagcttctggtgggtgagtggttccttgtcgccccttctctgcccacctccagatctggtcgttataggtaagctgggttagtggtttttccagtacgtgtaggtaactaatcggatccagccatgaattggttggcttcttccagtaggtaaataaatctatggttgttctagtgcgtgcttcatctac

SEQ ID NO: 65888 - DNA, 399 bp, Triticum aestivum
  Clone ID: PAT_TA_65888
tgctcccccgcgcctcctcccggtcctccaggaagaagaggatgcatacgaagtaaggctttggctttcctctcctccaagttcttccagcatgagttgctcggtactgtgagaacgtggagatgtgcaggctcacagagtggataagttgtagattgtgtatggataagtaagatatgtggctgctaggtgcaggtacacaaagatgatgaggtcagagccttgtttaagcaagtgcaaggagaagtccctggattgcctataatcattatgaaggtggcatctcaggaaccttctattgagttgttttactggcttaatttggccgctcttgagcatccagcagctctgtgtccgaagactgtcaccatttgtaaatactacgtacttgttgctgtg

SEQ ID NO: 65889 - DNA, 396 bp, Triticum aestivum
  unsure (1)..(396): unsure at all n locations
  Clone ID: PAT_TA_65889
ccgtcgccgcccgcgtgcaccatggcgctgccgaaccagaacaccgtcgattaccccagcttcaagctcgtcatcgtcggcgatggcgggactggcaaaaccacatttgtgaagaggcatctcactggagagtttgagaagaaatactaacccaccattggtgttgaagttcacccgttggatttcaccactaactgtggaaagatccgtttctactgctgggacactgctgggcaagagaagtttggtggccttanggatggatactatatccatggtcagtgtgcgattatcatgtttgatgtcacttcaaggctgacctacaagaatgttcctacgtggcacagggacttgtgcagggtttgtgagaacatccccattgtgctgtgtggcaac

SEQ ID NO: 65890 - DNA, 311 bp, Triticum aestivum
  Clone ID: PAT_TA_65890
gaaatggccccgaagcgaggcggcaaggccccggtgccggcgaagaagaaggcggcggacaaggtggtgaacccgctgttcgagaagaggccgaagcagttcggcatcggcggggcgctgttttttttttaagacctccaccggttcgtcaagtggcccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggc

SEQ ID NO: 65891 - DNA, 287 bp, Triticum aestivum
  Clone ID: PAT_TA_65891
ttcgccggcgccgccgccgccgacttcgattccgtggaattggctctgtctgccgcaggaagaagaaagatcaacatttggggtctccttttttaggagcagagggaattaaaatgaaggcgcggcagttggtgaatgcggtgctatagtatggcagaggcggattgtatacggtgagtcgcatgaaggccgaggagcaactcttctacggatccacggcggaagcacaagcagcagcaacatcagcggcatccaggatggaggtcatgtcgcggttgcctgcgccc

SEQ ID NO: 65892 - DNA, 537 bp, Triticum aestivum
  Clone ID: PAT_TA_65892
acagtctgaatggcaccatttctgcaagttttggaggcctttcccggctcacggagctgcagatgggaggcaaccgtctgtccggctcagtgccggttgagcttggcaaactcaatgccctccagattgctctaaatctcagctacaacatgctatccggtgagatcccaactcatctagggaacttgagaatgctggaatacctcttcttgaacaacaatgatcttcaaggggaggttccttcctcattcactgaactctcaagccttatggagtgcaacctttcttacaataatcttgttgggtcgcttcccagcaccctgctgttccagcacctcgacagcagcaacttccttgggaacaatggcctctgcggcatcaaaggaaaagcttgtccagtaaattcagcctacgcaagcagtgaagcagcagcgcgcaagaagcggtttcttagagagaagatcatcagcgttgcctccatcgtcgtcatattggtttcattggtgctgattgcactcgtctgctggctcttaaagt

SEQ ID NO: 65893 - DNA, 578 bp, Triticum aestivum
  Clone ID: PAT_TA_65893
cagtgtctccgatttcctgaatgtctcagtgagcctacgggggagcgatgcacagagctatgccgtaacctgggttctcatctgagagagaagcatggccatgacaatttcgcagaactaagaaaggtgctgatgcataactatgacagtttgtcagtgtatgctatgacctgcttgctatatcttggtgtattccctaacaatcgtcccctcaagaggaaagttgttatcaggaggtggttagcggaaggatatgcacggagtgattctcttcgcagtgaggaggacattgcggatgagactttcaaggcgcttgtcgaccggaatatcatacagtccattggcacaaggaataatgcgcaagtgaagacgtgcatgactcatggcatcatgcacgagttcgtgctgcacaagtccgtgtcacaggggttcatcgcgacatcgtctcgtgatcatccaagaccccatgcctatgttaataatgcctgccacctttccatccatggtggcaatgtgacagatagtgaggcctctgacgaggatttatctcgtgttcggtctctaacagtctttggaaa

SEQ ID NO: 65894 - DNA, 231 bp, Triticum aestivum
  unsure (1)..(231): unsure at all n locations
  Clone ID: PAT_TA_65894
gcgtcttggcgggccggggcggcgcagtgtggctgctccatggtgctagtgctgggtggtgcggtcgtggcagatctggtgtctccagttgttggatccggtctccgacggacgtggcggtttgttttgtgcgtctggcgcanagttgcggctgggaatcatggtggttcgtggcctcgggcagcgcacctccgtcccttgccggcatggtgctcggcggggtgtggtggt

SEQ ID NO: 65895 - DNA, 368 bp, Triticum aestivum
  Clone ID: PAT_TA_65895
gtgagatggctcgcggcgcggcggcggcggcagcggccgcgaagggcaagaagaaggggtccgtctccttcgtgatcgactgcaccaagcccgtggaggacaagatcatggagatcgcgtcgctggataagttcctccaggagcgcatcaatgtcgccggcggcaaggccgggaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgtgtgatcgcagccaacaaggagcgcaacgtgtacgagctccggtacttcaacatcgct

SEQ ID NO: 65896 - DNA, 634 bp, Triticum aestivum
  Clone ID: PAT_TA_65896
ggaagaacaaagaccaaagcctttaaaaagatttttgtatcacaaaggttggtttttgtaggtccaaacaacagccgagttggtgcatgaattaatttagcacgagagggaaactgaattcagaagacaatgtctagcttcgttggtgttcttgtctctgatccatggctccagagccaattcacccaagtgcagctccgaacgctccaaacaaaattcacttccgcaaagagatcggatgccgagcatgtaactataaaagatttgccgccagtgatggaggagcttaggggtattcaggaggttctaaccgaggaggatatcaccaactttttgagcgagtcttaccctgatatgaacgagccaattgaatttgagcagttccttagggagtacttaagccttaaagctaagggaaccaccaaatcaggaggccaaaagaacttgaagggatcagtgtcctttttgaaggcatcgaccactactctcttgcacgtcattaatgagtctgaaaaaacttcttatgtcaatcatatcaataattttctcggggacgaccctttcctgaaaaattcttgccattggatccaacatcaaatgatttatttaatcttatcggggatggtgttctgct

SEQ ID NO: 65897 - DNA, 282 bp, Triticum aestivum
  Clone ID: PAT_TA_65897
ggcggctgctgcgttggagcacgagaccaatggcgggcctcgggttcgaggagaccgagctccggctcggcctgccaggcggcagcaacgaggccgaggaggcggccgccgcggtgaggagctccggcaagaggggctacgccttttcatcgacctcgtgctgaatctggagccggcgtcggcggccgcgccgccgtccgaggacggcgagcaagtggccgacggcgtcccggaggcgcagccgtctccggctgctgccgacgggcagttgaagcggtcgcc

SEQ ID NO: 65898 - DNA, 479 bp, Triticum aestivum
  Clone ID: PAT_TA_65898
tcaatgcggcaagggcaaggtctggctcgaccccaatgagtaacgagatctccatggccaactcccggcagaacatccgaaagctggtaaaggatggtttcatcattttttttcctcagaagatccactctctgtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgccaagagcaaggctagcagggagaggaagcatgcc

SEQ ID NO: 65899 - DNA, 587 bp, Triticum aestivum
  Clone ID: PAT_TA_65899
ctagctcgcttgctcttcgatcatcccgagctgcctgcgcgcgcgcgtagctattcacagctcccgcgtagctagctagcttagcgttggagccagccagccatgccggccttcgccgagagcacggccgagccgcctctggcggacagctactacgcgctgctccgcggtggcaacaaagccgacgagtgcgcctcggcgccgccgcctggctgccaggccccgcccgtgtcggaatgcgagctcccgatgatcgacgttgggtgcctgacggcgtgcggcgggggcacggaggagagggcggcatgcgccgcggcgatcgcgtccgcggccgctgaatggggcttcttccaggtggtcaaccacggcgtcaagcaggagctcctggaggcgatgcggcgggagcaggtgcgcctcttccgcctgccgttcgaggccaaggccacggccggccttctcaacgactcctaccgctggggctcccctaccgccacgtcgccaagggagctgtcctggtctgaggccttccatgtcccgctcgccggcatctccggtaccccttgcagctacggggagctcgccagcat

SEQ ID NO: 65900 - DNA, 635 bp, Triticum aestivum
  Clone ID: PAT_TA_65900
ctctcctccttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctcgtcctccccggcgagctcgccaagcacgccgtctccgagggcaccaaggctgtcaccaagttcacctcctcctgagtctcgtagttagctgtttgggtgtgtttgtggccgtgttatcgtgtaagaatcgcatcgctatgtttctggatctcgagaaatagtaacggtgcctgcctcaatgttcagtaaaaa

SEQ ID NO: 65901 - DNA, 519 bp, Triticum aestivum
  Clone ID: PAT_TA_65901
ttctttctcccgcacgtctctctcaagcctccgccgccaccagccatcctccccgtcccgcctcttctcctccccatcgccccctccccccgtcggtcgtcctgctgcatctcctgaagggcgccgcggccggtggcgccgctgctcccccgtcgagcttgagcgtccccatcacaaggaggagaggaggttgccgctggcgttgctgctcggccctctcttccccaccacgttgatccgacgcaccactcctccgcgggcggccacgtctaaccctatcgccacggtcgccggtgcacggcgggcggctacggctaaccctagcgccatagtcgccggtgcacggcgtcgcccatggacgacggcgctgcgcctgcacctgcggttggtcctccccgagactggttcttgccagatctgctgttgtgctcattgatttgcagcctcgtccgctcctgtctgtgcatattttgatccgagccggttgcatcttagttcacggatctttgggtcatctgc

SEQ ID NO: 65902 - DNA, 559 bp, Triticum aestivum
  Clone ID: PAT_TA_65902
acttccgcgccgcgggatccgtgccgccgcgcgccacctggtctggcgacgcgtacgcccgcgcaaggcgtttcctgggcgcgccgccagcacacagctggtcgaggacatcgtcctgtttctcgccaagaacgagcaaacggtgctcaacatgctgttctggggagcccccgaggacgcggacgccgtggcagcggtgatagtccagcacgccgtccctctcatcgagagcagccacgggacccgcctgctcgttgtcgtcctcaaccgctgcaaccatatgctccaggaagcgatcgtcgctagaatcactcgagaccacaagaagtttttcaagatttgtgctgcgaggtcaggtgaggtggtgagcatgatcaattcctgcatatccgagaaatcactggagcttctgagagatgcaatcgtgccatgggtgactccgtttatgatggctcgccttgtaacggattcgagtagactcatggtggtgcatgccttggtgcagtgtgttcctcatccatactttgctgagaaactacattgttcagtacgtcctgaa

SEQ ID NO: 65903 - DNA, 558 bp, Triticum aestivum
  unsure (1)..(558): unsure at all n locations
  Clone ID: PAT_TA_65903
gtcacctttctcggccccgcgggcgcagaggcacacgccgcgctcgcgtcgaaggtcgcatccttcgtcctcgccgggcgggggttggcccaggcccacggagccaccggcgtctgggtcgacgcctcgctacgcctcagtcctacgttcgccgacacggccgccgctgtctacaaggccgacgctcgatcggtggacttcagcaacaagcccagggaggcgatggccgagatcaatgagtggttcgagagcaaaacacgcggcctcgtcaagaacattgtctctgagcgcgattgcgacggctccacggcgctcgtcctcggcaactcggtcttcttcagcggctactggaactcccccttcttcccangggccaccgaggaaggcaggttctatgtcaacgcctcgccggaggatcacactgttcgcgtgccgttcatgaaggggagcccgtttcagcagatcggcgtccaccccngcttcaaggtcctgcgcatgccctaccgcggcgactttggcgacagcgacccgttgtttgccatgtacatctacctcccc

SEQ ID NO: 65904 - DNA, 581 bp, Triticum aestivum
  Clone ID: PAT_TA_65904
ggaaggagagttggagtggtttataagggtttctcttctacatgctattggagcttgagaagagaagaggccctcgcgcactcctcctccgccgcccgcctcgtcacgacgagacgcgccgcgggttgcgggattgagccgagccgagctcacacctacgcgcttatttttgccagtcactaacggagagttttctgacagctgggccacgatctgagacgtcggatcgtgggctgtcacggactcggacgtgggtcgagcccacgtctctccacgcggctgcgcctataagtatgcggtgtctcctaaccctagccgccacgaacagatcacatctgctcacgcgcacgcccaccgtcgctcctttgctgctgctgccgccggtgactccatcccgtccgccacgtacacggtcgacgggagagcaggtctccgaaaccacgcccttctggttcctgtacggggtgaggggcgaataggtttttgggcagcgattacgcgactgctcgcttccgatcgtctacttcctctacgtccgcgtcgccttcgtcatcaccatgtccaccgacgccgaccgtgcc

SEQ ID NO: 65905 - DNA, 520 bp, Triticum aestivum
  Clone ID: PAT_TA_65905
cgaccggccgcggccgctgatgacacaactaagagaaggaccaccaaaaacaaaagtttcaaagatgttgagaactatgaagttcttgtccttgagaagaactgcggttgcaagttcaaatccttgcgctacttgcttatagctattgtttctgcgacatttcttaccctcctgactccgacgctgtacgagcgccaactacaatcaagttctcggtatgttgatgttgactggatatgggacaaaacaagtgctgatccgcgatacgtatcatctgctgatgttcagtgggccgatgtatatacagctatagaagatcttagtgctggtaaccaagagctcaaaattggactcctgaattttaacagcaccgagtatggctcttggtcgcgcatactccccgaaagccatgtttcgattgtaagacttgagcatgccaaggacagcattacttggcctaaactatatcctgaatggatagatgaggaggaagaatctgagataccttcctgcccatcat

SEQ ID NO: 65906 - DNA, 502 bp, Triticum aestivum
  Clone ID: PAT_TA_65906
ggctcctccgcctccgcctccccccgtccttcctcccctcgttcgtccaagtgatcgtcgtgtttgttcttccccatcccggatctgtcgccggacgatgtcggcggggccatcttcctgcgccggcaaagtgcaggaagccggagggcaggatgggatgtcggccgtgcgacggtctgatgggaggagaggatcaagagcacaagaccacgcgtgtcggccgtgccatcttcctgcgccggcaactcgtggacgagcgggacccggagggtggctcggttctggtaagctcttttactgctgtcagacatcagagttgcgttgtgccgcaatgtcagatcttcgccatcggatccttgttctagaccaaagacaaggtgatcataccgaatctcccctcagctaaaaaaaaggcattttgtcactgattagtagttggacaaaatcaaaagttcattgagttccatccagatgaataacgaaagttatatttgagttaaag

SEQ ID NO: 65907 - DNA, 277 bp, Triticum aestivum
  Clone ID: PAT_TA_65907
cgtcgggtgggcgattccgtcacttaggtggccggcgcaatcacgcaggtaggcggcggcggaatcgcgcaggtggtcggcggttggtcctggcgacgcgcggtggaatcggggaccagctcgcctccggtgggcggcggaatcaatgggcaactgttctcgggtgggcggcgcgggtgttcgtgggtgtctgcgagcgccggaatcgccagcacggcggcggaatccgaccgcgccggcccctggcgacgggaggaggactggcggagggaggaga

SEQ ID NO: 65908 - DNA, 345 bp, Triticum aestivum
  Clone ID: PAT_TA_65908
tcgtcttaattgattcgccagtcctgcatgttccggattggatgcgcgcacttgtcaaccttcaagagttacgcattgaagtgaagggaatcacgcagagtgacctttgcattctcggaagcttacctgctctgctcaagctggaactagaagggagataccatgattctaaagatagaatgctgacagtcagtgctgaagctgggttcccatacttgaccaagttccgatattatgcagaccaagaaggaataaatctcaagttcgcagcaggctccatgcccaacctagaaatgcttgtgatcgtgctacgtgcgtgtggaactgaggcactcgctgattgtt

SEQ ID NO: 65909 - DNA, 451 bp, Triticum aestivum
  unsure (1)..(451): unsure at all n locations
  Clone ID: PAT_TA_65909
gcctccgctgctggccaccacgccaagcgcgagccttcgtctgcggccgcgtcgacgccgaagctgcagcagtttcagaacctggttcgtttcctgacgcgaagcaacggcagcgctcccgagctggccaagaagaccaagtcggcgcgcgtgtccccggtgagccggaaggccgcatgctccggcgcggcgtggggcaggtcgtactcgttcgtcggcacggaggagtacgtggcgccggaggtggtgagcggcgacggccacgggttcgccgtcgactggtgggcggtgggcgtgctcgtctacnagatggcgttcggccgcacgccgttcaagggcaagaaccgcaaggagacgttccggaacgtgttgcacagggaggtcgagttcccgggcgacacccancgccggatgccggagctgaccgacctcatctcgcggctgctgcagc

SEQ ID NO: 65910 - DNA, 294 bp, Triticum aestivum
  Clone ID: PAT_TA_65910
aggcatgtgctgcgtctactcccccgccaccgtctccacgacctcgtcgcagcgaggtcagatcgtgtcgtcggatcggccgccctcctacgccgccgacgccccgctgcgctccgatgaggggttcgacggcagggcggccaatccctctcgcgcgaggcgcgggcgcgggcgcggcggcggagatggcgagcccccgccgcgttccccgaccccgatcgtgaacaccgacgggaaattcgatggcagggcggccaaacgccgtcgcgcggagtccggcggcggggtcggcgt

SEQ ID NO: 65911 - DNA, 494 bp, Triticum aestivum
  Clone ID: PAT_TA_65911
gccaaggtttccggctccatcccctccggcggctcgtcccggccagcagcgcaccgtctcatctgtccacgccccatcccgcccagctatttctgcgtagctcctctactgctctcatgccgagcaagccaagcagcgccatggcagtggccgcggcctctccggcgggtggcggcggagtcgcacgcctggaagccctggccatggacaaggtggcggaggcggccgacgcagtcgccatagcgtcgagcgccggcgaggttgtccgcgcgatccacgctgttgctgtcctcctcttccctgtggactccgccactgtcgctggcaccttggacgagcccatcaaaagccagattatcagtgttctgagcctcagccatgacgaaagggagtcttggaggcgtgctttttatcatggtccagcatttcctaccatgtctaagatattacttggcaatattgctttgaagtggctacggcagattcacaacact

SEQ ID NO: 65912 - DNA, 487 bp, Triticum aestivum
  unsure (1)..(487): unsure at all n locations
  Clone ID: PAT_TA_65912
aattttgtcacccccagctgcatctcgactacaaagaaacgaatatagcatgtgtgtggatgcaggcaggcaagggatgcagcttttgagtgctcatgcatcaatcgttctgttgtgaatgagtatgtggaagcagtgaagcagcttgcatgtgacatcctggacctgttgggagaggggctagggctggaggaccccangctcttcagcaagctcatcacagaaactgacagtgactccctcttgaggatcaaccactaccctccatcatgcaccgttcacaagcttgaccatgatgaccaatgcaagctcaagggggttgccaggaccaaggctggtagcggtgggaatccagcggcgggtggccggatcgggttcggtgagcactccgacccacagctacttagcttgctccgagcaaacgacgttgatggcttgcaggtgcttctgccggacatcaacggcaaggacacgtggattcaggtgc

SEQ ID NO: 65913 - DNA, 292 bp, Triticum aestivum
  Clone ID: PAT_TA_65913
gtcgtgagttgttctggagaatttttgggcattgcaaataagagacatctctatatatggagcatacctacgaaagatttcaaccatgacaatataaggaaaataaagcttggtcacacaaagaagttgagcaccctggccttccatccaagtgagagaatcgttgctggtggtgatgcaacagggaggatcttaatctggagaggttttggaaaggccaagttttctggaacacatggtgcaaagtctcaagttgatgaagaaagggatggtgtaaggggtaaagatgatg

SEQ ID NO: 65914 - DNA, 513 bp, Triticum aestivum
  Clone ID: PAT_TA_65914
ttcttatggtaatcataatccaattaattgtgttgttcatgaccatgtactgctagtgcggtacaatttgattccttcctgggttagtgtcttgcttacatgcttgattgagttaagtgtacaataaagaaagggggcctcaatctgttatttagatatgttttacatctgcgcttctctgaaataaatgaaatttagtgttgagctgaaccatgctactgggtgagagatggtaagcatctgctctatggaacaccatatttttctttgttgaattggctattaaggtgagagaagatgaatgcttggtcttccttgacaaataacaacttgtgttcaacttgtttatttaagattttgatttctaatagttattcttgtatggaaaatgtgacaccacatgtaaaaccttgtaggcgaacatttaaaacactgcccagcaaatgaagggtggaaacaatactaaccacgaatgccactattcaaggggatgccaattatgcctggaatcgt

SEQ ID NO: 65915 - DNA, 368 bp, Triticum aestivum
  Clone ID: PAT_TA_65915
aacaaaaaaaatctattctagggtttagactgtccgtccagcgtcgagagccgtctgcccgcgagcgtgggtgtgaagtatgtcgacagggatcgccggggggccgccgccgacggaaagagcatcctggtggacgtgtttggtactcaccgccgagtctctcttgatgactccagtctttggaacaatgaggaattgtttcggcaatgtgcaggcatccttctcaagaacaatggtgattttttttgaggcttggaacacaagaacaaaaaaatacaatagatttccatttgctttcacctggcggtgaggatgatgctagcaatgagcagcaagattcggcagctactattgctgctattgatggc

SEQ ID NO: 65916 - DNA, 460 bp, Triticum aestivum
  Clone ID: PAT_TA_65916
agcttaaccacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcctgtccacccactgccacaatgtcaactagttcaatatataaccct

SEQ ID NO: 65917 - DNA, 664 bp, Triticum aestivum
  unsure (1)..(664): unsure at all n locations
  Clone ID: PAT_TA_65917
cgaccggagttgcgggcgcgtggctgggatcgaccggtcggccgacggtggcggtgaagcgccccctccccctcccccagtgagatctgcgcgaccgatcggctgtccttgctaggcgacgccgtggggtggtgcccgggctaacgaaacgtcagttgtcgattcgactccggcgatttaggaattaaatcacggttgcaagaggccattaatggcaatcgatgcggctgatagttgcatgtcaattaccctcacgattcatattcctcctttttactcttgcgtacatataatctccatgatccagcatctcctttcccattcccgtttttagttccgcaaaacattatccggtagccatgcttgtcactcggattgctaattcgtcttccgcttcctctcctaccagcttccgctccatgctaccttcactttctcttcaattctgcatcgagttctttgcactctggctcgatcgattgaacctcggttccacctggttggctgattctactgcattggaagcttttcttattctaagtaaacaacagcggaaggtgcagatcatagtcttttccctgaaggtatttgctttacacagatcaattcctttntgttcttatatgttaaagtctgtctgtatgggctcttgtcttgctttcta

SEQ ID NO: 65918 - DNA, 593 bp, Triticum aestivum
  Clone ID: PAT_TA_65918
ctccctcttctccctcgccccgctctgcctcacccggcgcctcctcctctcccccagccccggcacggcctcccgcttctagacgctcgcctcgaagaaggcagctgccaccaccatcccctggcccaacggggcgtggggagcgggctgctcttggtgctcggctgggtgctcaccgacgaggagtaccgccgcgcgaccaggtgcatcgcaagggcgtggaggcggaggggtacaccatcaatgtgatctcggcccacctcgaccgcatcgcgagtgatgtacaggctgcatggcaccttcttcgtcccaagtacaccatgccattgaccagtacgagctcaagcacaccctcatcccaaaagatgctgacgagtagtgtgaattcaggagggatctaaaggtcaaggccttcaaaacctaccatgtcataccccgctagatgattgcatgggaaaattggacatggcatatctgaatattgaaaattcattactggagcattcttaactgattgtatcattgtatgcgaaaattgctacggaggaaatattgcttaaatagtctaaacgttctgttggctgttgcccttt

SEQ ID NO: 65919 - DNA, 468 bp, Triticum aestivum
  Clone ID: PAT_TA_65919
tgcgataggtgcgtgcctgcacgatttgatgctgcgaatacgccctggtgatgcgcgggtcagccggtcaggggcctaggttggcgacgaagagcgcctccaactgtgagtgatgcagatccggtctccagtggctgcggtggcgtgcatggggcacgttggtgctgctcggaaccctggtggctcttggcttcgggcagcgctcctctattcctaacggcatggtgctcggcagggcacaacggcttgcgttgcgtctagaagaccgttgatggatgtagggactcgttctggaggttggccgtcggtggtctccgcgaggtgtggttggctacgacggatctcggagctgtcctgtctggtcgcagggggctgagttctagcatggatcttcatgcatcttcacgcggactctgcagtgtgtgtcgagtcgacgatcgcctacgacgaagtcggagtcgtttgctc

SEQ ID NO: 65920 - DNA, 536 bp, Triticum aestivum
  Clone ID: PAT_TA_65920
ttcaacgagtcagactacaagtattactccgcagttgagagtctcgagaaagcatctatgacaaacaaccaagacgagagggatattcttgctagggaagccttcaatctcttgaccaaaattccagactctgctgatttgagtgctatatgcaagagatttgagaacctacgattctatgaggcagtagtgcggttgccactacagaaggctcaagcacttgattccaatgctgatgttattaatgggcaaattgatgcaaggcatcatgatactataactgcacagcgtgtacagtgctatgaaatagttatgaatgctctgcgtacactcaaaggtgcgggacgaagtggggcacctggtccagtgactgcccttgatccagcttctcgaagcaaatgtatcaaacagattattcagctaagtgtccagtggccagacacagctttccacgagcatctatacaggacacttattgagcttggtctggataatgaacttttggagtacggaggctccgatttggttgcttttct

SEQ ID NO: 65921 - DNA, 416 bp, Triticum aestivum
  Clone ID: PAT_TA_65921
gccctctccttctcacatcgtcgccccgcaaacctagcgtgctccccgccgccgacgacagcgccccagccctccactccggcgaccggcggtgcacctcggcgttcttctcccccacgtattcaaccgcggcaggcactcagcaatcaggcaacgcctagttgacgatacaagatggcgccactagcacgtaagcaccgcaaggcatcaccttccccctccccctcggaggcttcttccaattcaggcagcgactctgaactccaccttgatgaccactccgacccagaggacagcttcttctccacaaggagcgccgccgatgacgacgtccaggaatcctccaccagtgacgaggaggaggacgatgaggagagcctccatgaggaggaggatgatggtgagatgggagagct

SEQ ID NO: 65922 - DNA, 543 bp, Triticum aestivum
  Clone ID: PAT_TA_65922
gagcccgagcccgaatccctgcgatcccccctctcgacaccaccatcattagatcggagccgcacgctgctgcttcgaatggaccgggaatcaaaacagaaccgacgggacgcgcagctcctcttttcgggcgggattcgggatccgcgacggcgtggatctgcgattggttttgcggttcctgacaaggagcagatccgaggttcgcttcgccgcgctctgatgaccgggatatcgaggaaccggacgcggttgctggtttttgcgttaggcagttccgtcagacggcctcgtcgaagccggttgagatatgggaatcgccattcggccgtttggctgtaaatttcatcgctccgttacggatttccgtctcctgggtgggattacagagaaggcgcaatgcttgctcatatgctgcttcatagtatctgttgctcatattccccgggcgacaaaacttgagtaataccctcccgttggatagagtaggagcaggagcactctattatgtatgtctacggtgtagtagcactctagtatgtt

SEQ ID NO: 65923 - DNA, 484 bp, Triticum aestivum
  Clone ID: PAT_TA_65923
tgtcactaatacagatgtattgaagaatgggttgttagtcaaagaagacacagaatgggctaggaaactgtcaatgaaagaagatgaaattaatactttgaggcagaaactagatcgccttctcagtattgaaaatgcaggtgccgcaggttctgataccgtttatcttgaattggagaaagaaaatgaaactctaagggtaaaaatacaagaacttgagaaagattgttctgaactaacagatgaaaatctggagcttatatataagctgaaagaaagcagtgtggggaaagggcaggattctcgtgtttcaaacaacagtgaattgcaaattgaaaagcttacatcacaaatatatgaactggaagaggaacttagaaataaggaaatgatgcatgacggcagttttaccgagtcatcagtgtctaatgccaaagagttacagaggaagtgtgctgaccttgagctgaagctgctacgtttt

SEQ ID NO: 65924 - DNA, 603 bp, Triticum aestivum
  Clone ID: PAT_TA_65924
ttgacggcgtgcccgtgcttttcatccctggcaacggcgggagctacaagcaggttcgctcatttgctgcagaatcttctcgagcatatcaaaacggtccacttgagccctccttttatcgggaaccatctagtgcatttgaactggaagattcttcccttccatcacaatatggccgtattctggattggtttactgttgatcttgaaggagaacactctgcaatggatggtcgcatacttgaggagcatactgaatatgttgtctatgccatccataggatccttgatcaatacaaagaatctcatttagcacgatcgaaggatggtgttcgttctactggtaacttgccatctagtgttatgctagttggacattcaatgggtggttttgtggctcgagcagctcttgtccacccgggcttaaggaaatcagctgttgaaactatactgacgctctccagcccacaccagtatcctcctgttgctctgcagccgtccttgggtcattttttctcccatgtcaatgaagaatggagaaacggatacaagaaaggagtatcacatacaagcagtccaaaactctcaaatgtagtagttgtct

SEQ ID NO: 65925 - DNA, 564 bp, Triticum aestivum
  Clone ID: PAT_TA_65925
actggcgcttcctcttccccgtctcctccgtgttcaacccgccgtccctcgccccgccggacgcctcccacgggcccctcttcttcacccctctcccgccgcccgtcccgctcctctccctccccttccccttccctccgcccctgcacgcctccaccaccggcgacctccgccacgccctccgctacttcatcgcctccacctccttcctcccctactccgatctcaagtccctctcgggacccctcctcgccgcgccgtcgccgccgttcccaccaccttccaatcttctcgccgtcctcccctcccgctcctcaagctctctcgtcctctttttcccgtacggcgagaatgcggagaagattgctttcgctcttgtgaactcccccgttgcgagctctgcgcccgtttcgcccttcgttcagagggatgggttcaagcaccctgggcaccgcatacagcagcttgctgctattcctgcccagtcgtcctggtcatcggagccggatgacagctgtgtcgagggtttcctgcttgctgcgacattgtacacagtgagttggt

SEQ ID NO: 65926 - DNA, 590 bp, Triticum aestivum
  Clone ID: PAT_TA_65926
cacacatgtgcctcctcgctgctcagtccctggccacgcacgctctggccgcagcgtccaggccgttcacagttgccaccctagtccgttcaccaccgccaaccgaggccgatcgacaatgcagcgatgaggtcgttcaacgacacaatggtggttcggcacatggcctgttccaacgatctctaatggtggtcatggcgtggtgttggaggccccgtatgcaaacagggacaagttgtgggatggcatacaagtggggatggcaacaaagcttgagagattttatgttgccatatcgggcttcacagtcaatagcaccatgctctgggatcccaaactgaggtcccatcaggtctggaacacgacccggcacccggaaaatggtgtaacagggcttccaattttcatggatgctagccggcaatacgtcgaagattcctgacttgtggtgatagcggccaccactaagggcatttgcttccagcacaggagctacatgctcgacggttgcacactgccgccatggacatgcacaaagatattgagtacataaatgtgtatcgcacagtacatgtattactactgggaat

SEQ ID NO: 65927 - DNA, 559 bp, Triticum aestivum
  Clone ID: PAT_TA_65927
catggaagtatttagtagaagaagcacaacctgaagaatcacacatacatgacacaattgtatgaaatccgtcacaaatgggcgaagccttatttcaaaggtatattctgtgcaaagatgacaagtacgcagcggagtgaaagtacaaaccaaatgttgaagaattatgtccctcctggatgccccatgcatatttttgtcaggaagtacatgagattgctcttttcacagagaatctgaagaaaattacaaggagaaacggaccagaattgggaggccacttctgcgtgcaaacatggcaactgaacggcatgctgggaagatatacacaagagctatctttgagcagtttgggcatatactatatgagtgcggtgcataccaggtggaggagattgagaaaggaaaatcatatgtcgcaatacatactgaagcggatcgcagggagaagtggtgtaggacttcatacaaatttacagtgttagatggtggagatgaatttgattatgaatgcagacagtttgcacacatgggtttgcctggcagccatgtgttaaag

SEQ ID NO: 65928 - DNA, 468 bp, Triticum aestivum
  Clone ID: PAT_TA_65928
gtgcggtctgcctgtgtgagttcgccgacgacgaccgcctccgcctcctccccaagtgcagccacgccttccacgtcgaatgcatcgacacgtggcttctatcgcactctacgtgcccgctctgccgctgcagcctcctggccgacttctcgccgtgcggcgggggctgcagctcgctggtgtttgtgctcgagtctggctcggagggctccgtctccggccgcgtcgaccggccgcccgctgctcacctcagcctggtcatggagcaagaagaaggatgtgaaagtcagacgcactcagatgtcaaggagaaggacgaggtagtcgtccccgtgaagctcggcaagttcaggagccaggccacggaaggaggcgcgggatgcagctccaaccccgaccaagatgtgaggcggtgctactccatggaccagagctccctgctccgtgtatccgtgaagccgccggcgg

SEQ ID NO: 65929 - DNA, 337 bp, Triticum aestivum
  Clone ID: PAT_TA_65929
ctccgtctgttcgcatcggccgggccgccgccgccgtcacgggctcgccacacctcgctgggccagccatggagctcgatctcccgccgccgcgacaggcaccgccgctgaccgacctggccgccgccatccgcctggccgccgaggccgcggccgcgctctccgcgccatcatcctcctcggccgcagccgctgcggccgccaccctccgcgacgctcacgccgccatcggcagcttcctctcccgcctcgatgcgcccgccgccgtgccgtccgacaacgatcagcccatggcggatggctgcgaggcgggggagccgatgatcggggaggtgga

SEQ ID NO: 65930 - DNA, 390 bp, Triticum aestivum
  Clone ID: PAT_TA_65930
gcgatcgcggtcgcggtcgtgctcggagatgtccatatcgctgtcggcatcaccgtcgccggcggagcgggagagcgctgcgcttgccgcgctcaccgccggcggccgcgccgccgccgctagttggggctcttattgagtcgctgtcattccggagctgctggttctgccgtgccgcgtcctcggcgttcgagaaggaggacctccgcctccgcgtcgcgcttccgcatcgcctccgcgactctctgcacgccgcgctgaaggcgaaggacccgtcggcaggcgccttcgcgttggaggaagccccatgggtgggcaccgcggccaacccgtggttcgccctggcgcccgaggacgcccccgagaaccccctggtcgcgttcgtcaacc

SEQ ID NO: 65931 - DNA, 266 bp, Triticum aestivum
  Clone ID: PAT_TA_65931
acctcgtcgccacctgcggtctcacccgagcccagcgctcaagcgtccaagaagctctgccacctcaagtccgcctccaacccagacgccgtgctcgccctcctctccggcgtcggcctctcccgcccggacatcgccgccgtcgtcgccgccgacccgctgctcctccggtccagggtggacaacgtcgccccccgcctctctgccctgcgcgaccgcctcggcctctctgcgcccgagatcgccagcttcctcctggtgggcgc

SEQ ID NO: 65932 - DNA, 381 bp, Triticum aestivum
  Clone ID: PAT_TA_65932
gcagacaaatatgggatggacatagtgcagcatgatgctgaatcatgggttgtgctgtcatcgtatgcagaagagacttttcccatattgacctactctactgaatcagtctctccagagtctgacaaagtaaagaatgagagcatgctaaccttgcttgtttcactaatgcgcaagtacaacgaagagaatgacagcaccttttctggatccaagtactgcaatgttccatctctagttgagagtttgttaaaaagatttgccaagttaagtgagcagtgcatgtctacattaagagaaatggcaccgcaagtagttccatctattccggatcatggtagcactaaacagaattctggatctccagatctaatggacaag

SEQ ID NO: 65933 - DNA, 615 bp, Triticum aestivum
  Clone ID: PAT_TA_65933
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgacc

SEQ ID NO: 65934 - DNA, 625 bp, Triticum aestivum
  Clone ID: PAT_TA_65934
acgtatggccctcagttgcccctaaaacctcaactactgatgttgctgaggttacagccataaccgtcttgctttggacagaacttataatttcttttgcataagtgtgccaagtgctgaactgattcatgtggctggttgttattgggcatttgtgtggtttaaatatttcagtatcagtgcaagatcatctgtctatttgagtatttatcttggtacatgaacatattcatatcaatatagcacatgaatacttgacatggctatctattttagtcttgcattgatattttgagaatggaagtggcctgaaagccacttgactgaattgccatctcttacaaagtggcaatgccatgataattagatgcctgcaggggatcttcttttcattgaaacatttacctatgatattgagcatagttcatttttcttgaatttcgctgccatgtatgtgttacttggaaatttagccatcgagcatgtgcttgggcatggtttaacattgcagaataattgtttgatgtagttggggttctcttttttgtgcgaagtgcagactgagatggtttcttgtgcaaagtgctgctaccgtttttttcttgcatgtaggtcaacaatccaa

SEQ ID NO: 65935 - DNA, 629 bp, Triticum aestivum
  Clone ID: PAT_TA_65935
gagtgctccactgtaaagccatgcacgcatacctgcatcaacacgaagggcagcttcaactgtgtgtgcccatcagggatgaatggtgatggccggaaggagggaagtggctgcagtggaattggcacgctgcagatttcaatagttgtgggactagctctgctactgcttctccttgttctcggtttctggactcactgtcttgttaagaggagaaagcttgcgaagaaaagacagagatattttatgcagaatggtggcgtgttactgaagcagcaaatgctttctcggagagcaccgctgcggatatttacctcagctgagcttgacaaagcaaccaacaaattcagtgatagcaatattgttggtagaggtggattcgggactgtctacaaaggtgtactatcagatcaaatggttgtagcagtcaaaaggtcgcagcgagttgatcagagccaggtggaacaatttgtcaatgagctggtcattctttcacaagtgacccacaagaacgtggttcagctactaggctgttgtcttgaggcagaagttcccttattggtgtatgaattcatctccaatggtgccctttttcatcatctccacaatacatcaatcccaatgtcatg

SEQ ID NO: 65936 - DNA, 212 bp, Triticum aestivum
  Clone ID: PAT_TA_65936
gaacttaagctggtggagatctgggaagtcacgcatcaactttacctgctgcgtaccgatggacaactctcacagtcagccatgacctcctggcgttggagcatggcagccgccacctgcaaatcctcctacacaatttcatcatcctccacaatctcaacctaccccacgcccacatgcttatccagcaccatatgataccagacccaatg

SEQ ID NO: 65937 - DNA, 227 bp, Triticum aestivum
  Clone ID: PAT_TA_65937
aacaagtgcgtggtatccgggccggttgctagcaggcgatgtgggtctagaagaccttctacggctcaccgacgaggcattccgacgggcagaagtccaggtgaggttgaattctccggcaaggccctctccccttctttctcttgtgtgtgtcttctcctccgcctgggcgttgatctgaggcaggaggcacagcggttgcaaggtgggatggtggaggctgtggg

SEQ ID NO: 65938 - DNA, 630 bp, Triticum aestivum
  Clone ID: PAT_TA_65938
atgcaattctgcatgtgcagcgtaaaatcacgccacccacctctaacaagagggtcctgcaatatctaggctgattgtttcacctaaccaagttggctgcctccttggcaaaggtggcagtatcatagctgaaatgaggaagctgtcaaaagctcatataatagtgctgagcaaagacaagatcccaaggggtgtacaagaaattgatgaagttgttcagataaccggggattctgaggctattcaggaagctctgatgcagataactgctaggctacgtaacaatcttttccgggacagaatggcttcaatgggtcccagtatgcagccaccttttggtttgctggatccccagtttggtgcatttgcgggaatccatgaatctacatctcctagaatttatcctaatgcatctcagtttcataaagatttcatgggacgaccattggatgagatgcctgctccttggaccacaaaggatgttggtgatccgatgtcaatatctggcattcctggaatggcacacagaggaatgggtggattctctggtcctgttcattcatctaggccaatcataactggaaatatcatggttccaagattagttatacctgctctatgtgggcatga

SEQ ID NO: 65939 - DNA, 578 bp, Triticum aestivum
  Clone ID: PAT_TA_65939
acgcctccgacgccaccttcctcacactcctcgtcctcggcgccgtcgtcatgggcgccgcggcggacgggccgcccgccacctacctgttcttcgtcgaccccacaccgcccggcgtcacctgcatgcagtaccacctcggcatcctcaccgccgccctcggcagcgaggagaaggcgaaggcggccatcatatacaactacaagaacgtggtcagcgggttctcggcgagggtcacgccggccgagctcgaggccatcaagaagcaaccgcatgtgaaccgggcgctgccgagcgctacgttgcaactcatgagcagcaacttcgacggcgtcagctgatccaatctagcgcggcccatccattcggctgatacgggctgatacatatcgtgcaactcgtgtgtactgattctctggagaagcgaacatcttttttctcttcaagaagatcggatgatgatgtaatctcattagctaagctcttactaattttcatctgtgcctctctatttttggttctagttctgcaatctgcatgaatgtgcatgtactttaagataatgcacaatcgccccc

SEQ ID NO: 65940 - DNA, 676 bp, Triticum aestivum
  Clone ID: PAT_TA_65940
acccgtgggagctgttccggcactacgacgagctctacttccgcggcgcgctcgccgacgccggcttctccgtcgagcgggccgccccgcgcaccaagacgatcacttctttcggatactgttcccttggagacctgagcaaaataacactctacaagccaatgccgcgatatcgcacaaatgccaatctgaagaacgccctgctgcatctcatgattcatggaatcgtatttgtaaagcgtggtctgacgagcctcggccatggtcctgcattccgtgattggatggatgcgatcaacactagctccgtcgacgattacgcgagaccgataagtggctactgtatcaccactacccatgatttcagtcaggaaaaatcctgcaacatccagggctctatgtggaagtgtgacaagtgtggcaatacacttgtgagggccaagagcctgggacctccatctgattcctgctgtatcgagaatgttagcgaagatccaacctgtggcaacaagctttgtcactggcacaaccacaagaagggttgtcgtggtaaatacgtggtgaccaaaccagcagtgacaccaggacaaaagatggctccaaaaggtacgctgcggcttcggactgaaacaaccaaaatgcccaagtcacaacaaggagctgtacagcagtcgta

SEQ ID NO: 65941 - DNA, 168 bp, Triticum aestivum
  Clone ID: PAT_TA_65941
gctccggcggcaccgagaaggagaaaaccgacgcacctgctgccgctgacgcaccgaagccggatgcacccaaggaggcagcgcctgcgcctgcccctgccgcggaggaagagaaatcgtccgatgggttcggtctcgacgacgtcatgaagggggctgcatcgctgt

SEQ ID NO: 65942 - DNA, 448 bp, Triticum aestivum
  Clone ID: PAT_TA_65942
acttgcaaagttgtttgctcaggattgggagggtgatgtcaccatggttatgccagcaacagtagctcagtacttgaagattatacaaaacccgacatatccagaactccaaatggctgccaaccattgtctcaggtgcacatgggagaagatctctgcgatcagagcaaactgtgcaattgaacttgcattggatgaatccatagcagccctcaaccacaaacgaaggctaagaagaagcattgaaagggcagcagcttcttcccagggatataccgacagtgttcgactcaaaacaccaaggagggtgccatcatggagctgcatcagccgagagaattcgtcaggatctctctcggaagatcacttcgcggccgccatctcatccaatcaccaaggtactattcgagtggatggtgcaccgcacacgtctcatcatgttcgtcag

SEQ ID NO: 65943 - DNA, 299 bp, Triticum aestivum
  Clone ID: PAT_TA_65943
cgggacaccaactgggcgcgcctcacgcggccgacttccacggcggcgacgtcgtttaccttggcgcctgcttcttttccgactcagcgatccccgcgggcaccgatggacggcgacgggcagcacgtgcggccgcggagccgcgcgctcctgaccgactttatgatgacgggacgtactccggcgacgtgtacagcggcagcctcgccgccacgggcgggtctcgtgctggctggatcttggggcggtagcagtacttggtgcagcgccgccgcggcgactacggcagcgtccgggtc

SEQ ID NO: 65944 - DNA, 422 bp, Triticum aestivum
  Clone ID: PAT_TA_65944
tagcttaaattatgaatatgctactttctcatccttgctgttgttgtaattcgaattatgattggttgctttgaggggcaggtgacattttatgaaaaatgtgactagatcatgaagagaaatcatcaaatgattatgtcaatacatgctcaatatttctcaaggtagtttggcaatgactggaagtatttacttgtctgtcaacaaaacgggaaataagaaaccatagaaatatattcgagtaatgaagactcgataaacttccgttctgttgattcttcttccttcagtgtttacgcctaacttaaatattgcatttttatcttcgtagttgacattttcttaactgcattctgatgtaggcaaagcagtgaggtttattctattgttgaaggtcaggttcatggacgaagaatgtctgc

SEQ ID NO: 65945 - DNA, 526 bp, Triticum aestivum
  Clone ID: PAT_TA_65945
tcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcggggttaccatacaattttttccaggaacctttagtgaatgtgctgatggagtcaaagggtggcaaaaagtctagcagtagtagttccctgatgtacgaagctcccctcggctacagcattgaagacgttcgacctgctggaggcgccaagaagttctctgctgcatactcgaactgcgcgaagaagccatcctgatatcgtttttggcatccccttcccgtagtttaggatttttatgcaattttattctgactcttttctcccaccaatctctctggcctgcttcacgataatcgaccagttctctagtcttactccctctgttcctctctgctctgctttctgactcaaactgcaacaatggctgccccgacctc

SEQ ID NO: 65946 - DNA, 144 bp, Triticum aestivum
  Clone ID: PAT_TA_65946
ggggtccgttcagaacatggcggggaacaccccccgtctggctcggggacaggtctcatcaccgacctgcccgccggtctggaatcttcgcgacaccttacataagaaatggggccaccttggggcgctgcccggcggaatgct

SEQ ID NO: 65947 - DNA, 144 bp, Triticum aestivum
  Clone ID: PAT_TA_65947
cccccacctccccaccgccgtccccagctcaccggcgctgccctatcctatcctcgccgccacgcgcatttgctgccgcgcgacgacatcggcgccctcgtagctgggactccgcctagtcaactttgattgggaggtggtgac

SEQ ID NO: 65948 - DNA, 160 bp, Triticum aestivum
  Clone ID: PAT_TA_65948
gccttgtcaagccaattcagggatataagtctgttggcaaagacgctccttctggaagcctgcccgacgaacaacttgaggctgagtgcagagaggtgctgcatgtctcttatctgattccagatattctaacgggcccgataatccactttgaaaactc

SEQ ID NO: 65949 - DNA, 318 bp, Triticum aestivum
  Clone ID: PAT_TA_65949
ggccgcgccgcagcaggtccgcgccgtgcccctggcgcgcgcgctccgcctccgcacgcgcgcctccgccgccgccccgccggagacgtcccgccgcgcgctcctaggcctcacggagcccgagctccgccagctcgccgtcgacctcggccagcaaagctaccggggcaagctttctgcacgacctcgtctacttgagggggggcaagcaggtcgaggagttcgcctatgtgccgaaggtgtggcgggaggcgctggtcggcgcgggatggaaagtcggccggtcgccggtgcatcccgccgtcgcggcctccgttg

SEQ ID NO: 65950 - DNA, 491 bp, Triticum aestivum
  Clone ID: PAT_TA_65950
tcgctcgcaccacgaaacgcactgacctgcctccgcgtcactccgttcgccaccccggcaggcaacgccagcggccagcgacgacgaaggacgaatccctagcgcccgctctccgtcgcgcccccgcctccacctcactccgcgcgccctgctgcgtctgcaccacgccgtcctcgaccctgcgtgcgccggtgagcagtcccaccgagaggacgatctccgcaaaggccccaagatggacgaggtcacacaagccgttgaaaacctgaaaaaggaatggagccaagcagttgaacagcttgaggtgtgcattgctgcaattgaatcctgtgggaagatggggaaagggacagaagaagcaatgtctcttcctcggttgaacggttctgcacaggatgcactgcaattgctcaatgcactgcagtgcaggcttgatcttctggcagagcagctacccacttttgaagaagttcagtctggacaggcaacct

SEQ ID NO: 65951 - DNA, 129 bp, Triticum aestivum
  Clone ID: PAT_TA_65951
aaaaaatggaggatgctggcatggagttcctgctcgatgccgttgacagatttccattgcgggaggagttcgccgacagtcatcagcacccagatccggttcctctttttttgttggcgaaccccggaa

SEQ ID NO: 65952 - DNA, 116 bp, Triticum aestivum
  Clone ID: PAT_TA_65952
cggactggatggtgtcctctcgagacaacggcagctcgctgttgctgaatcacccggaaaccgcgaatggtatcgagttcttgcagttcaatctcgggcaaatcagcctgatgagg

SEQ ID NO: 65953 - DNA, 269 bp, Triticum aestivum
  Clone ID: PAT_TA_65953
ggatggccgagggtttcttagtgtgtgtgagatactccaccaaataccatgcatggttatctgaaattatagagaatggtacaggtaagaacctaaacttatcttcatttatagtgcttatcttcatttatagtgctaaagatatgtcaatacggggggggacatttaggctcctaaacttgttgaatgagttctatatagggggggtgaagttgcccttctataaattaatactgcccttgctaatctttgttgcattgctattgatg

SEQ ID NO: 65954 - DNA, 366 bp, Triticum aestivum
  Clone ID: PAT_TA_65954
tccgtctcttccgtcccgtcccgctgcggcgtcgacgccggtagccaccacggccgccctccgccccgtgcgaatattcacggcgatggtgttgcagcggagactttgacgacggagcaggcgccaccgccacgaaccaacagtggccgcgtgcgcgcttgtgtacacttctacgtgagcgtggggagggggttacgtccgtcatcgagctgggcgtagtggggggtgtgcgcctgcttcccgttcgcggtgattgagctcgccgtcctagccaccgtgcgcgcgcccgccgcgatgtgccgccgcaccatccgcgagcggcgcatccggcgatgcgaggcccgggccatgcggaagaaggagatg

SEQ ID NO: 65955 - DNA, 103 bp, Triticum aestivum
  Clone ID: PAT_TA_65955
agcgcacagcgtggcggaccgggtgatcgcgtggcggtccatcgccaagcacgcccggcactggcgcgccgcccacttcctcgtcttcaacacctacatctgg

SEQ ID NO: 65956 - DNA, 362 bp, Triticum aestivum
  Clone ID: PAT_TA_65956
aaaaacaaacatggtggccactgcaggagaggagcatatataccagccagtagccaccctgcaccacgcgcatcagttacacacacacatacaccgcaacaaacggagccagtagctagccagctttgatggagagcaggggcagcgcgagaggaggagaccgcgaccacctcgaccaccaccggcaggtgctgctgctgaggccggctgcggcatggagctacgcctccggcggcggcggcatgtcgtggccggcgcagaggtcgccatcgtcttcgtacacgtgcggctactgcaagagggagttccggtcggcgcaggcgctcggggggcacatgaacgtgcaccgccgggagagggcc

SEQ ID NO: 65957 - DNA, 193 bp, Triticum aestivum
  Clone ID: PAT_TA_65957
aacaagcagctcaatcaggacgagttcgacgcgctgctgcaggagttcaagacggactacaaccagacccacttcatccgcaaccccgagttcaaggaggccgccgacaagatgcagggcccgctccgccagatcttcgtcgagttcctcgagcgctcctgcaccgccgagttctccgggttcctcctctaca

SEQ ID NO: 65958 - DNA, 494 bp, Triticum aestivum
  Clone ID: PAT_TA_65958
tttttttttttttttttttttttttacaaaattgttctgatatagaaaacaacatttccatacattgtcatccatcttatttacacattttttttctagtgtgttaaaagggcagcttatcaccgcaactcgggctaatgctcggatatcaagaacaaactaacagtggtaactggcgagatgctctaccaaagttacattatgtatctatagttctatatatggaaaagaactaaggcagggtctaccccttttggaatgctggcaatctgattactaatgtccggcatggatagtgcaattttcttggcactctccaagtagctttggaacttcttatgattgacctcaggcttgtccatcttatctgcaagctttggctgttcattttcgtgcttcaatggttctatgccaagagacaattcctccctcatgagctggtacttgactgcctgtttccgaaaggtccagttgccagtgatccagtccaattt

SEQ ID NO: 65959 - DNA, 388 bp, Triticum aestivum
  unsure (1)..(388): unsure at all n locations
  Clone ID: PAT_TA_65959
caaacattggaaacctattctgcactgcttcaaaaatcctaaaactccacgaaacgtgtttttggaatttataagaattattgagcgaaagaaatacaccagggggcccacaccctgttcaggagagtggagggcgccccccctaccgggcgccccctatctcctgggtcccctggtgggcctccggtgtccatcttctgctntntgagagctttntccctganaaattcgtgggcaagcttacgggacgaaacttcgccgccacgaggcggaaccttggcggaatcaatctagggcttcggcggagctgttctgccagggacacttcccttcgggagggggaaatcatcaccaacgtcgtcatcaacgatcctctcatcgggagggg

SEQ ID NO: 65960 - DNA, 438 bp, Triticum aestivum
  Clone ID: PAT_TA_65960
tcgatctagactttttatgcttgagctgctagtcttgtgttgtcttatggaacactaatttataaatcaattaacaatcttcattgatatcctacatcctttctatttcaaattttattatagtttttattgttatcttggatttttctagtgatttgtagaacttgtcaagaataaattactctaatttgctaaatggtttcttcattagccatatttttggcatgtcttagtttccagtgtttagctctgtggtacactataccatatgcctaacgttcctgcatcaccagcctctgttggaagaaggttgtgaagattcagatatgtatatgtagttatatgatatccatgatataataaacgtatggactagagtatgttatatatcagataaatgtaaaatcccacaatgttagtattagaccacatttttcc

SEQ ID NO: 65961 - DNA, 518 bp, Triticum aestivum
  Clone ID: PAT_TA_65961
caagcaaacacagtctctgttcttcgccgcccaaggataatccaccagacggaccaaggcgaacgaagaaccccctcgccgtagagctggtcgacggcggtgaggcttgtccttctccgtcagtctggcagggtaacatcccaagtagggcaagaggtttttcattcaagggtggattagtcgtagagggcgaagatgtctgacttatttagcgggatccaagcagctatggttatcaatcgagtagagaatagtgagcagtcacctgaagattggaacagcgactgtgatggatccggtggttcaacagtcggtcatgtgcttgcccccactgctaagcacgattacatatccatagacttctgggctgcactgagtgatatcagcaagataaaggattggaattggggaggatatgtactcaagaatctgttccaagctgttaagaagttcaatgcagatgtgtccaagagaaacccaaccgtccacatagttggttgtcatctgttcctgcagct

SEQ ID NO: 65962 - DNA, 108 bp, Triticum aestivum
  Clone ID: PAT_TA_65962
cattgtggccattgttctgggtgatgtcgcagggatcttgatcattgccctggtgttctactgctattggaagaaagtttcccccaaggagaaaggacatggtgcggg

SEQ ID NO: 65963 - DNA, 390 bp, Triticum aestivum
  Clone ID: PAT_TA_65963
ctttgaatcacttggtgaagcattttcccttgaccgccacaacccagatttaatatttgacatgggggttgagtatgctgagcaacgaaacatgcaggctgcactgaaatgtgcaaagcagttcattgacacaactggcggatctgtttctaaaggctggagattgctatctttggttctctctgcgcagcagaagtattcggaagcagaggtggtgactgatgctgcattagaagaaactacaaaatgggaacaagggccattacttagaataagggctaaactgaaagcagctcaatcattgcccatggaagcagttgaagcataccgtgcccttcttgctcttgttcaggcacaacggaaggcttatggatctttaaaaaatggcac

SEQ ID NO: 65964 - DNA, 334 bp, Triticum aestivum
  unsure (1)..(334): unsure at all n locations
  Clone ID: PAT_TA_65964
taattatacccccgcgcgcggcctaatcaaagcccaaatttaagagccattgctgcacgcaacgcagcacgccataccttgcctcaccataccctgcgtcctctgtgttcttcttctcctcctcctcctgtggcaccgcaaccgcagtggtagtgctacagtgctaagcggcgtgcgtgcgtgcctctcgtggcctccgtctcgtctgatctgagcctaacttgggggcggcggcgcggagggaggggatccccgtcgcgtgcangggttgctccgcggctcgaggcggcagccgtcagggtttaccaacaaaactctacccagctatgatgaa

SEQ ID NO: 65965 - DNA, 315 bp, Triticum aestivum
  Clone ID: PAT_TA_65965
gcagtgacaaaacaaacctataccaacgaactgggcctgtcaaaacaaattggcgtgcaagtccaactgcgttctcctcttggccgccgtcctagtctccatctttgccgccgttgccgccatcggcaatgaagattgcaccccatggatgagtactctgatcactccactcccaagctgccgtgactatgtggaacaacaagcatgtcgcatcgaggcgcccgggtcgccgtacctcgccaagcagcagtgctgtggggagcttgcaaacattccgcagcagtgccgatgccaggcgctgcgctacttcatggg

SEQ ID NO: 65966 - DNA, 288 bp, Triticum aestivum
  Clone ID: PAT_TA_65966
ccatcctccctcagcagcccttcgtcatcggggggtcgggcgggacggcctcggggaagaccaccgtgtgcgacatgatcatccagcagctgcacgaccaccgcgtcgtgctcgtcaaccaggattcattctaccgcggcttaaccgctgaggaatctgcactcgctcaggactacaatttcgatcgtggggggggcatttgatacggagcaacttcttgaatgcatggggcaacgggggggtgcattgcctgtaaatgttcctatatatgacttcaaaaatcaccga

SEQ ID NO: 65967 - DNA, 411 bp, Triticum aestivum
  Clone ID: PAT_TA_65967
gttggtcgtgcttgccccttctcaaccgcggctccgctccatccacgcccctgctgctgctgctgctgcaccaacgtcggctgctcttcttccatctccccgttgaaagcctgttgctgcttcatggcttcacctgcctgctaaataaaggtggatctaaagcaggcctccaagagaagcacccacggcgctactctgctctgctttcagctcaggcacagcacaaacataactagagagccaagatagatccttgtccagccatctcagccacagatggttggaataatggtgagcgcttctaccggggtgatgaattctctccttggtaagctggccaccctgatgggggacgagttcgccaagctaaagaacctgaggaaggaggttaagtacatcagcgatgagctg

SEQ ID NO: 65968 - DNA, 190 bp, Triticum aestivum
  Clone ID: PAT_TA_65968
acgtgctcgcagacagatctaccaagcaggcaaagatggtccgtggcgtccattacggcggcgcgtgcgccgtcctcctggccgccgccgtcgcgctcggcctcggcgcccgcggcggcgcggcgcagctggacgacaagttctacgagggggcgtgccccggcgtgcacaagatcgtgcggcgggtcct

SEQ ID NO: 65969 - DNA, 315 bp, Triticum aestivum
  unsure (1)..(315): unsure at all n locations
  Clone ID: PAT_TA_65969
ctcccatggcggcacatggccggtgatccctacaggagttctgctaatgggcggcctgttcgccgccttccctgccgcgtcgggcggccgcgtcgacgccggtgacatgctgatgatggacaggttccggcagtggcaggccactcacaaccgttcgtacctgatcgccgacgagaggctgcggcgctgggggggggaccgcancaacgtggagtacatcgacgccaccaacaggggcggggacctcacctacgagctcggaaagaaccaattcgccgacctcaccggggaggagtttgccggaaggtatgcgtc

SEQ ID NO: 65970 - DNA, 510 bp, Triticum aestivum
  unsure (1)..(510): unsure at all n locations
  Clone ID: PAT_TA_65970
cccgcggaggaggagcccgcgacggagaaggccgagaagccccccgccgcgaagaagcccaaggccgagaagcggctgcccgcgggcaagaccgcctccaagagggcggcggcgagaagagggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccacgatcacctcccgcgagatccagacctccgtccgcctcgtcctccccggagagctcgccaagcacgccgtctctgagggcaccaaggccgtcaccaagttcacctcctcttanattcagtctctggcagctgtagttgggtgctgtttgcccagaattattgttgctcaatggaaatccgtggaatatcgtttagtttgtag

SEQ ID NO: 65971 - DNA, 579 bp, Triticum aestivum
  Clone ID: PAT_TA_65971
agcggccgccgcggcctcggtggcgctgcttgggtcactgaagatggggaagacggagaggggagagaagcgaagcagggcggtcgcggcggcgctggaagtttgagggattggagcgccggcgaaaggtagagcgcagcatcgacccagcctgctgcctgccgccgacgaccacacctcaggtcaggatcactcacaggcaaaccgaatctacaattctggcttcaagtttccaaagaccttgtacccagaatctttgaagaatcaaatcaaggggagaggggagaagacgtcccagcagctccctgagaacgagcgcccacttccctacgtcttggggaagcagaagcgccccgaacccctcgctgattcaagcgacgactactcaagaagtttccttccctcccgcaacaatgacgccaacggctgcctaagttcattgataatatgaaggggagcagcgtagtggttgctgttttctttgtcgggtgcctaatcatggttggacaatgtcgttccgtccccaagagcacctacagagatggccatgacaacgagactatggtggcctcatcctta

SEQ ID NO: 65972 - DNA, 489 bp, Triticum aestivum
  unsure (1)..(489): unsure at all n locations
  Clone ID: PAT_TA_65972
agggtgccgccgccgccgcaaccccaaccggagatgctccctcggcggagggctttgacgcgcacggccgtgtcccgccggcttctgcgccgcgtgtggcccgaacaccggccatcctgcggaatctccctggcttctgcgacgcctgtggacggangaggggaggcccggagcgccngtcatccttgcgaatatctccatggcagagacggtgcagtggtagctgacttctatggtcggcctctgtcgacgtttgacggcaaactggtctggcatatatgaggtgtgttgatggcgtttccctcccantcacctgcaaaatatgtacaactagacaaggtatgaccaatatctttgatgcactgttcgatttgatagttggacttttcgcaagattatagggaacctctgcatcattagtactctaaacaagtgatgaaagttccatttagaacaagataaggattccatactttgcaatcacacatg

SEQ ID NO: 65973 - DNA, 169 bp, Triticum aestivum
  Clone ID: PAT_TA_65973
tgggcgccggcgcgggggggccgcggcgtacaacggcaacctcgtgcggcgcgtgctgtccaggaacgccggcaccccgcggcgccccgacgcggacgtcgacgtgtacctcttcgcgctcttcaacgagaaccagaagcccgggccgacctcggagcgcaactacggc

SEQ ID NO: 65974 - DNA, 115 bp, Triticum aestivum
  Clone ID: PAT_TA_65974
cgcgctccagcatcgacgcatgccgtccgcggcgagctcgagggaggcagaagcgaggtcgaggtgctcctgcacgagctgcccgcgaggccaccgtgctccgtgtccatggcgt

SEQ ID NO: 65975 - DNA, 161 bp, Triticum aestivum
  Clone ID: PAT_TA_65975
gcggtggcatgggaggcggggaaccgctgtccatggaggggtggagtggcgccgcccagccatggagtgcgcgtcaagacctcttacctccctctgccacaccgacgtctacttctgggaggccaagggcagacccccatgttccctcggatcttcggtca

SEQ ID NO: 65976 - DNA, 412 bp, Triticum aestivum
  Clone ID: PAT_TA_65976
cagttgcttatcaaactgaagaatctaaagagtccaatgagctgatgaagttgaagcagcagcttgatgaattcattgaagagagacagagttggattgatgaaatcaaccaaagacaatcagaacttggagctgcccgtattactgtagagcaattacggcaaaaggaacattttatggtagctgaagtggacttgctgaaggtatgacaattaaggtttccactagaaagggaggcacatatttctttctctgttgctatggtaaatgtttgtttgttatattaataggctggtatattgtaggctgagaatgcaaactacaaaacgatcatttttaatcttgaagatgaagtaaagaagcttaccagacaacagaatctccagctacgaattaatcaccatgtcaaaac

SEQ ID NO: 65977 - DNA, 175 bp, Triticum aestivum
  Clone ID: PAT_TA_65977
cggcgcggcgcacggccatggtgtggggcgcgtcgcagagcaggcggacgggtgcggggcgcgtcgggctggcacgaccaggggccacgactctccttggaccgaggatccgggccgtggcccttgctgacggagccacggacgccggtggatggcgggtcgacgcgaccacgta

SEQ ID NO: 65978 - DNA, 411 bp, Triticum aestivum
  Clone ID: PAT_TA_65978
agcagtatgatatgctattttctggagggtcagctgcaaattccacaaggggtaggggggagttcgatggatcctatgaaaatccattttcaagattcaacaaacagaacgactacccttttgcagaattctacagacaaggtgatggtcctttttctaatcagttttacaaagtattctcaaaggtggggcagcatgatgtggatgtacatgccagtgacattgagatagagctgaatctgtcttttggcgaagctgctaaaggatgtacgaaggaagttcccttcagtgcaaagaatctctgttactcatgtgatgggagaggatacttggccaatgcaagaaaatatgtttgcccttcttgtaaaggtgcacgaaaagttagtatgtatccgttcacatccatttgta

SEQ ID NO: 65979 - DNA, 365 bp, Triticum aestivum
  Clone ID: PAT_TA_65979
gtttgctttgccactctttcctgcgtgctctccctctcacctggtgctgccaatatctcaatgcccaccaacctgaagattcaccgcatcatctcccactggtactagtagtatccaccccgtcttcgtgtagctgtgcccgtgcgggattgtttcggagccaccggagccggggacttctcgagataagctgatgtggggggggactcgggcatcgtaaaacagagttctagtgcccctgaccggggagcaagtccccttctcaagttggttttttcgctctgccctgccatgggtaagcctagagggaaggccaagaaatccgctgaggatgcgagggacgacgacgacggcagtggcagcga

SEQ ID NO: 65980 - DNA, 536 bp, Triticum aestivum
  unsure (1)..(536): unsure at all n locations
  Clone ID: PAT_TA_65980
catacttcatgtctctcttgaaattgcagaactacttgcggactttattattcgtacgacagggatttgacattaaacttgcagagggcatcaaagctggctgcggggagggtacataagccgctatggaagcaggttaatattggtttattatttgcattttaatattcaactgtcttattatacttgagttgttacatactcatcaacacaatgaatttgatatgtcccagccacatgagaaacaggttttctaagtcgaccaggttgcacaccatgaagactaaagttgcatagaaatctgcatgtaactttaggtgtagaagggtgcaactacccatagaaatctgcatgtaatttttttttacagatagcaaaactataaaaataacaatataacatattttagaacccaaatatanctggtgagcatattgcatattgcctgtagtatttggatcttttggctactgtctttgttctttttagttttgttattaatcttacatttatgcttactttcaaaatacaatttc

SEQ ID NO: 65981 - DNA, 446 bp, Triticum aestivum
  Clone ID: PAT_TA_65981
gccgtccgcgctggccctctccaacgccatcactaatcttgcagctgctgtgttcggcgaacaacgcaagttggagcccatggcccccgacagaaaggcgaggtggaagaaagaagtgggctggctcctgtccgtggcggatcagatcgtggagttcgtcgccaagaaacaagtcctggacaacggcgtcgaaatggaggtaatgggcacgcagcagcgaagggatctgcagtccaacataccggcattgcgcaagatcgacgccatgcttctcgattacctggacgccttcaaggaccgcaccgacttttggtacgtaaagcgcgactcgtgctcggacgccgagaaggaggagtccaacacatcggaagagaagtggtggatacccatcgtgaaggtccctcccaacgggctgcccccggcgtccagagcctggatccagcacc

SEQ ID NO: 65982 - DNA, 492 bp, Triticum aestivum
  unsure (1)..(492): unsure at all n locations
  Clone ID: PAT_TA_65982
ggtctcggtctcttgcttgccaagacccggctggcgcaattgaattgcagcccacttttcatgtttaggcctgagggagtcgcacgcgagggcctgagggggagcctgagggggagtgttaaacgaattatttgtgtgttgcacatgtgttgatttactagtaggtaccctaaacaattgaactactccataattcaacaagtaggtacgtgttccaaaactagctacgacacgacaggccaaaagctagctggactggactggactgctggagcctggagcgatcgatcccatcggagtgtanccacgttcggaacagctgtgcagcttgatcgctggagagaagcatggtacgtaccatgttgcctgcttaaaccaagctgagcttcatgtgatgcgccgtaccgttttggtggcaacttccgctttaaatactgtgttataaaataatgattctacacacacacaaatgggtatccacaagcacgtgaa

SEQ ID NO: 65983 - DNA, 351 bp, Triticum aestivum
  Clone ID: PAT_TA_65983
aactgatttatcgatcccttctgcaggtttggtatccagtgacaactgcaatggggaaaacatcatttcagggtcctgattgcatcaaagaggtgaaaataggacccagtgaaaagccaatttcaaatttcttcaccaagaaagcaggcgggtcagtgaagccagagaaggcacatggagagttggcagaaacacaagctttcaagaccacaaaagaagagtgtggcgatgattcaggcgaagacccatcgaacaaaacagagcaacaacaacaggcttcttcggagaagcaaagtgccattaagaatgaacccgtcactttggatccccaaattttctataaagccgatg

SEQ ID NO: 65984 - DNA, 395 bp, Triticum aestivum
  Clone ID: PAT_TA_65984
gagtactaaagagcaaggacacttctcgttgccgtgcttcatctgcacactgaaacatgacggccacgccatgtttcccgaagtttctcaagggctggtgagagcaattattggtttggtacacagatacacatcttgtgagggtagaaactttaacagacctgagcctgggagtgcttctcatcagaggggtgggaccggcgaacggcagctcttctcaacaaagcagcggcttaccatagcaggctgggccacagaaattatctgaagacacacaggctacctgctgtgcaacatatctgtctcagctctgactcgaggagcaatggccgaggttgtgattctctcggcagtggcaaagatcggtgtagctctggggaatgaagcaatgaacc

SEQ ID NO: 65985 - DNA, 185 bp, Triticum aestivum
  Clone ID: PAT_TA_65985
cctctcgctctaggggctccatgtaccagtgcgccggagcggctgctcgacggcgaggtcgttaggagaaggctgataagacgacggcgggcgccggagcgtggcgcaggcggagaagtggcgggcgtcagggacggccggcagtgtccgcgtcgacaaccacatttctggcttcagcttcacaa

SEQ ID NO: 65986 - DNA, 190 bp, Triticum aestivum
  Clone ID: PAT_TA_65986
cgcagcgtgcccacgctcaaccccgatagcaatatgtccctcttcgtctcgcgcaccccctcctcccctcccgatcaccccgtgcgtcgccgtgcatcttccccgtccgctcgtcgcgtcgccgtccgcttcctcctcctcgccgtctcggccgccatccgccggcgtcgcgtccctacagacagaccgg

SEQ ID NO: 65987 - DNA, 439 bp, Triticum aestivum
  Clone ID: PAT_TA_65987
atcgccgccgcggggctggctgctctccgcgaccacgcccacggacacgacggaggcgcggcaccgccggcggcgccagactcgcccttcgacaccaacgtggtgatcatcctcgccgcgctcttcttcgcgctgctcttcgccatcgggctcaactcgctggcgcggtgcgcgctccggtacgtgggccgcggtgccgcggcagccgccgccggcgagggcggggcgacggcccggggtgccagccgtggaggcagcggcatcaagaggcgcgtgctcaggagcctccccgtggaggtgtacgggtccggggaggtcatcgacgacgtgtgcgccatctgcctcggcgagttcgtggacggcgagaaggtgcgcgtgctgccacggtgcgcgcacgggttccacgtccggtgcgtcgacgcctggctggtgtcccatg

SEQ ID NO: 65988 - DNA, 166 bp, Triticum aestivum
  Clone ID: PAT_TA_65988
gcccaccccgtccatgctacccgacttcatgccccttccgcgacctggcgccctctgggcaacacctctgcgaatccagtcgcatgggccccccgcgactcctcccctctcccgagacaacggccctgtccttcccgcatcgcgattcatgctacgaccgctacat

SEQ ID NO: 65989 - DNA, 509 bp, Triticum aestivum
  Clone ID: PAT_TA_65989
gcttcagtcagctgacatgcctgccctcgccaagcccgctgcccgccccgccaagcccgccgccgcggcgccgaagccgaagcccgccgccgccaagcccaaggcggccgccgctggagccgcccacccgacctactttgagatgagggagggggcgatcgcggcgctcaaggacaggaccgggtcgagctggggggggggcgccaagtacatcgaggagaagcacggcaaggctctcccgcccaacttcaagaagatgctctccgtccagctccgcgcttccgccgccaagggcaagctcgtcaaggtcaaggcctcctacaagctctccgacgccgccaagaaggactcccccaaggccaagcccgcggcgaagcccgccaaggacgccgccaagcccaaaaagaaggcggccgagaagcccaagaagacggccgccgttggcaccaagcgcaaggcgccggagaagaagaagctggtcaccaaggccaagaagtcgccggctgcca

SEQ ID NO: 65990 - DNA, 415 bp, Triticum aestivum
  unsure (1)..(415): unsure at all n locations
  Clone ID: PAT_TA_65990
cgccatctcatccgggtaaacctcgtagccgattgatctctcattatcagtgattctcgcagcatttgatctattcgcagggaggtgattaccaggacagaagaagacggcgaaggaaggccgatatccatggccgcgagtgttgaatccggtgagggcacattcccacagccaggagctttggtcaacttanctacgcggggggcatgaagcacatgttggtcctcccacgacggctggtttagaacatcggttttggtaactatggtgttgaacaacttacctatgcttctctaaatcatcatagcgtatggttcttaaaaatgttgatacaaaagtatgatgtgcagctgggaagagtctcatttcgacctgcagcaatgtttgaactgtggaacagaacgtgattgctgcc

SEQ ID NO: 65991 - DNA, 373 bp, Triticum aestivum
  unsure (1)..(373): unsure at all n locations
  Clone ID: PAT_TA_65991
gcacttcttgctagatggggcattaattattcatttgctgaatacaaagcttcggccaacgaactggaaccaataaggcattatctttctattgagcgtgaggaggaaaagaatttcgatgatgcgcctgctgagaaaaagagattgggagtgacgagtggtctggtgtccttctaagaattangaacaatgcgagggtgggtctgggtattatttgtcttcagctgccatttgagttggcctatgctcatttgtatgaaaaaactgaaactgaggcgctgaggtatgtcttgactgcactatatcttgttgcaattcagtattatacaacgattggtggaaaggtgtctgtcattctaataaagtctgaaaa

SEQ ID NO: 65992 - DNA, 499 bp, Triticum aestivum
  unsure (1)..(499): unsure at all n locations
  Clone ID: PAT_TA_65992
tctggtgactccgcgtttcctctgtgcccgcgcgactccagcggcgtcggctcgtccgtctgccacgcgccggcaccgtcgtgttcggatcgcgtccgcttcaactcttgatgccagtggaggcggtcatggatggcaagcggctacgcctccatgatgcgggggcggggcatccggcgtcgccgcccggcaagcgtcnccgcgacggtggtgaccacgacttccgcgcaagcaagaagcaggcggccgcttctgccgtcccgcaactttcctgcgccaggatcaggccgtacgtgcgtgcgtcgcgccccaaggaggagcagacccaggtcatcgccggcggcaactcccaagtcgtgattacgaagcagaacgccgacaagcgcacctcttgcatcggagggaacatggcggcggtgcatgcgccgcgccccacagaggcatcgacccaagtccgagcccgcgccgtcgcagtcgcagacaacgtgatcaacaagca

SEQ ID NO: 65993 - DNA, 423 bp, Triticum aestivum
  Clone ID: PAT_TA_65993
ggtaggttagaacttgtaagcgtggtaatcaagccatctaatcagctcaagatcacattcctagaggcggtgcaaaaatatactcagctcgaacaattaaagttaaggatcaggagggtatcaggacgtattacttctatgaatgggggggggacagacaacatgttgctctaatggccaccgtggatagtggggggggaaaggctgcgtactataaacccaaagtggtcggacccttccccgaccctgcgcaagcgggagctacatgcaccgggctgcccttttcatcatgcattttgtgttgctactttctttagtccttgcagctgtattctagattcttaaactataaatttatatcctactaatgtccccaagcattcatccatctgttcgttccttcttgaatatggcgtgaaccga

SEQ ID NO: 65994 - DNA, 413 bp, Triticum aestivum
  unsure (1)..(413): unsure at all n locations
  Clone ID: PAT_TA_65994
cggccactatctgctcgctcctcccgcggggccccgtggtcctcgccggcggcggctcctcccagcggttccccgtcgtcctcgacggcggcggctagggactgagcgtcctgcgtcgttccttctgcctgctaggacgagcagtggatcgaattaaccacatgccgttcgccggagccatcggggtgggcgtcctcttgcttgtcccctgtgccaaggccacntcnggggggggggtgatcgagcagatcttgtctgacaaggggtgtggtgccttcgccggcctcgttgccaccacggccggcgtgggcgaggtgttccgttcctttttagagaaggaggctgaaacccccgacgtgttcgacgtgttcggtgagaagagggcccgcaatgcggggctcaccattttctgc

SEQ ID NO: 65995 - DNA, 217 bp, Triticum aestivum
  unsure (1)..(217): unsure at all n locations
  Clone ID: PAT_TA_65995
tagaaattcggactagttaccagctcaccagcaaagtttcttctttcacttgagccaaaagccaaaaggaatagaaaagttacagtaacattccacatgtgagatgtcactacttgttcgattttttgagactggtctgcccactgatgtaggaccctctgttnctgacgtcattttgcaaattgctgcataattaggctgctgctcccagtgattt

SEQ ID NO: 65996 - DNA, 236 bp, Triticum aestivum
  unsure (1)..(236): unsure at all n locations
  Clone ID: PAT_TA_65996
cgatattctctctctctctttactttattacnatatacatctttcctcatctttcctctataagtgcctctctgacgcttctatagtgctaatcctctaatgctatagtaaagatgatgcattaacacggtgtcgtacagcaacgtcagtagagttctggtactcctgtctcattcgcgagtatcgttacatcatatgacatagccgagacatatgtgtgcgagtgtactccgact

SEQ ID NO: 65997 - DNA, 680 bp, Triticum aestivum
  Clone ID: PAT_TA_65997
gcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagtttcgacgttggtaacggggtcatggtgactgtcgggccgcacaacttggcgtggtgggttgatcaagaacaggt

SEQ ID NO: 65998 - DNA, 673 bp, Triticum aestivum
  Clone ID: PAT_TA_65998
cggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttgggatctaatgcttctgggtgtttgagatacacatacataagcatcaagatatctggtgggtgaaacaat

SEQ ID NO: 65999 - DNA, 799 bp, Triticum aestivum
  unsure (1)..(799): unsure at all n locations
  Clone ID: PAT_TA_65999
ctccgacaccattgacaatgtcaaggccaagatccaggacaaggagggcattcctccggaccagcagcgtctcatcttcgctggcaagcagctggaggatggtcgcaccctcgctgactacaacatccagaaggagtccacccttcaccttgtcctccgccttcggggaggcatgcagatcttcgtcaagaccctcaccggcaagaccatcacgcttgaggtggagtcatctgacaccatcgacaatgtcaaggccaagatccaggacaaggagggcatccccccggaccagcaacgccttatctttgctggcaagcagctggaggatggtcgcacccttgctgactacaacatccagaaggagtccacccttcaccttgtcctccgtcttcggggaggcatgcagatcttcgtcaagaccctcaccggcaagaccatcacgcttgaggtggagtcgtctgacaccatcgacaacgtcaaggccaagatccaggacaaggagggcattcccccggaccagcagcgccttatcttcgcatgcaagcagctggaggatggccgcacccttgcggactacaacatncagaaggagtccacccttcaccttgtnctgcggcttcgtggtggcatgcanatcttcttgaagaccctgacggggaagaccataactctggaggtggagagctttgaaaccattgacaatgtcaggggccagatccaagacaaggagggcttccccccggaccaacagcgcctgatctttgttggcaagaaattgaagaaaggccggacccttcgg

SEQ ID NO: 66000 - DNA, 863 bp, Triticum aestivum
  unsure (1)..(863): unsure at all n locations
  Clone ID: PAT_TA_66000
ccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactggtggttttgaggctggtatctccaaggatggccagacccgtgagcacgccctccttgctttcactcttggagtgaagcagatgatctgctgctgcaacaagatggacgccaccactcccaagtactcaaaggcccgttacgaggaaattgtcaaggaaagtctcatcgtacctgaagaaggttggctacaaccctgagaaggttccctttgntcccatctttgggtttgagggtgacaacatgattgaagaggtccaccaaccttgactggtacaagggccctacccttcttgangcttcttgaccagatcaatgagcccaagangccctcagacaagcccctgggtcttcccttcangatgtttacaagattggngggcattggaactgggncctgttggaccccgttgaaaatggnggtcatnaancctgggattgggttggtaacctttggccc

SEQ ID NO: 66001 - DNA, 896 bp, Triticum aestivum
  unsure (1)..(896): unsure at all n locations
  Clone ID: PAT_TA_66001
ctcattagtagagtgcatcatttaagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttctgcagccgcaactaccatattcacagccacaaccatttcgaccacaacaaccatatccacaaccacaaccacagtattcgcaagcacaacaaccaatttcacagcagcagcagcagcagcaacaacaacaacaacaacaacaacaacaacaacaacaacaaatccttcaacaaattttgcaacaacaactgattccatgcatggatgttgnattgcagcaacacaacatagcccatggaagatcacaagttttgcaacaaagtacttaccagctgctgcaaagaattgtgttgcagcacctatggcagatccctggcagtcgcagtgccaggccatncacaatggtggtcatgctattattctgnatnaacaacaaaaacaacaacaacaaccatcggccaggctcnttcaacaggctntgnaacaatatccattanggcanggcttctttccgggcatttagcaaaanccacaggnccagggcttttnncaggccttaacaactggcccagtcgagggaaataaggaactaacgctcagacgttactgnaatgggcaatggctacatccttcatatggaccattgggcctttgg

SEQ ID NO: 66002 - DNA, 206 bp, Triticum aestivum
  unsure (1)..(206): unsure at all n locations
  Clone ID: PAT_TA_66002
ctctctctctctctctctctctctctctctctctctctctgtntctctctcnctcncncnctctccncgtgccgaantcggcaccaggccttcaatttcgagttncaccgcccgctcncgcacagnaaaggcaaccgaagccgcgagaggagccatggcccgtaccaagcagaccgccgcaagtccaccggnggcaaggcgccccg

SEQ ID NO: 66003 - DNA, 714 bp, Triticum aestivum
  Clone ID: PAT_TA_66003
tggaggagttagccgacactaaaaactccatgtcgcagcatcttcatgattccgacattacgaattccagcgattccaacagccaatgtattcagtcatcgcggcctgatccagaaccctcgacagatattattggggacatctcatatatcagctctgctgagtcaacttcaggtgatgggtttgatgggtcaaatattgctgctgctccagaaaagttaaatacgcataaaaaggaagcatctggcaagaaatttaaagaaacttttgatgatgaaacgcacacggggactaggatttctctaaaccctcagaccatactaatttcgatgtccagccaaaacatcaggaataaagcagtttgtgagcagagtcatctttccaggataacttattatgggaattgtgacacatctcttgggatgcatttgcaagatactttacttaatgagaagcacaattgcttatcatgtggtgagcctccagaagctcacatgtactcttacacccaccatgatggtaccctcactgttcttgtgaaaagccttccattggcggaagcactatccggtgagggtcaaagaagaatttggatgtggaccaagtgcttgagatgccatggtatgcccacaccgagggttataataacttcctctgcacgcaacctctcgtttgcgaagtttttggaacctaaggttttaacacattcttctg

SEQ ID NO: 66004 - DNA, 777 bp, Triticum aestivum
  unsure (1)..(777): unsure at all n locations
  Clone ID: PAT_TA_66004
cgcaaatccaccatgaagaccttactcatcctgacaatccttgcgatggcaataaccatcgccaccgccaatatgcaggtcgaccctagcggncaagtacaatggccgcaacaacaaccattcctgcagcctcaccaaccattctnccagnaaccacaacaaatatttccccaaccccaacaaacattcccccatcaaccacaacaacaatttccccagcctcagcaaccacaacaacaatttctccagccccgacaaccattcccccaacaaccacaacaaccatattcccagcaaccacagcaaccgntcccccagactcaacaaccccaacaaccatttccccagtccaagcaaccacaacaacctttttcccagccccaacaaccgcaacaatcattcccccaacaacaaccatcgttgattcaacaatctctacaacaacagttgaacccatgcaagaatttcctcttgcagcaatgcaaacctgtgtccttggtgtcatccctctggtcaatcatcttgccaccaagcgattgccaggtgatgcggcaacaatgttgtcaacaactagcacaaatttctcagcaacttcngtgtgcaggncattcatagcgtcgggcattccatnatcatggcngcangaacaaccaggaacaactacagggngngcaaaatctgggtggccaactgtttnaaaaggcaacaaggnggggtnaagggatttttcggnccagggttaanggnttgaattcaaccttaaaaaaccaaggttaa

SEQ ID NO: 66005 - DNA, 642 bp, Triticum aestivum
  unsure (1)..(642): unsure at all n locations
  Clone ID: PAT_TA_66005
ctaaacccaccaaaactaaaactagaggagcaaaccaaatcaacaggacgtcaaacatcttcaagtccaacgccgggacacaacgatctagcaagatagcgccttcaagaaggggaacgccgttgtgacgccgtcgccattcgatccggagaaccggacctagggtttcccctgctgctcgacgagggtcacatatcaaggccaaggcagcgcctccaagaagaaaaatgacacccacgagtgtcgccgctgccagcatcggcaagcccatcgtggatttgcctggcctgagtctgagcaatcccaaagtcgccagatcaggatccgacgacgacgacttggacgggtaccttgtgcgtacaaagacgcctttcccatgatggtgtattgtaggtgtgacgatgagtagtgtgatgatttaccatagaactgtttttagttatctagtgtgatgtcgntttaatgttaaatgttgaacatttcctattagagttagaaattatgaaatatgcaataatgntacggaattaaaaatttcaggtgtctaaaaacttattattattattttcgaacaccaacttttacatnctctattggagatgctcttccccagcagacccacccgactgagctttgggtcat

SEQ ID NO: 66006 - DNA, 255 bp, Triticum aestivum
  unsure (1)..(255): unsure at all n locations
  Clone ID: PAT_TA_66006
gttttttttttttttttttatgtagacaagacatgtgtttgtcttttattcccaagtttgaactagtatagttcgggttcttacatgatagtgcatgtcactttattttttcactgctacaacgaccaaaccatggactaagaaaacggggnttcatatatctagtactagagttcttctcttctcagttggtaccaaagatgccaaatggcgcaatggtggtcgagcaatgtggagggatgtagacattgcaca

SEQ ID NO: 66007 - DNA, 617 bp, Triticum aestivum
  unsure (1)..(617): unsure at all n locations
  Clone ID: PAT_TA_66007
ccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcggccccaacaccaacggctcccagttcttcatctgcaccgtcccctgcaattggctcgacggcaagcacgtggtcttcggcgaggtcgtcgagggcatggacgtcgtcaagaacatcgagaangtgggctccccgcagcggcaccttgttcaagcaagtcgtcatcgccgactgcgggcagctntaaatccgttccgcccccggtcgcctgtcgtcgtcgcccccgtgtccgtgtcgtcgatctaaataaganaancngtgtcgggtcgggtnttcccttgtcctccnatgagatttccggggttggtttaaganggttttagggggactttt

SEQ ID NO: 66008 - DNA, 553 bp, Triticum aestivum
  unsure (1)..(553): unsure at all n locations
  Clone ID: PAT_TA_66008
caacaactagtcccccaaccccaacagccattatcccagcaaccgcaacaagcatttccccaaccccaacaaacatttccccatcaaccacaacaacaagttccccagcctcagcaaccacaacaaccatttttccagccccaacaagcattcccccaacaaccacaacaaccattccctcagactcaacaaccacaacaaccatttccccagcaaccacaacaaccattccccagactnaacagccacaacaaccatttccccagcaaccacaacaaccatttccccagcaaccacaacaaccattccccagactcaacaaccacaacaaccatttccccagcaccacacaaccattccccagactcaacaaccacaacaaccatttccccagttccagcaaccacaccaaccttttcaccagccccaacaacaattcccgcagccccancaaccgnaacaatcattcccccaggaacaacggaccggtcattcagccattttttacaacaaacggttggaacccatgcaagaatattccttttggcaacca

SEQ ID NO: 66009 - DNA, 827 bp, Triticum aestivum
  Clone ID: PAT_TA_66009
ccgcggtaggcgccgccgccgcggccgctgccgcccaccgccacctcctgtagccgcccaaacatgactccgcctccgttataacccccctccgcctccgcctccacccctgcccacccccgcctcgccatcaacgccatggccccgccttctccccccgcccacgcggcccggcgcgtgccgcccccgtgctggacccccgaggagaccgtcgcgctcgcgcgcgcctacaccgcgcgccgcctcgccgtcggccgcgcccacctctcctccgccgactgggccgccgtcgccgcggccgccaccccgtccaagaccgccaggcagtgccgccacaaggtcgagaagctccgccgccgcctccgctccaagcgccgccgcccctgccccatcctggacggcatagatctgctcgacgacccttcgtcgtccccctcccgctcccactccccgtccccgccgccgtccgcctccccgcttcccccctctccctccccacccaagaagaggaagcggcccgatcccgatgaagaagggtatgccggggagagcgacgtgtcgcagtcggtgaaggcgaacgcagagggattccaccgcgcccagctgaggaggatgtagccgctcaggcactcgcacttgatgccacatgcagatgtccgctgggtgacctagatccgcatcaactgaatatctggaagacccccaatatccgaacagtccgaccccactggaaacacagcgataaatcccgcatataatctctataatctctctaaaatcaccattaacatacccaactactcgcgctataacacctgcgcttaccg

SEQ ID NO: 66010 - DNA, 799 bp, Triticum aestivum
  Clone ID: PAT_TA_66010
cgtagtattgcctgcggaaagaggggagatagggagacacacgcgggcgacggcgatgctgtcggcgcggagccagcggaaggcgtctgtacagccgtgccttctattcgacccctcgcccggttgcctccagcccacgcgcctcgtcgttcacgtgcgtacgcacgccgacgcacagtatctgttgcgcacacctcttctcgcgcacgcctccagaaccctaaaccctcgggtctaatccctcccctctcctgccccctgtcccaggtcaatggcgacggcggatcctgctccgcgtacttcggctccggttgccgcgtctacaagctcgagatatccatggaagaagagatgctgtccagaggaaaagagagcctgtcgattcctatcagtgcgcaggtcataagctcgtcggttgcggaccgctgcccgcatcaatcggagattcaaagtgtaactcctggctgaaggtgaaggtgatagctgcttgattttgggaactgtcgacgcttacgggcaccttattgtatccccgtatgaacactgaggccagaggggcgtccttattaaaaccacctcgtgatagcggtgtcggagaaagaagaagtctgggttgcggtttaagtcaacacaccaatccacggtagctgttgcccgagaatggggatgcagcatgcgtttctatgatcaagattttcatattcgggggttacgttatgggggcccatctcaataacggtttgttcaaggaagtgcaagcaacttcgaaattgacaaaaacggagggtttcagctgcac

SEQ ID NO: 66011 - DNA, 857 bp, Triticum aestivum
  Clone ID: PAT_TA_66011
agcgtgtgttcgttcttccgcaacctcatcgaattcaagagatcaagtcgctgtttccagctgccaccatgcataacgaggggggtgacatggaggacctttacgttcccagcaagtgctcgggcaccaacaggatcattacggccaaggaccactcctttgttcatagcaatcttggtaatggagttgataatggcctctatgatggccgctttaaccccatttgtatcttatgggttcctctcagcacatggtgatgctgttggcttccattacgtgctgtggccaaagtattaggctgaaatcactcacgtcttcaacgactgtagtctcgtttccatgacatcgtttctttaccatgtcaaaataacatttggattcattcgtttgattttacctgcatctttacaattatttcagtttgttcaaatcgcttgctttaatcgaaccgagtgtttgatatggaacgggctcgaagtgcttcatcgattataactagtttccattccctttgattctataaacctgattgcacccatatttgtatcgcttttaaccttattgcatcttattcgtttctattctcattgattctgaagtggtttggaatttatcgataatgtttggtttctcacatcgtaccgaattgtattcctcctgcgatacgtattccaattcggtattcatattcatattgaacttaactattcattcgattcgcattcagacatgtattcggtcttcaattctgaatttgtatccaacattcgaattctttaatcaattcgtacaactgctaatttcgctccttatctcgtctacgtgatttcatacactatgaatcgtgatatcgcaat

SEQ ID NO: 66012 - DNA, 685 bp, Triticum aestivum
  unsure (1)..(685): unsure at all n locations
  Clone ID: PAT_TA_66012
gcaatactagttaacaccaatccaccatgaagaccttcctcatgtttgctctccttgccattgcggcgacaagtgccattgcacaaatggagactagccgcgtccctggtttggagaaaccatgggagcaacaaccattaccaccacaacaacaaccaccatgttcacagcaacaacaaccatttgcacagcaacaacaaccaattattatactggaacaataaccattttcgcagcaacaacaaccagttctgccgcaacagcaactcaggtattatactggaacaaccaccattttcgcagcgacaacaaccagttctaccacaacaaccaccattgtcacaacaacaacaacaacaacaacaacaacaaccaccattttcgcaacaacaacaaccagttctaccacaacaaccaccattttcacaacaacaacaaccaccattttcgcaggagcaacaaccatcttcacaacaaccacctttttcacaacaacaccaacagtttccacaacaacaaatacctgttgttcaaccatccgttgtgcaagcagctaaacccatgcaaggtgttnctcccacagcagtgtagccatgtggcaatgncgcaacgttttgctangnaacaaatgtgggaacagagtattggncatgtgatgcaacaacaatgttggcaacagctggcg

SEQ ID NO: 66013 - DNA, 667 bp, Triticum aestivum
  unsure (1)..(667): unsure at all n locations
  Clone ID: PAT_TA_66013
aggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgacttgcggncaagntcttanatccgnccgccccgncggtcgcccgtcgtngtcattcgcccccgtgtgttcccgtgtcgtgttcgtcgatctaaataa

SEQ ID NO: 66014 - DNA, 819 bp, Triticum aestivum
  unsure (1)..(819): unsure at all n locations
  Clone ID: PAT_TA_66014
cacacaactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttcccagcaaccacaacaaccatttccccagactcaacaaccccaacaaccatttccccaacaaccacaacaaccattcccccagactcaacaaccccaacaaccatttccccagcttcagcaaccacaacaaccttttcccagcccaacaacaattgccgcagccccaacaaccgcaacaatcattcccccaacaacaacggccattcattcaaccatctctacaacaacagttgaacccatgcaagaatatcctcttgcaacaatggaaacctgngtattggngncattcctntggncaataatctggccacaaagggattggcaggggaggcggaacaatggtggcaacaactagcacagattcttaacaggttcagggngcagccatccanagcgngggcatttcattattatggcggnggcggnnggaacaacaacaacaaccaggggtngc

SEQ ID NO: 66015 - DNA, 885 bp, Triticum aestivum
  Clone ID: PAT_TA_66015
gaagaagccccgcgccgccggcgacggccagggcggcggcgaggcctccggcagcgtcggaggaggcctggtcgacatcctccccgaagcgctcctggtggaggttgttggccgggtggggctagaggccgcctgctccgccgcagcatcctgccgcgccctccgaggcgccgccggcgccgccttatcctccgtcgcatccctagacctctcggcgtttacgccgacgaatgctatcgcgaataggattcttgccggtaatggcaggctccgcagcctcgccgtcaattgcagcctactcaacgactccgctgtcgctgctattgcgaaggagagcctccgcgagctctcgctgctcaagtgctcgtccttctccccgtacctctttgtggtgattggtgagaggtgcaccaatttgagatcaattacactggagatggcaaacttgaatggcagtgaacattttgtgatctgccgtaagtccatagcacatatgttcaaaggatgtgattacttggagaatctgtcgctgaaattttctcttctagcttcaggctctgttgattttgattctttggtgcctattatgcctagtaccatcaaggtactattggtaatgcctggggccaattgggaagcaaaagaaaattttcccataagcgcatttttgaagacaccctttagtgacagtctaagattaactgggttttaggtttggacattataacagattgaacttggtaaccttcattactaaaaagtctttttaacctttctttgactttttcctagaaagaacacccttggaagtgatagcaaatctgggacattggatcttaaccaattttgggtcttgcaagcactttggtttatttccagaaattt

SEQ ID NO: 66016 - DNA, 841 bp, Triticum aestivum
  Clone ID: PAT_TA_66016
agcttcagctcaaagatcatgagttcttttgggacagcaatatgaagaagattttctttgcctatgatgtcccccaaatcttcaagaatgatgcagttaagcaaaaatttcaggaatcttcatctatgccgtcattaccatggacgacatcatggaaacctggtgtgatacctgatgagcttatgaaacatatgttgatttaccgcggagagcatggacttgcaccatacgatgcatacaatgtggaagagtttctaagaatcattagtgggatgtattctcatgagaatgaactcaggcagaagaatcctggcctcgttcttgatggcttgagttaggagatgtatcccgggttgggggatgatttaaaaaaaaccatgcgagaagccaaggaagaagctgataatggcatggcagtgggccatttacgaggaaaaaggtgcggcgtctcacttccttcccagggggccaggccgggtccctaccaaccccgcggaggaaaaggcccctgaccctgccctgccttgcctttaggaaggcccgcagacttttaccttcagttgcgtggcaaatctgagcttggattatctcatgcgggccccacctttggttgtgtcctgtggaccccatacgattgcttagggcccagatcgtcccttggctgtttcgctcaagggaacttgctctcccccatgctgaaaccctgaatgcctgtcgcgcacaatacggagatcgggcgtcttgctatacccaatttgcgcaaatcgccattgctctacattccctacttgcaaaactaggcatattctgacacaggttgaaaatggtgatctcgcaaccc

SEQ ID NO: 66017 - DNA, 845 bp, Triticum aestivum
  unsure (1)..(845): unsure at all n locations
  Clone ID: PAT_TA_66017
gtcgcgtgctgtggtatggcgccgcagcggcctcgggcgctcctccgacgaccgctcccctcctcgtaaccaccgtccgtacccatccaaaccccgcagaccaccacggccgccacggcaagcgtaggagcagcctctctctcctcgattgggtcagccatggcggccgcacttctcgccgccgcgccctcgcttctcccgccggcatcctggagacggaggcctctcctcgtggccccgccgcccgctctccgccgcctcagggctccagcctccgctcctccccgcagagctctcgcccccgtcgccagagccgcgcgcggggcggcgcccgcgcgaggcggcggtgaggcgacggaggggctgggccaggcgccccgcgactggggcgctctcccgaggcgtctggtgctgttcgcgctcctgggatccgctgctctgctcggctgccgcggcgcggcgctcgcggcggccgaggactccatcaaggcgtccgggttcgggctgcgggtcgcggcgtcnctgcggagcctcggctggcccgacgacgccgtcgtgttcacgctggccacgttaccggggctggagctgcggngagcgattccggccgggtattggatgcgcctttaacccggtcggctcaccgtcctggcagttttgggggaacatggtgcctgggccattcatcaatctttacctgaaagaaactcgcaactttcctcttgccaaagaaccgcttggggccaaccggataatggacctccttttttaagcgggcgccacggaagggttgctccccgtcagggagtttcagtgggtttgggcttattgttgatttggtcccc

SEQ ID NO: 66018 - DNA, 648 bp, Triticum aestivum
  unsure (1)..(648): unsure at all n locations
  Clone ID: PAT_TA_66018
ataaatggtcaggagattgatcacggtcatcgtcaatatcagatctgtaagactcgaaagagatttagtaagagtgtgggctagatctagagagtacagagtgagaggatgtcgacaagcagtggcaagccgctcctcgtcgtgatccgccggagcaagctctccgtaggagatgagggccgccgcatctgcacagagttcaagcaggccaagtaccccttcaagtggagaaggtacatgtgcgctaggtgtggggtgctccgtgaggagcacaacgcctgcaagagcaagctctccgcaggagatgggggcaagcacgacaccagcaagagcaagctccctgcangagataagggtgagcaatccactgacaagtacaagctctctgcanaagatgaaggtgagcgcaacgccaacaagagntagatatctgcaggagaagagggcgagcgtttctgcaccgagttcaacaggccaagtaccccttcaagtggagaaagtacatgtgtgccaagtgcggggtgcttcctaccgagcatgccgtcacaaggccaaggcaaagtggacacaacccgagatttcaggagaggactgcccccccagaggctatctaagtcaaacgcccgggcttgtgttgttgtttgccac

SEQ ID NO: 66019 - DNA, 637 bp, Triticum aestivum
  unsure (1)..(637): unsure at all n locations
  Clone ID: PAT_TA_66019
cccacccgaaggcgagcctctccctgcatttatcaggataggtggtttcgatatttccttcaaacatttcagtaatgggctcaaaaagcgcgcacatttgaacaatgaggtgatgtcactttacatcgaaagtttcaacattgagcagacgtacaactcaaccaagccaaggaagtttgcgttctcaccacatgttgctaccaagctttgtgttgatccaagttcattcaagacaagttcctgcattagagatttgaccagggtctgcgagaagaatgacatcgtgaaatttgatcaattgttcttcaccatagtccagagagaccattgggcagttgttgttgtcaatttcatgaaaacacaatttaatgtctctgactccaggagcttagaccctgactacgtcagcatccttgagaagccttgctgcaacctgataacaaacttcaaagcactggtcacagaatttaacccatggaagcaggattttgcacatttcaaagtccaagcaacaagctacccgcacagtcaacataattgattgtggatctttgtattcatacctggaaantaactgccggggatgagcctttaatcaatcaaactatggtcatggcggaatcattcggaaactttn

SEQ ID NO: 66020 - DNA, 612 bp, Triticum aestivum
  Clone ID: PAT_TA_66020
ctgcgccagctgctgctcctgcgtgctcccgccgtcctcgccgcgcgccgccgaccaagagatggcctccgacggcgccatcacgcaccgcagcgtcgacgtcaacggcgtgcgcctccacgtcgcggaggccggcccggccggcgcgccggtcgcgctgctgctgcacgggttcctggaggtgtggtttacctggctggacctgatgctcgctctgtgtgcagtggtcttctgtgccttgtcctttgattgcatctaatttgctttcatttggctttcattaggctatccaatatgatttgatattgttgtagatcctatttgatttaattttcgcttggatttcaggtctaagttatctgaatttcttgtcttatcttccttggatttggcggttgatctttctcctgtaaattggactctaatattttgtttgttaatattttcatttaatacattgcaatcgtccacttttcatagtggttaaatttggctcttttataattttcatttgtgcattttgatatatgtaattttgggctgttaaatttgtccttgttcaattattctggtttgattatgttacaatttataatttttcctctttacacg

SEQ ID NO: 66021 - DNA, 613 bp, Triticum aestivum
  Clone ID: PAT_TA_66021
ctccaacccgcgcctcgcgcacgcgccgcacgcccgcacgcccgcgaagaccgatgtcaatgtggcgcttctcccgcccgctcctccgcgccgccgtcagcgcgggcgccccggccgccgcgccgtcgcgcgcgcgggccgtcgccttcgccgcggcgtgctggctgcccccgccgacgtatgagccgccgtgcggactcttccaggagtggttccgattggcgtcaatgccgtcggttgtagcggtcgtgttgagggctcttgttgccgatgtgacgagtgaggatgttcggttgcttttattgattgcgtacttggatctcctaaagcgtgagtaaggtgtcggttaatgaggactcatcttggatgtcttgtcaattagatgagtcttgctttctttcccatggagtgtttgtactatctgtgtgaacatatagggggctagtgatgtttttattttactcggagtttttgatggttgcaaattactaatggttggtgtgtttctttactatttgttgacatgtatattctccattggaactttctcgtttctaaatagtgggggcgcgaaatctctataattggatttgtcttgtatattagtatataa

SEQ ID NO: 66022 - DNA, 690 bp, Triticum aestivum
  unsure (1)..(690): unsure at all n locations
  Clone ID: PAT_TA_66022
catttgcaggcaacaacaaataacacaatactccagagtatatcttaatgcagctggtgtaggggttattgataggattatcagctactccagtgttgtcatgtttcttgcttcttacatatttgtacttttgattgtttttacgtttgatcaaaaggtttcataccgaatattaagaaatttgtttacatctatggttgtgattgcatctgcttgcagaacggtcaattttaaattatctatagaaggctgtgtacatgagaggcgtggcatgctattggaaattatagcatactgtatatggcttctaagcaatttgaaagtttaggacacaataggaagtcatattacgatggtttccgattattgacaaatctctatttttcgagggcagcaaaattattttctagaactgatagtttcttcagcaattttttagtttgcttcgtgatactttataactgaatatgaatatgtagntagcttatttttcttttatgtgatatgtgaggtaatagcaattagctgcctgggttactgtgatttcaaacttcacttttgggttatctaactgcagtggtaggactggttggtggcccaagagaagaaatgaccattcgtttatgggctttttgaccttgatgtttctggatgggagaaaagaatttctcggcaggtcaccggggtaat

SEQ ID NO: 66023 - DNA, 669 bp, Triticum aestivum
  Clone ID: PAT_TA_66023
cccaaatgcccaaaccctgagcctctccgtcgaggtggcgcgggcggcggccaacaccagccctccatcccggttccggcctctccccgtgccaccccccagccgcgtcgagcgagcgcggtgaccgttggcaaggagcggcgggcgaatcttgcggccaaaccgtccgtctcgccagtcgccggccatggagaaggaggccccgcgggccgtgcccggcgagagagagtacagtggaatctcggcgcaacgggcgcggatcggcgactgcggcgagaccgaggacgatttgatcagcaagctccccgacgcagtactttgcaccatcatatacctcctactcaccaaggacggcggacgcacgcacgctctctcccaccggaggcggcgcctgtggcgcttcgcgcccctcaacctcgaggtcatcatttggcctacagacgacaccatccccactcactccgtctgcaacatccgccgttgatacatacatatctacgcaccacggatgaggcctggcgagactaatttcactgactactgcacgactatgtcatcggcgacacgcataatgtggaatgatcttccgggcgacttgatagcctcgatgatgcatgatgccatgtagcgaacacctaccactggtgtcctcggcggctccgagtgggc

SEQ ID NO: 66024 - DNA, 673 bp, Triticum aestivum
  unsure (1)..(673): unsure at all n locations
  Clone ID: PAT_TA_66024
agagcgcatcatttaagccaagcaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacagcaatttccagggcagcaacaaccatttccaccacaacaaccatatccgcagccgcaaccatttccatcacaacaaccatatctgcagctgcaaccatttccgcagccgcaactaccatatccgcagccgcaactaccatatccgcagccgcaaccatttcgaccacaacaaccatatccacaaccgcaaccacagtattcgcaaccacaacaaccaatttcgcagcagcaacaacaacaacaacaacaaatccttcaacaaattttgcaacaacaactgattccatgcagggatgttgtattgcaacaacacaacatagcgcatgggaaggtcacaagttttgcaacaaagtacttaccaagtggtgcaacaattgggtttgtcagcaagctgtgggcagatccccgagcaagtcgcggnggccaagccatncacaatggtggtcatgctattattctgnattnatnattnaacaacaact

SEQ ID NO: 66025 - DNA, 783 bp, Triticum aestivum
  unsure (1)..(783): unsure at all n locations
  Clone ID: PAT_TA_66025
ccgccgcacaccccagtgcccagcccctccctccctccttcgtcccctatcgccgctccctagccgagtgccccatccatctatctaatgagactgcaagggtcgtgatttgggtgcctctcctacgaggaatcggcgcggctgtactcatcgcaggtggcggcggctcttagcaagggcacgttcggaagagcaggtggcgcgtacaaggtcgcgtggagatccaacgacccgaacttcgcctcggtagaggacgcccccatagctggaagaattccaagatagagctattgcttcaaggttgggattggccacaacataattgacatcaaaaccagatctgggtcctacatatccggtgttgctcgatggtgtggctccttacagtaagatgatcaagcagcgatctagagttctcaatacagatcgatgacgcctcctcgggatccacatctccgcagcccccaaccctggtatagtatgaaaaacctacaaataaatcagaagaatanggtaatatgggatgnctatgttttgttggtgtagtagtcgttttaaggtcagtccctagagatgttgcttgacgcctccctttaatcgagtgactttgcatgcctatagtccaatggattaatctaattaatacctccctcttcccaaaaataatggatttaagttgggcctaaaagaggtaccaaagtgagtcaattattttggggaccggagggaggacttatgaaggcggaagggtttgggaaaacctttaaattatgggggccgggg

SEQ ID NO: 66026 - DNA, 590 bp, Triticum aestivum
  unsure (1)..(590): unsure at all n locations
  Clone ID: PAT_TA_66026
ataagtagagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagcttacaagttttgcaagaaagtcttaccaactgggtgcacaattgtgttgtcaagcaactgtngga

SEQ ID NO: 66027 - DNA, 630 bp, Triticum aestivum
  unsure (1)..(630): unsure at all n locations
  Clone ID: PAT_TA_66027
ctcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcaagcagcagcaacaacaacaacaacaaggcatgcatatctttctgccactatctcagcagcaacaggtgggtcaagggntctctagtccaaggccagggcatcatccaaccacaacaaccagntcaattggaggcgatcagatcattggtggtgcaaactcttccattcatgggcacggg

SEQ ID NO: 66028 - DNA, 861 bp, Triticum aestivum
  unsure (1)..(861): unsure at all n locations
  Clone ID: PAT_TA_66028
cccatttccgccatatctacgtgacttacccttgtttttgccggatcccctttcccttggcgtgaaccaactttcaagtgcttccgttcttgcctcccgtgccgccgccgcctccaatcttgcctccgacctcgtcgtccggcctcgcggcgccggagcccggccggatggagtacccacggtcaccgggcgccccatatcatgcgccgccacctccaatgtcgtcgcttcgtccgcctacgccttcctcggcagttcatgccgtcgccgccccaactccttccgcagacgccatgaagaggaagcgacaggggaaccacctcatccaagggggcccagccgatgcagcaccaccctctttcgggcccgcttcggttcctcccgtcaaggccgccggcgggaggaagaagaccggctccaccagcccaaccggtgcatgtgcgaagtccccgaggaagaatgcaatcacagcaagaggtcgggctcctcctccggctacggntggccacaacctccccattcacggngactccaccggccacgcctaccatgtgttcgatgaaacgaccgggagccaaagggtgccttccacatataccgaaatgttggccgagagtaaaggggatttgagtgcttactctccgatcatggtggatgatgggcaatgtgctaggggcgggaatggtggcgacaatccttacaacaatgaggattttggttgatttctcaggaatggggggcaattgaaccactttttgtttggttgacgcgcatttataagggtaaacttggctccttggaaggtgcccttgaatttgaatggggggaatttagttgatggggaacctacgatggttattn

SEQ ID NO: 66029 - DNA, 576 bp, Triticum aestivum
  Clone ID: PAT_TA_66029
aaaacattctcggctgctattgctccccaaactaccatctcttcactcgccgctctgttccagtaagaaccctagatccattcccctctcctcctcgtccccttaatcgcgcccccaccccaatctcttgtctggtgaggttcatccaggtaggagggatctgaagcacgccgtctgctcctgcaacgcgcggtcgtcaccgtccgcacactcgatggaccaagatgacgagctgcaccaccccgcgtggaccttgccaccactgaccccgcttggctgaccccaacatccaggacctctcttcagaaagtttgcgctcttatctctacattcaacgaatccaaatgcatactggttgtagaaattggttttggtggcatgttgcgtctcccggctattcctaggcttaatttaaaatttagcacatggatcatgagcatggttgatggtccgaacagatgcatcaagctatctcatgatagatcgattaaattctggccagaggatatccacaaagtttttggcataccatgtggcacaattggcattcataggcctgaatatcaacaagccgaa

SEQ ID NO: 66030 - DNA, 721 bp, Triticum aestivum
  unsure (1)..(721): unsure at all n locations
  Clone ID: PAT_TA_66030
ccgtgctgctccgccgcgttttcctccccatccgcagccctccattgctgccccaaggtaccgaggaagattgatatgggatttgagtgggagaggttggatctacaaaggggtgtgtggatctgaaaagcaagagcagatggattgaaggcgagcggacccctctgtcttctctctttcttcacagagcccccgctcgntctttattttcccccatattgtcatatctagcgacaagccgccagaaccgccttgccccgccgtccgtcgcccctgctgctccgccgcgnttcctccccatccacatccctccattgctgccccaaggtaccgagngagattgacatggagattttgaggggggagttggatctacaagtgatgtgtggatctgaaagggtgagaaaaaatttttgcgtttgggccatccaggggagggggaacctctaattaatctcattttattttgaggttaataacaaaaaaaatggtaaaccagccaccagaaggagatgattgaaggcaagcggacccctcaactatttttctttatttataaaacccgccctccgttttttttttcccctttttggaaaattaagggaaaggccgcaaacacgcttttgccccgccgctcgctcccccttcttgttcccccgggattcttccactcccccccccctccattgccgccccgaggacctgagagaaatatgattgc

SEQ ID NO: 66031 - DNA, 820 bp, Triticum aestivum
  Clone ID: PAT_TA_66031
cctgcacccggtccccttgccggcttgccgcctcctgcctctgccgccaggcccggccgccgtcttcggctcccgagcgcctcctcccgccgccccgacaagctgctgcagcgacctccccgtccctcgtgcgacctccttccagccaggatctggcgtcccgaggccgatccatccgcccctgtcgtccccgtgcccgtgcccacctcctgcggtggcctgcgaggccatcagcgcggccctctccgcgtgaagcccctgctccaccaccattagcgcccgacgtcttcgtcccccgcgccttgttgatgctgtaggccatgagctcgcggctaccgcacggacgccaagaccgagaccgccccgaaccacgtcctctcgctggatcgtcaagaccatctcgtttttttgcaagttcctctacgcccgaagacgttggatccgccaagttccgctctgaacgtgtacgactacacccggtgatgcgacaagtaccccgacaacatgtacatctacaccgtcaagaccggaccaacaagtaccgacgccgtgtacgactacctcctctacgggccgtcaacgactacttccactacgccccgtgtaccactaccgtcgaccctcgaagattccgtggacggcaagttcctcgtcgtgaccccgaacatctacgaaaacgtgtccaactaccgggggcacgtgaacaacgacttccaatacgccgggtacgactacttcccacgaacaaccgggaacgttaacctccaatacggccccggaacgtttaccaaatgaacccatactgtcggccccagaacct

SEQ ID NO: 66032 - DNA, 844 bp, Triticum aestivum
  unsure (1)..(844): unsure at all n locations
  Clone ID: PAT_TA_66032
cccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaaagcgattgccaagtgatgcggnaacaatgcttgccaacaactagcacaagattctcaacagcttccggggcgcaagccatncatagcgnngngcattccatcatcatgcagcagcaggaggcaacaacaacacaaccagggatgcatatctttttggcataatctnaacaagnaacaaggngggtcaagggttntttagtccaangncagggcatnattccaacccaacaaccaagtttaattgggaggggaatcaanatnaatggggggtggaaaactctttccttncatggggcaacggggtttgtccccacctgaangcttccatcat

SEQ ID NO: 66033 - DNA, 716 bp, Triticum aestivum
  unsure (1)..(716): unsure at all n locations
  Clone ID: PAT_TA_66033
cagaagcctgcctcgccccggggcggtgagctcaggctgctcgacctgaccaggcgcgacgctgcggcgatcatcaacctcctcgctctgctctcgtctgctcacgtgctcgcgatcctcgggtacatcacagtgcactccatagctctcggcacggtgttcgcttctgtagcggggcgccacctgcctgaacgacggcgagggttcttcctttccggtgcagcaatgggcgctaggaggctcactgggtttgcattcctgcggtgggcgactcgggatgcggttgtgcagatgctctgcctctggttctttgctgacgtgcacgaccaggcgcagctgttcaggctctttgtggttgccaagctcatgccgttttcggcatctgcaaacccatggcttgctgcagccatttctggcccagagcttgatggcttcttcattgcgtgngctcttcttgatgctgntgtatcgggngtggtcacgggggtgccatgggtgggtgcaatggatcgtgatccgcggtcacctggccgcaaagctgggaagggaggctgctatctttggtaattgatggcaaccgaagcccacttgaacaagtgctgggagaccagggggtggtgcagcatggggccggctcaatattggttacatttggggggcaaagttcttgggcggggtccctcccctcaattgcagaggggggactttcatggggg

SEQ ID NO: 66034 - DNA, 838 bp, Triticum aestivum
  unsure (1)..(838): unsure at all n locations
  Clone ID: PAT_TA_66034
ccccccgatgccctgccgccgcggcgacctcccagatcccgctgtcgcgcggctttctggcgccgcctcccctgcctcctcctagaaccagcgccaccgacctacctccttccggcgcgccgacgacctcaccccgccccaaccgacgccgcctccttccggcgcaccgccgacctcaccccagctcgaccgacctccgatcccccgacctcccatcatccttcgccggcgaccgccggacctccgccgccgcgcgcctaagctctccttcttccttctcctcatcttctcatcagcgcagcagcgccctaaatcctacgcgcatccccgcgccgncaccggggcctggaaccccagatgccgtcgccggtccaggatcccggcgcgccgccacggggccatggattcccgtgcgccaccgcacggncctagatcccacactccgccgctgcgccaaaggatccccacacgccgncgncgnctacccaatgcgcctccactggcagacagctcggcgctccaccagtcccaatgctggatccatggtgggctactggatcttgtcccctcctctgcgtggagccctgctggaggcccttctcctcgacaggatgccggccacctagggccagtgggagcaagccgccgggggttttcgattgctccgggaggtacttccaaatatttttaccggttttggggaggcacctttcttttccttaaggagcctaaaattttcctttgaaacaaaaaaatttggtaaaggcgccctttttttgaattgcaaagtggaacaacacaaaatttttggcagaaatttaaggggttctactcctgc

SEQ ID NO: 66035 - DNA, 485 bp, Triticum aestivum
  unsure (1)..(485): unsure at all n locations
  Clone ID: PAT_TA_66035
ccccctccaccgccgtttctaccgaccgactccatcctcctgctcggctgctcctgtcctcctccagatcccaaatctccatcgtcgcctccctcccccatcaagcaagcaagcaaaaaccccaccgccggcgccatgcacccggcgtcctcttcctcctcagcggcgcacccgcccgacggcgaccgccccaacgccaaggccccgccgcctcccggccccgccatgggctacccggccaacgccgcgcccaaccccggcaacgccagctccgcctactacgccgcggcgccgccccccgtcgccaacggcaacggcgcggccgccttcggcgtcgcctacccctacccggncgcgcccccgnaccagcatcaacatcaacggnnccaagcacagccgtagcaccactaccactatctctacaagcctttacctggggtttctttctcgctctttaccatgtttggaccgtttcttctcactct

SEQ ID NO: 66036 - DNA, 825 bp, Triticum aestivum
  unsure (1)..(825): unsure at all n locations
  Clone ID: PAT_TA_66036
gttgccttcatacaaaattttcagcacctgcagattttgtatgcaaattgtttagaaagaaaatattcttttaaaacttatgagattcaaaaataaatctcttgctaatgctgcattaaatcttttttcccttaccgtgttgtattgccttttacctgcactgtcattgtattcttgctggagagcattatgtgcaatttttggtacctgaaaatgcaaatatagtggttgacacatttttatatgatttatggaactcacttcggtcgacatacttcacatactttttatttgatatccactttttgactgaaggtgcaaatttagtaattctgatgaaatttgtatctctggacaaactgtagtcaagtatactctagagaaacaattgcaattttacttttatgaacatccatngtgtagtttgtgtatttagggtggttttctgataggactgtagttgaacacacttttaactactatgcgtgaagaacgttgacaccatcaagttaactttcatgcattttcatgatttccatcatgatttgcttctgtatttcacaattttctactctggttatttttaggcactttggttatttttggaggggtttcagaggatgcagcatttaanaaaaaattcacacaaaatatactggagaagggcaagaaaaaaggatataccttggcctgacagaagcaatttgatccccaggtttctttggcctccttttttttgtccctgaaaaccgattggaatcgggtatgaaattggggcctccctttctttataaaatcgggaactggggatgaaaaaaggaacta

SEQ ID NO: 66037 - DNA, 849 bp, Triticum aestivum
  unsure (1)..(849): unsure at all n locations
  Clone ID: PAT_TA_66037
cacaagaacaaccacccccccagtcccaacaaccattctcccagcaaccacaacaaatatttccccaaccccaacaaacattcccccatcaaccacaacaagcatttctccaacctcaacaaacattcccccgtcgaccacaacaacaatttccccagccccagcaaccacaacaaccatttcctcagccccaacaaccccaactaccatttccccaacaaccacaacaaccattcccccagcctcaacaaccccaacaaccatttccccagtcacagcaaccacaacaaccttttccccagccccaacaacaatttccgcagccccaacaaccacaacaatcattcccccaacaacaacaatgggatgattcagtcatttctacaacaacagatgaacccctgcaagaaatttcctcttgcaagaatgcacccttgggtcattggtgtcatctctcgtgtcaataatcttgccacgaagtgattgccaagctgatgcagcaacaatgttgccaacaactagcacaaattcctcaacaactccagtgcgcagccatccacaacgtcgcgcattccatcatcatgcancaagaacaacaacgangcgtgcagatcctgcggncactatttcagctcgcccaaggtctgggtatcatncaacctcaacaaccaacttaaatgggaggggatcaaggtattgggtattgaaaactctttccaaccatgtgccaacgtgtatgtcccaacctgatgnttcaacattnaacggggcctattgccaancatanacncctgncattggnggnccatggaaaaattcaaaaaattttgcttaataggtagaatnaat

SEQ ID NO: 66038 - DNA, 838 bp, Triticum aestivum
  Clone ID: PAT_TA_66038
ctttggttacttcacgcgagaattccagcctaccaccgcctgtggcagcggccgctagggccagggcctgatggctaggttgtgcgctggaccctgcggcgcggcggagcatggtgaccgggagccggtaggaagaggcaccgggcgtttctcctcggccgccgcataggccggtatcgatgcctccccgttatttgcctttgatcttccgcttctcgttctggatcttgatgattttgcgcttttcggtggatgaatctagtcattgcgtgctgttgctcgcaagctgctgccatgcaagatcccggtggaagattgacgccagcggatgccgatcttgtacagagcgatcgacgatcctgccccacagcgctgacctgacggcctaccctgcacctgacagtagcctcactcacgtgggcgttacagttcgtgtcgcccgtctatacccaggacgccaggacgccaaatttccaaatttccagaattggcggcggtgagggactgctggctggactgcgcgctcggcgccgtggagcatggtggacggagcagcagatgcggtttccgcatcgatgatggatggagacatgagacgtaagggggatgtcggtgggagattgaggtcaaagcggatgttgaacgtccatgggggcccatgagagtcggattaaactgtaggatttaaagatctagggcacattctatggtgagaacttggcgctttttaccacgaggaactgtaaccttggccccaagtttccatggcgatgacaacaccggtaaaaaaactttctttttgggtagaaaaaaagaaggaatcttggacctaacttgc

SEQ ID NO: 66039 - DNA, 791 bp, Triticum aestivum
  Clone ID: PAT_TA_66039
caaaaaccccagccccgatcgagccgccttttcccaacccagcagcgccccgaccccgccgtccgttactggtgtggacacgcggccggcgtggtcggcggcaggcggggatgagcatgcgcgatctggtggccggtcgggccggctgtgcggcggcgggatcgtcctcgtcggccaaccccctcaccgccctcgccgacgccgtgctcggctcctccaaatctgagcagcagataaaggaactttcaggatcagcagttcgcgggaaagcttcttttgattcgatgcccattcctttatcaacacttccaggctccgaggatgagatcaagctaggtcagggacctattagaagcatgaagggcaccgacttcattaatgggtgtcatggagacgcctgtggcgataattttcaagcctcaatcccttctgttcctgaacacatagtggtcgagcctcaccttggagagccagagcaagttgatagcgctactcgcctgcatttcaagcccaaatttgaaggtccaccagagatggctgctcaagctttcttgcctcaaagttcatttgaaccatacagtataccgggaaatggaccagaagaatattcaggaggaaaggatggattgctggatcatatagatggtctttatgatgatgaaatgagaacctctggaaacataagcaccgaaatcgataggtgcctggctgcgtttgaacagggaatacatcctcgaagcatgaacgacgaccaactggcaggtgatggctggttgccattcttgcggatt

SEQ ID NO: 66040 - DNA, 624 bp, Triticum aestivum
  unsure (1)..(624): unsure at all n locations
  Clone ID: PAT_TA_66040
aaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcaagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcaagctccagtgtgcagccatccatagtgtcgtgcattccatcatcatgcagcaagaacaacgacnaggcgtgcagatccggcggncactgtttcagctcgttcagggtcagggcatcatccaacctcaacaaccagctcaattggangtgatcaagggcattggtattgagaactcttccaaccatgtgcaacg

SEQ ID NO: 66041 - DNA, 811 bp, Triticum aestivum
  Clone ID: PAT_TA_66041
cagacgcgttcctccgcttccttccttctccccctccttaaacctgcctctcgtctcttctagatttgcgccctcccctttccgcccctggtctcctccccctccctcccaccgatccgcccgccccccgccgcgcaatgctggccgtcgcggcggggcaggcgacgctgggggagccgtcgtcgtcggcggccgccgccgccgccgtgcccaagcgccgggatcccacgccggatcatccaccgtattcatggatgatcgaagaggcgatccaggcgctgggcgaggacggcggctcggcggagtccgccatctcgggcttcatccgcggcaggtaccccggcgtccccgccgcgcacgacaggttcctccgctactacctcgccaagcacgtcgccgagggcctcttcgtctgcgccgcgcctgggcggtactcttgctgctccgacgacgagccccagcccgagctcgcactcaccgatgtcctggcggcgtgtgctgcgccggcacagtccaagcgcgcccgcggtcggtctaagaaggatagctcgctggtggtggccaagcggggcgcggtcggcctaagaggtaaggattccaagccccctgcggggccggtaagtgcttggccttccgattacaggggccaaacgcgcccgcggtccggcctcccaaggatggttcggcgccccattccggtttctggctcgaagattgtgatcgggtcatcactccgcgtagcccaaaaccccgggaccgctctctccttatccacgaaggaacgtccggcctcccctccccctggaaaccc

SEQ ID NO: 66042 - DNA, 843 bp, Triticum aestivum
  unsure (1)..(843): unsure at all n locations
  Clone ID: PAT_TA_66042
aagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttctgcagccgcaactaccatattcacagccacaaccatttcgaccacaacaaccatatccacaaccacaaccacagtattcgcaagcacaacaaccaatttcacagcagcagcagcagcagcaacaacaacaacaacaacaacaacaacaacaacaacaacaaatccttcaacaaattttgcaacaacaactgattccatgcatggatgttgtattgcagcaacacaacatagcccatggaagatcacaagttttgcaacaaagtacttaccaagctgctgcaagaattgngttgtcagcacctaatggcaagatcccttgagcaagtcgcaagtgccaggccatccacaatggtggtcatgctattattctgcatcaaccaaccaaaaaccaccaaccancaaccatttggaggccaggtnttctttccaacaagccttntgnnaacaataatncaattangcccagggggtttcttttccgggcctttttaannaaaaaacccacagggcccaggggcttttgtccagnccttaaaaaaantggnccccagtaccgaaggnaaat

SEQ ID NO: 66043 - DNA, 672 bp, Triticum aestivum
  unsure (1)..(672): unsure at all n locations
  Clone ID: PAT_TA_66043
cacaacaaccatatctgcagctgcaaccatttccacagccgcaactatcatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccaagctggtgcacaattgtgttgtcagcagctgtggcagatccccgagcagtcgcggtgccaagccatccacaatgttgttcatgctattattctgcatcaacaacaccaccaccaccaacaacaacaacaacaacaacaacaacaaccgttgagccaagtctccttccaacagcctcagcaacaatatccatcangccagggcttcttccaaccatctcagcaaaacccacaggcccagggctctttccagctcaacaactggcccagnttgaggcaataaggaacctagcgctacagacgctactgcaatgngcaatggggatatccctncatantgnaccattgcttcatttggcatctttggtactaactggagaagagaa

SEQ ID NO: 66044 - DNA, 799 bp, Triticum aestivum
  unsure (1)..(799): unsure at all n locations
  Clone ID: PAT_TA_66044
aagcaagaagagacttcagttgctcagaaagggtcgatattgggtaccatgaacttcaggagatgtgaaataggcgatactgcctcgagatcaagaaatcttggttccacaattgcttcgaggattagtcagctggagtctgcaagcaggccggtgaaagatgttcatcctaaggtgaacaaacagaggcggacaagcaaggggttctgcaaaggtattccagaagcagcttccacggcaactcaacagcctgaacaaaggtctccatatgtcagtgtgacgagggtcaaagaaatgttgtttggttcaacttcgccaccgacgcatccggaaaccaatatagctaaagaaaatatgggaaaagccaacgatgaacctgaattgaaagaaatacatcagagcgtccgtttcaaggccaggtcactgccaaatttttactggagaagtaaagaatcaaaggattcaagggggcacgagagacccaccaaaatccgccgaacagcgatcatagactgaatgatgatgccagtgacccacacggaatgagcagaggagcctcgaaagacaaacaaatatgttgcttcccacttataaggcggtagtaatgcttgtaggccggcctttcaataaataatagctgggtcatttaatttgattatgtttgggtaactacctatggcttctatcggtagntatactaattatggaatcctatatatccttctaatgtataggcagaatcccttttgtaatcctgactagcattttcttgcttggaaaataaaggacaagcctttgg

SEQ ID NO: 66045 - DNA, 811 bp, Triticum aestivum
  Clone ID: PAT_TA_66045
gaaaaaataaatggcacaaatggacagcccagaaaagcccgtgaggccagtggcggatcacaacactcgacgcgcaccgcctcctccttccactggcaccgtgttcgccatgccctaggcgccgtcgccgctgtctccaccggcaccgcctccccattccatcccttccttccatgtcgccgcagtcgccaccatgtttctcgaagaggccgctgtcgggaagcgccgaggaccgagccgaaccttgcgggggtaccatctctgcaatcctgacgatactgtctttagcttcggcggcggtgacgtcggctttgacggcaggcgtagctgggacggcggatgaggccttcggcagcgactttacggttcctttgctctgctccccctcgcgctcatctgcctctccccctcttctgcgacacggcctatgggacatgggaccggtggatgccgtacgtcgccggagtagtaggcggtgaggattgatgcagattcaggttgcagcaacttgagaaccgaatgatatggaataagggttagactttagacacctcaatgcatgccattcccttctaagtaaatgaaaggttcaagacttcaaacaccttaatgatgcagaatcatcacttttcattacatcttcatagcccgaatcaatctcctttgggttaagttttaataaatctatgtgggaattaaaggggctaatctaagaaattaaagtttgccaatttaacggcaccaatgttggctccgaaccggaaagaaccggaagggggaataaattaaggccttttaatataggggcctt

SEQ ID NO: 66046 - DNA, 686 bp, Triticum aestivum
  Clone ID: PAT_TA_66046
gcatcatttaagccaagcaagcgggggtcaataaaaatccaccatgaagacctttctcatcctagccctccttgctatcgtggcgaccaccgccacaagtgcagttagagttccagtgccacaattgcagccgcaaaatccatctcaacaacaaccacaagagcaagttccattgatgcaacaacaacaacaatttccagggcagcaagaacaatttccaccacaacagccatatccgcatcagcaaccatttccatcacaacaaccatatccgcagccgcaaccatttccgccacaactaccatatccgcagacgcaaccatttccaccacaacaaccatatccacaaccgcaaccacagtatccgcaaccacaacaaccaatttcgcagcaacaagcacaacaacaacaacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctc

SEQ ID NO: 66047 - DNA, 563 bp, Triticum aestivum
  Clone ID: PAT_TA_66047
acaatcatcaaatccaagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccattctcccaacaaccacaacaaatttttccccaaccccaacaaacattcccccatcaaccacaacaagcatttccccaaccccaacaaacattcccccatcaaccacaacaacaatttccccagccccagcaaccacaacaaccatttccccagcaaccacaacaacaatttccccagccccaacaaccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccg

SEQ ID NO: 66048 - DNA, 730 bp, Triticum aestivum
  Clone ID: PAT_TA_66048
catcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacgaactattccccaaccccatcaaacattccaccatcaaccacaacaaacatttccccaaccccaacaaacatacccccatcaaccacaacaacaatttccccagacccaacaaccacaacaaccatttccccagccccaacaaacattcccccaacaaccccaactaccatttccccaacaacgccaacaaccattcccccagcctcagcaaccccaacaaccatttccccagtcacaacaaccacaacaaccttttccccagccccaacaacaatttccgcagccccaacaaccacaacaatcattcccccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagcgtcgcgcattccatcatcatgc

SEQ ID NO: 66049 - DNA, 526 bp, Triticum aestivum
  unsure (1)..(526): unsure at all n locations
  Clone ID: PAT_TA_66049
tcttctcccgcgtgcgccacctcctcgccaaacctttcccctacgcgcggccctcgccgacttgctcttcctcggcggggagcagcagtagcaggcggaggcgctgtgctcgcggaggggctgcagatccccgccgagcaggccgcgctggtgctcgccgccgtgctccccggcgacgacgacgaacccgcaacggaaggagctggcgcctccccgcccccatctatccactccgtccagatcttcctgtacccgcagcagatagagagagggatgatgtgaaggagaccagatagagagagggatgatgtgaaggagacgagaggaaggagaagccatgccccgtccactgcgtcgtgcgcgacgaccggctgggctctgtttcagcaccccaatgcttgtcggcgcttcttcgacgaccacccangcacgccatcgcctctcttcgaccccaacggaagggacgactaattaatctgtccagatcccaggcaagtgaggccttgcttcacccctctccccttca

SEQ ID NO: 66050 - DNA, 506 bp, Triticum aestivum
  Clone ID: PAT_TA_66050
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccac

SEQ ID NO: 66051 - DNA, 252 bp, Triticum aestivum
  Clone ID: PAT_TA_66051
acgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccaggctcagcaaccacaacaaac

SEQ ID NO: 66052 - DNA, 570 bp, Triticum aestivum
  Clone ID: PAT_TA_66052
acagtcgccggagtgcgccagaatgttgagaacctcctcaactactctctcaatgagaagaagcgtaacttcaacgagaccatcgagctccagatcggtctgaagaactacgacccccagcgtgacaagcgtttctccggtaccatcaagctgcccaccgtcccccgccccaacatgggtatctgtgttcttggtgaccagcacgatctcgaccgtgctaagcaccacggtatcgatgccatgtccgttgaggatcttaagaagctcaacaagaacaagaagctcatcaagaagcttgctcgcaagtacgatgccttccttgcttccgaggctctgatcaagcagattccccgtctgctcggtcccggtctttccaaggccggaaagttccccacccccatctcccacgctgaggatatggccgccaaggtcaccgacgtcaagtccaccattaagttccagcttaagaaggtcctgtgtctcggtgttgccgtcggccacgtctccatggagaaggaggccatcgttgccaacctgatgctcgccatcaactacctcgtctccctcctc

SEQ ID NO: 66053 - DNA, 576 bp, Triticum aestivum
  Clone ID: PAT_TA_66053
actagttaacactaatccaccatgaagaccttcctcatctttgccctcctcgccgttgcggcaacaagtgccattgcacaaatggagaatagccacatccctggtttggagaaaccatcgcagcaacaaccattaccactgcaacaaacattatcgcaccaacaacaacaacaacctgtccaacaacaacaacaacaacaaccgtcgagccaggtctcctaccagcagcctcagcaacaatatccatcaggccagggcttcttccagccatctcagcaaaacccacaggcccagggctttgtccaacctcagcaactgccgcagttccaggaaataaggaacctagcgctgcagacgctaccagcaatgtgcaatgtctacatccctccatattgctcgaccaccattgcgccatttggcatcatgagtactaactgagaagagaagaactctattactagatatatgaaacaccgttttcttaaaacatggtttggtcgttgtagcggtgaaaaaaaagtgacatgcactatcatgtaagaacccgaactagactatttcaaacttggaaataaa

SEQ ID NO: 66054 - DNA, 355 bp, Triticum aestivum
  unsure (1)..(355): unsure at all n locations
  Clone ID: PAT_TA_66054
tctgtagccgacacgccgccgcccaccgccgccacctctcctcatctcccatcccgggggacgggngaaaaagacctagcaactcacgtgcttccttcctcttcctcaagccgctccttctcaggctgcgccgccgcagcgcgcgagctcctccaccgtccactccctccgcacctgcccgccaggccgccgctagctgaccaaggcgagctgcggaggcgtcaggccaggcgtgcagcagtgtgctgtactcgattgctcgatgcagctagagaccgcgtgtgctcagttcagttagaaatgcatgtgtgcccaccatttcattggtcgatcgttctaacaaaatgggctcaaa

SEQ ID NO: 66055 - DNA, 114 bp, Triticum aestivum
  Clone ID: PAT_TA_66055
cccaatgcatatgtttgtgaaacattacatgcgcctgcagtttgcccgggatgcggacgagagctatgaagaaaatcggaataaaactggtggtgtggtagtcaaatgcaatat

SEQ ID NO: 66056 - DNA, 421 bp, Triticum aestivum
  Clone ID: PAT_TA_66056
tcatgaagaacatatgatgctagtttttattcataacctgggtcagcctttagtaatagtataggatttgagtgttgaagcagcttcagaaaacttgatccatcttctgttcttctatgttttctgtaacttccattttagctattgatttgtgtgggctgattgttttggaatgcatgccttctttggattcgttcgttgttgcttgatgtttgcagtgctttattatttctatgtttgcaactttccatctgaatttggtaaagcaaacggctattgacaagtttgaatcagtaaatgatgaattgctgatgctttaagtttgaacaacagcaattctgctgacgaaatttgatcaaagtgtttgtgatatctcctctgttctcatgttgttgctgtccgcttcaaacaatttgctgct

SEQ ID NO: 66057 - DNA, 420 bp, Triticum aestivum
  Clone ID: PAT_TA_66057
tcatggcatgatagtatctaaacagaacgaccttttagtttgtagataacaaaacatagagttagatgaaagacatatatgattcacttgtcactgaagagaaataatcacatctggacaagcacctcaaaatgtctttttgtacaatgcctcaaagaaccactggctactgaaagatacacatattggtttcagagttttattcttcgtgttctgaatgagctgacagggaagaaatcttggtttcaaagttctctctgtcagtggctagctgagtctggtctacttttctaactttgctatctggcagatatagctatttgattttcctattcaattaggaagtcttttgaggaggttgaaatgagttatatttttggcatgattgatggctatttgtctattgagtcatgtaaatgg

SEQ ID NO: 66058 - DNA, 191 bp, Triticum aestivum
  Clone ID: PAT_TA_66058
tggtaggtggctgcaggtggagcgccagcaacagcggtggcggcggcgttggatcagccatggggcggcggcgcctagatggcactgccaggaaggtgtcctagcgtgcagcgggcttccggccgcctctatgtgaggggatcgcggcgatgccccggtggatatggcgccggagtgaggttggaggggcg

SEQ ID NO: 66059 - DNA, 508 bp, Triticum aestivum
  Clone ID: PAT_TA_66059
atccttgcgatggcaataaccatcgccaccgccatatgcaggccgaccctagcggccaagtacaatgggccgcaacaacaaccattcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatattcccaacaaccacaacaaccggtcccccaaaattaacaaccccaacaaccattttcccaattccaaccaccacaacaacctttttcccaacccccaacaacggaaccattatttcccccaacaccaaccatcgtggattaaacaatctttacaacaccagtggaacccatgcaaaaatttcctctggcagcaatgcaaacctgtgtcctgggggtaatccctctggtcaataatcttgcccccaaccaatggccag

SEQ ID NO: 66060 - DNA, 138 bp, Triticum aestivum
  Clone ID: PAT_TA_66060
cccactcttatccgctcccaccttggatcccccccccccgggatctggcagcaatttgtgatgtaactttttaataattaggacttcagtgtttgtcattcgtggtttatttaggcggtgtgggcttatgcctccagc

SEQ ID NO: 66061 - DNA, 446 bp, Triticum aestivum
  unsure (1)..(446): unsure at all n locations
  Clone ID: PAT_TA_66061
ccaccaagaaaggaggatgtcttgctgcggcggcaactgcggatgcggcgccggctgcaagtgcggcaacggctgcggcgggtgcaagatgttccccgacgttgaggccaccgccggctcctttcttcatggtcatgcccaccgcctggccgaaggggagctccggcgggttcnaaactgccggcggggataccggggggtgcgactgcaccacctgcaagtgcggcaccgcctgcggctgctcctgctgcagctgcaactgagccggcgcccangaagccggccggcgaggcgagctcgaggatgatgaggacaactggacaagcaaccaccaccaccaccaccaccatcactagccgctgcatgcgcccgcccgcgcgcgcgctgaataaaataaaaccgtcgtgtgttccttaactctgtacctgtacgcccgtgttttccac

SEQ ID NO: 66062 - DNA, 435 bp, Triticum aestivum
  Clone ID: PAT_TA_66062
ggccgcttaccggagaagaacccctgttgtgcgtgagagtggcctgctaaccttggacgtggacacataaatgatgcaaacatgtcaggctaatttcccagttgaacctgactagtcatctgaattatgagacaaatgctacttacacagattcaaggagcaactgcatcagaacaaatgatgggtcgtaacaatgtggaatttcctggacaatttgcagggcaggtgtttgattcattgcaccgcacagacagtccatcaatccaccggctcctgagtggacaccttttgagagtccagtttgaacttgaacacactgcgacgccaacagcttcgcaggagcagcaccgcgcagcttcagcaagacatcaccagagcagcttcagcaggagcaacaccaaagcagctgcacagcgccaagcccactgctgcaac

SEQ ID NO: 66063 - DNA, 142 bp, Triticum aestivum
  Clone ID: PAT_TA_66063
cgtggctgtggtgggactacgtgcacgacttcgccatccggtgccccatgaaggagaagaagtacaccaccgattgcgctcatggtgtcatcaagtcccttggaatggacattgacaagattacccagtgcgtcggagaccc

SEQ ID NO: 66064 - DNA, 662 bp, Triticum aestivum
  Clone ID: PAT_TA_66064
aacaacaacaacaacaacaacaaatccttcaacaaattttgcaacaacaactgattccatgcatggatgttgtattgcagcaacacaacatagcgcatggaagatcacaagttttgcaacaaagtacttaccagctgttacaagaattgtgttgtcagcacctatggcagatccctgagcagtcgcagtgccaggccatccacaatgttgttcatgctattattctgcatcaacaacaaaaaccacaacaacaaccatcgagccaggtctccttccaacagcctctgcaacaatatccattaggccagggctccttccggccatctcagcaaaacccacaggcccggggctctgtccagcctcaacaactgccccagttcgaggaaataaggaacctagcgctacagacgctacccgcaatgtgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtgacatgcactatcaggtaagaacccgaactatactagttcaaacttgggaataaaagacaaacacaggtcttgtctaaaaaaaaaaaaaaaa

SEQ ID NO: 66065 - DNA, 340 bp, Triticum aestivum
  unsure (1)..(340): unsure at all n locations
  Clone ID: PAT_TA_66065
cggcttgcgcctggctgacacgagggcgtcggcagaaaccgctcgctgctgggcgccgcagaggcgctggccgcacggcgggtcagggagatggaggcggagaccttcaaggcggcgcggcgcggcgtcgagctggaggagcggctggcccggctgagggcggaggcggcgtcgtggcaagccaaggcaatgtccgaggaggccacggcggccgcgctccacgcgcagttgcancatgcggcggccacagcgcaggcgaggagcggcaaggccgccttggacgacgacggcgcggcggacgacgccgagtccggcttcatcaaccctgacagggtggtgg

SEQ ID NO: 66066 - DNA, 470 bp, Triticum aestivum
  Clone ID: PAT_TA_66066
caggcatggcagctccaagactctcgtcctcggcctcctgctggtggtcactgtcgccaacgtcggggccgcgtccgtggtggtcggcctggccaagtgcgccggctgcaccaggaaggacatgaaggccgaggaaacgttcaagcgtctccgggtggcgatcaagtgcaggaacgcggacggcgagtacgagagcaaggcggtgggcggcctcgaccgcaggggcgccttcagcgtgcccctggccgccgacctccaaggcgccgactgcgtcgcgcagctccacagcgccgcctccaacgcgccgtgccccggccaggagccgtccaagatcgtgccgctgtccgagggcgccaccaccttcggcgtcgtcgccggcgccaagaccaccgccacgcagtcggtggcgtccccggagtgcgcgtcggccttctgcccctcgaccacgcaaaagaagccccgcggcggcg

SEQ ID NO: 66067 - DNA, 129 bp, Triticum aestivum
  Clone ID: PAT_TA_66067
aagccccccacggacgtgacggccatgctggagaagtccggcaagtactccaagttcgtgcagctgctcaaggagacccgcgtggagacgcagatcaacgcgcagctgactgacagctacaacgggctg

SEQ ID NO: 66068 - DNA, 143 bp, Triticum aestivum
  Clone ID: PAT_TA_66068
aaatcagaatgtgttgaataaccaccttatatttggtatcatagttgtgtcatttcttagtaatctttgattgcatttctaatcgaaaattcacattggaaaatttctttgtattgacctcatgacaaccaagcagccatttt

SEQ ID NO: 66069 - DNA, 316 bp, Triticum aestivum
  unsure (1)..(316): unsure at all n locations
  Clone ID: PAT_TA_66069
ggctgctgcggtcgacagagcagcaggagcaaggagctcgagatggttcaggtagagcgcctacaacgattactgaactggatagaggtgccttatgatagtatagctaaagaacatcaggagctggtgttatgttctacctgatcgatttttancagacttggtgagggggatgttggctgagtgcgctcttgcagcgtgaatgttgggtgagtcaactgattctaggtgcgggtgcgccctctccctgggcgccgcgtgcacatcgcgctgtctgcaggagcgtgcggcaggctgtggaccggtgcctaaactg

SEQ ID NO: 66070 - DNA, 117 bp, Triticum aestivum
  Clone ID: PAT_TA_66070
atcatcttctcaacgcgttgctcctcctctagatcggcggcgaacaggcggccagtgagctccatctgtttctggcgatttgttttccatggatcaggacatacgtcttgtttttcc

SEQ ID NO: 66071 - DNA, 435 bp, Triticum aestivum
  Clone ID: PAT_TA_66071
attgcagatctttggtctccactcggcatatctaacgtgcagtttccattccctcactggaaaagatgggctgagatgaacacaaggttctccattgatgtgcgcaattttttgaagggagaagctcttattagtgatcttgctacgcgtttgtgtggtagcggggacctattttccaacagaggcccggcgttttctttcaattatgtatccaggaattcagggcttactcttgttgatttggtgagtttcagcaatggggatcttgcttctgagtcgagctggaattgtggtgaagaaggaccgtcggaggacagtgtagttcttcagaagaggctaaggcagataaggaatttcatatttattctctttgtttcacttggtattccaatcctgaacatgggagatgaatgcgggcactcctctgctggttcg

SEQ ID NO: 66072 - DNA, 501 bp, Triticum aestivum
  Clone ID: PAT_TA_66072
acaagtatcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaatcattcccccagcaacaacaaccgttgattcagccatatctacaacaacagatgaacccttgcaagaattacctcttacaacaatgcaaccctgtgtcattggtgtcatccctcgtgtcaatgatattgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttc

SEQ ID NO: 66073 - DNA, 280 bp, Triticum aestivum
  unsure (1)..(280): unsure at all n locations
  Clone ID: PAT_TA_66073
tcgacggcctgcaagagttcttcgtccacttccactaccccaacgcacagtacgccctcatcccatctcatctcctgcttaactgttttgcttcttttaattattcagtgctttcatttcacacgttttgaattatgcaatactccatgtgaaaatggaatggagggagtnctaaatttaggatcaatttttcacttcctgnccacaagcgtgaattatactgacatgtcctgaactcttttgctggtcaagagaggcgcagtgaatgagaatgttggct

SEQ ID NO: 66074 - DNA, 304 bp, Triticum aestivum
  Clone ID: PAT_TA_66074
gctgaagtttataagaaaatcaatggtcctgtaagaacctttaatcaatgcaatttagtgtagagtgtagacacattgaccagtcaaagctgtcttgtggatgtactcctttctggatgtattctgtgtgtatgagactcgcatggtggctagcgagaaaactaatcaattgtgagctatgatgacatgcaatcagcattgttactcgtcataaaataattacatactcgagtataatgtgcttttagattaaaaaagacgtttaattttggtgtgatgtgtcattgtactctatttgagttcc

SEQ ID NO: 66075 - DNA, 207 bp, Triticum aestivum
  Clone ID: PAT_TA_66075
gtctcggatccaccgccgcttccgcagccatggtgaacgttccgaagaccaagaagacctactgcaagaacaaggagtgcaagaagcacaccctccacaaggttacccaatacaaaaagggtaaggacagtctttctgcccaggggaatcttttttatgaccgcaagcagtctggatatggtggccagacaaagcctgttttccaca

SEQ ID NO: 66076 - DNA, 313 bp, Triticum aestivum
  Clone ID: PAT_TA_66076
ccatcgtgctactgccggtctggggcgccggccacttcatgcccatgctacaggccgggaagcagctgctagccagcagcagccggcccctgtcgctcacggtgctcctcatgccggcgccgacagcgcagtctgcgtccgacatctccgaccacatacgccgggaggaaggggcaggcgctgtggacatccgcttccaccatctcccggacgtcaagctgccgacggaccactcgggcgtcgaggagttcatctcccgcgcagtgcagctccacgtgccccatctccgcgcagctataattggcttgacctc

SEQ ID NO: 66077 - DNA, 284 bp, Triticum aestivum
  Clone ID: PAT_TA_66077
ccaaaccctcgctcgcctctcccctcctccgcaccgctgccctacaaatcccaccggaggcctcggtggttgtggtggcagcgagcgagctcccccgccgtcacgcccgcgccccgatgtcgagcaactccgccgccccccgccgcttctcgtcggcgatgtcgaccgctactgccaagcgcccggccgtggcggagggcgccgggggatccatggcggcggcgggccccgcggccgcccagcagcaggccaagaaccgcgtggcgctcggcaacctcaccacc

SEQ ID NO: 66078 - DNA, 403 bp, Triticum aestivum
  Clone ID: PAT_TA_66078
tcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagaccgccgccaagtcgccggccaagaaggccgccgcgaagcccaaggccaaggccccagccaaggccaaggccgtcgcgaagcccaaggcggcggcgaagcc

SEQ ID NO: 66079 - DNA, 446 bp, Triticum aestivum
  unsure (1)..(446): unsure at all n locations
  Clone ID: PAT_TA_66079
gaattggtgtgtgttaaccatttatttgaacatggtatggcaattgtcgcactctgtttcagttagctgaaactgatagccaggaacgcatctttgtagcacttttctgttaaaattgtaaatatacattttgcttcaagcaatttgctagctattcaagttggcaactagctggcatcatgtggtgtttcttttccatgttattaagacttatacataacttattgtttacatggtggtccattataactattgtaaactaaattttttcaacaaggagatgtccgcatataactccttcataattgttattacatgactatatgttgtgaaatcatttgtcatatgtctgatttttttttttttcatcaccccctttanaaatgagcttctattaactcccggtctttcaagtcattttctgtgtctgccaaacttgtgccttt

SEQ ID NO: 66080 - DNA, 438 bp, Triticum aestivum
  Clone ID: PAT_TA_66080
ggcattgttggcggccgaagggtgcttgtggaagcaggtggtatagtcggcagctgtggggattcgttattctccgaggttggcgggctcgacgccaggctcgatggcgctgcgggattgtcaagcaggaaaagttcgtcaactcgtccagtttgatgcttttcaactgctggataatggtttcgtgccatgcgtcgtctccatgtatttactaaaacatttactatgctcttctatttggagaaagaagcctggtgcagcctaccaagctggggagagccatagaatgcccatcttggaattagctgttcgactgaatgtccgggacaaagatattgccacctcctttgagtatgcttgacttgtataatgcgattttcatttatttagagtgaattacataatatatagatatgcattaaaaaaaaaaaaaaaaaa

SEQ ID NO: 66081 - DNA, 429 bp, Triticum aestivum
  Clone ID: PAT_TA_66081
cctacctccacgcgtctctgctgggactgcaggcccgtcacggatcctctgcgatctcaacgtcgaccccgtggcgccgctgccgccacgccaggacgatctcatggcggacaccgtgggtcactgtgctcccggcggctgcgcatccgcagccggcagcggcccggagcacgccgcgcttgagaggcacgtgctcgccgcgctgaacgagctcatgatgctgatgaagcagggcgagccaatgtggcagccggcggccctgggcggcgaggtgctggaccaccagctgtatcgcgcgaccacggtcccaggcttactcgagctccccccgccggggttcacggcgaatggcactcgggacactggcatggttatgtgcactggaaccgaccttgtccgcatcttcatggacgagaactgctggcttga

SEQ ID NO: 66082 - DNA, 187 bp, Triticum aestivum
  unsure (1)..(187): unsure at all n locations
  Clone ID: PAT_TA_66082
ctaccagcgacttaactacttcaacggccgtggctgacacggataacactagtattggttgccttctggtggggtattggagaagtacttcggctcactttcgtgaatggagaggggaggttcacttctgaccanatgtggcaagcaaatgtttgcaaattctatatcatcttttttttggggtttg

SEQ ID NO: 66083 - DNA, 381 bp, Triticum aestivum
  Clone ID: PAT_TA_66083
catccacaatgttgttcatgctattattctacatcaacaacaacaacaacaacaacaacaacaacaacaaggacaacatcaaccgtcgagccaggtctcctaccagcagcctcagcaacaatatccatcaggccagggctccttccagccatctcagcaaaatccacaggcccagggctttgtccaacctcaacatctgccccaactcgaggaaataagtaacctagcgctgcagacgctaccagcaatgtgcaatgtctacatccctccatattgctcgaccaccattgcgccatttggcatcttcggtactaactgagaagagaagaactctagtactagatatatgaaacaccgtgttcttagtccatggtttggtcg

SEQ ID NO: 66084 - DNA, 490 bp, Triticum aestivum
  Clone ID: PAT_TA_66084
gccggcgcctcccttctctgctccctcgtctcctctcgcgcgggcccggcgaaagggaagcaagatgtacaccgccaggaagaagatccagaaggacaagggcgtcgagccctccgagttcgaggacaccgtcgcgcaggctttctttgacctggagaacggcaaccaggagcttaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttggaggatgttgtgtacccagctgagattgtggggaagcgtgtcagg

SEQ ID NO: 66085 - DNA, 490 bp, Triticum aestivum
  Clone ID: PAT_TA_66085
gctcctgccgatccgagttggagcttgccatgactccctcctcccactccttcccgcaccacctttccaccccaccacctcccttccttcgcctcccagcaccgccgaccccgcgcctcccacagcccctggccgcacacctcttgtggaggagagcggagcaggtcgcgttggtgggctggcgaggcgaagcggccatcgactcgagggacgacaaggcggtcaactcgatggtgcgggtgcgcgtctcctctggacagggatgcgggcggcggtgctggcgacttccagcagggaaggctaggtgctggacagcggatccgatgaccagcgtcgtggggcaggccggatctggtcgaggacatgcggaggcaatcggcgccgacgacagatggtggcgcaaggggctctggttcggggctaaggtcgaccttggcggtctatgcgaggaagaaacgacagagagatgtgagaaacagataggaatgat

SEQ ID NO: 66086 - DNA, 367 bp, Triticum aestivum
  unsure (1)..(367): unsure at all n locations
  Clone ID: PAT_TA_66086
ttacctgctttgctgtttctctggctgatgtcgaaatcagctgctcccaaacagcggcttatcataagcagcagcatgtttgtatgtctgagggagttccatttcacctgctggagcaatggggaaggactgatgtttgaagccggggccatgccgaggcttgagaagctgtgggttccgtttgacgcgggcagcggtcttgattttggcatccaacacctctcttccctcaggcatcttgccgtcgagatcatttgcatcggcgcgaccgctcgggacgttgaggcgttggaggaggccatcanagatgcagctcatctccttccgaatcgccctgcggtggagttccgaacatgggatgatgaaa

SEQ ID NO: 66087 - DNA, 336 bp, Triticum aestivum
  Clone ID: PAT_TA_66087
gcgcgcccttcgctggcgacgatggcgggatggactacgacctgctgttctgggcgattcatgaagcggaatcaccggatccgaagattgcagccaagtgggcacgcttcaagacatggagcccgtcccgcttgaacatcaggccaccgtcggtggtggggctggccaggattcctcgtgagttcctggagccgggggatagccccccacgcgtcccttgaaggccacagctcccggcggccgagtggcgcgaaccaactcgcgggtgctcggggcggggtctaggctgactgacagcagtctggaaccgccgccattgccgggggattgtgggaa

SEQ ID NO: 66088 - DNA, 648 bp, Triticum aestivum
  Clone ID: PAT_TA_66088
gcgaaccggtggacgacgaacatgccatcacgcaactgtccgaaaggacaacctagataaacaatccgtcctaggcgaagataactgtctggacgatctaacgccggacaagctactggagcagaagaaccctcacaaaaggctcgtcgccaccgcgcgtagcctgaaaaagcagaagcggaagctcaaaacagcggaggaggcgctccgaatcagatggagcaaagtactcaacaccgcagacaaatacggcgatagtcgccgaacgaagagctacccgaagtgaaaactactgcccgaattcgatgaggaggccgtagagcccccgcaatcaaaaagcagggagaccacccggtcggatagacgaccccatggcaaacataaaacggcaaacggcgccgcacgcaagccgacacgcgatccgcatacggattcgcatcaaagagatggcccagttagatctatctacgggccaagaaagaaagctctagtaagcaatgcaacacatcaagtatctaaatgctacggtacacctaaatatacaggtgccgcacaccccctatgtttcaccgatgaggttctggattatgaattcccagcaggattcaaacccgtaagcatagaggcatacgacggaacaacagaccc

SEQ ID NO: 66089 - DNA, 619 bp, Triticum aestivum
  Clone ID: PAT_TA_66089
attttactcgattccatttagtaacaactttctcagataattgcttccatgtgtgcttcatatcattggcagtgttgaccaaatttcacataattaatgtaatgtactactggttggctgcagttaggaacttctattccaaactctgatgcctcatcttttgtttttttgttcaacacaaacttaaatgtctgacttacacaagttctcttcatgtaatttttaatggagtgtgtcatctttattgtagcttattgagctgtcatgtcagtaatttaatttttaaatataaagcgcttttaatgccaaagacttgaagaaggatttgtaatgggaaatgcgtagaattaaatctgactttgaactcttatttaacctagttcagcattataggcagcgaacaattacctgtactttggaatccagtaatttcagctacaaagtttgtgttcattgcctcatgttaacttatttgtttaatttctgtatctatgtgcgtgttttaaattcactcctaccaggcaataaacttaatttgaactatgaaaattttaaattttggagaaagatgtatgattactatcaaatattttatttcaaaaagactttggaattagtg

SEQ ID NO: 66090 - DNA, 357 bp, Triticum aestivum
  Clone ID: PAT_TA_66090
cctgcgccgcccgcatccggtggcgcctccgcccccagtccaagcgccgcctcctcaacgatatcacgttcctctgcaccgggttgcggcctgtgatactgatggactacggcggcacgatgccccaactacaggagaacctctgcagcctgctgcaccatgcttttttggaagcaagcatattgaatccactaagggtgatggttatgaaagatatgctctacttgattcacgcagaaggacttgctgaacatgtgtcaccaaatgcaaggtcacagcaccagctagcttttgtggacctagagaaaagctgttgcgaactgcttgcaaacacggaaaagaacgaaaccatggtgg

SEQ ID NO: 66091 - DNA, 594 bp, Triticum aestivum
  Clone ID: PAT_TA_66091
tccgacagcaccttcaagctttatgatgagatgatacgaggaggtctatcacctgatctcttcacctacagtactctgctgtcagggtgcatgaagttgaagcacggctacgctaaggcaatggagttgatcaatgagctcaactcacgcggtcttcagatggatagtgtaatatatggtaccctcttggcaatatgtgcatctcataactactgcgaggaagctgaggcatacttcaagaaactgaaggatgaaggccataatcctaatctgtttcactacagttccctgttgaacgcgtattcagtaaattcttattatgaaaaagctgagctgttgatgaaagatttgaggtcttctggtttaacaccaaataaggttatactgaccactttgttgaaggtatattctaaaggtggtctgtttgagaaggctaaggagttgctaactgaattggaagcgtcaggctttgcacaggatgagatggcatattgcatattgattgatgcacttgccaaaggaggaaagatatgggaagcaacaatggtgtttaatgaaatgaaagaaaaaggtgtcaagtctgatggctatgca

SEQ ID NO: 66092 - DNA, 634 bp, Triticum aestivum
  Clone ID: PAT_TA_66092
acaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgggttctagccagccacaacaacaaacacaactggatcagggttggattgcggtgataggggacatgggtgattcagaccatcccggcaatgtgcgacgtgcatgttccaccatactgctacaccaccatatcaccatccagtgacgtcactaccgacatgggcggctactga

SEQ ID NO: 66093 - DNA, 581 bp, Triticum aestivum
  Clone ID: PAT_TA_66093
ccttcctcgtctttgcccttctagccgttgtggcgacatctgccattgcacagatggagactagctgcatccctggtttggagagaccatggcagcaacaaccattacaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcagcagagcagttgcaatgtgatgcagcaacaatgttgccaacaattgccacgaatccccgaacaatcccgctatgaggcaatccgtgctatcatcttctccatcatcctacaagaacaacaacag

SEQ ID NO: 66094 - DNA, 268 bp, Triticum aestivum
  unsure (1)..(268): unsure at all n locations
  Clone ID: PAT_TA_66094
tgggttggtggcgttggtggctgtggtgtcgaccagcatcatccttgtatcctaccacctccgccgccgcctccaggatgataccaaactcaacaagaccgccgagcaacaacgacagagcaagatgacaatgaaggaggtggggttcatggacgacgttgcggaggatctctcgtcggacgaagaggagtgcccccgtcgactgggtncgactgccattcgtgtccccatccaaccgttgctccgcaggggccctcgattcaacaat

SEQ ID NO: 66095 - DNA, 311 bp, Triticum aestivum
  Clone ID: PAT_TA_66095
acctcggtgttgaacgccgtgataatgcctgctcgggctcaaatccccctcccccacgagctccccctcgacgcgccgccacccacgctcagacctcgcctccgcccatgcccccgccctctcccctcccctctcctcccccgaagaaaagagaagagaagagacgcagggatatctaaccaccagatcgagtggcggccagatccatctgccacggtcgcccagggctcgcgcgcctccgacgacgcggccgtgcccgtgtgtcaagggcctagtcggagatgcttctgctccgccatggccatggagct

SEQ ID NO: 66096 - DNA, 679 bp, Triticum aestivum
  Clone ID: PAT_TA_66096
gcatcattcaagccaagcaagcagtggtcaatacaaatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacattttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaacaacaacaacaacaacaaccgtcgagccaggtctcctaccagcagcctcagcaacaatatccatcaggccagggctcgttccagccatctcagcaaaacccacaggcccagggctttgtccaacctcagcaactgccgcagttcgaggaaataaggaacctagcgctacagacgctaccagcaatgtgcaatgtctacatccctccatattgctcgaccaccattgcgccatttggcatcatgagtactaactga

SEQ ID NO: 66097 - DNA, 153 bp, Triticum aestivum
  Clone ID: PAT_TA_66097
tactactacacctctcacatctgctctttggttccacagcttccttcgacaccttcgtccagaaactctcgcggacatggcggccgggaagcgcaccatcggcctcgcgatggactactcgccgtccagcaaggcggcgatgaggtgggtggt

SEQ ID NO: 66098 - DNA, 389 bp, Triticum aestivum
  Clone ID: PAT_TA_66098
ggcgaccgcgtcgcactgcacgtcctcctcgaccacctcccgcccaactcgtccgccccactccttgcagcgtcccacgagatcctcaccgccgtcgacgccttcccctggccgcacggggagaagcgcatccactaccgggtggctaatgcggggctccaggcgcagtggatcgaggcgtggtggcctggctcggacgacgagttcgccttcgtcgttgaggatgacctcgaggtctcaccgctctactacaggttcctaaagcgggtggtcatgaggtactactacgacagggagaactacagtccctatgtcttcggtgcgtcactgcagcgcccccggttcgtcgcaggtaaacatggaaacaagatacagctggacagtgaaac

SEQ ID NO: 66099 - DNA, 533 bp, Triticum aestivum
  Clone ID: PAT_TA_66099
gcggcccgtgcaacgtcgagctgtgcgcggcgacgacaagcccagcatccaagaaggccacggcgacttctcgccgccgcggccgcgcccgctcccgccgccatccttgcaggtcccaacccagcagcatcggagggtgaagagcgttgacaaagccagcaagcaagaaggcgacgcgcacttcacgccacagccccctcgccctctgcccccgccgccgccgctggagccggtccggagcgcgaagaccgaggaggacaataaatccaagagcaaagaagacgagaagcgctcgccgacaccgcaggcggcgccgaagcaccggaaagcgacgagctgcgacaacagcaacggcaacggcttctgcggcggcagcgggaggctggacgggagcgtggcggtggtgaagcagtcggaggacccgctgggcgacttccggcggtcgatgctgaacatgatcgtggagaacgggatcgtgacgggcgacgagctccgcgagctcctccggcgcttcctggcgctgaacgcgcccc

SEQ ID NO: 66100 - DNA, 161 bp, Triticum aestivum
  Clone ID: PAT_TA_66100
ggcacggatgtgcctctgctggagggacattcgagtggacgagacgaggcagtggggttcatccaggcatggagaattcccggcgttgccccgtttgctctctgcctcttcttctgcaagcttgtggcctacacgttcctgtgttggctcccctttttcct

SEQ ID NO: 66101 - DNA, 146 bp, Triticum aestivum
  Clone ID: PAT_TA_66101
gagacgcgctcgctcgctccaccgtcagcaaccaagccaggcaaagggcggcgatgacgttcgacaaggtggaggagctccggccgggcacctacggccacaacctgcagctccgggtgctcatcgccaagcccgttctgctccac

SEQ ID NO: 66102 - DNA, 331 bp, Triticum aestivum
  Clone ID: PAT_TA_66102
tttgggcggccccacgtcgctccctcggccacttaaactccccccctccaccattagctagctctgtagttgcagctcgagcaccttgagagggaagcacaccaagctaacaagctaggaagagaaactcccttgcatccgaccagcgcgtgacgtgacgcttggatctccatggacggcaaaacgcctcatcggctgcctccgagcgaggccaacaaggagatccgggatgacgtcccactggtctgcgcatgggcgctcatcaacgccttcagcatcgtcgtcggagcagcaagcggctgcgtagccgcctacctccatgtctcgtgca

SEQ ID NO: 66103 - DNA, 161 bp, Triticum aestivum
  Clone ID: PAT_TA_66103
gccttccttttcccatctgcacacttccgccacatcacagcaccgccgccgggacagctttgctttcccacctcctcgcgccgccgggatccgcgtagagctcgtcctccccgccgccgccggcaggagctccctcgctcgcttgctcgccgggaaccccg

SEQ ID NO: 66104 - DNA, 243 bp, Triticum aestivum
  Clone ID: PAT_TA_66104
gttgtccttccccgtcccatttcctccgcttcccagtccggagcagttccgcaccgacaccctcaccctccccaaagccctaaccgctcgcccgctccgccgccatgaggtccaaggccaacggagacaccgcgttcaaggcctccggcaagaacaagacggccaccggcggcgtcgccaagccgaagcgcgccctcacgggggggcttcgccttcctggctgagttcaggccacagtacatg

SEQ ID NO: 66105 - DNA, 192 bp, Triticum aestivum
  Clone ID: PAT_TA_66105
tgtcggtcgggcggggaattgcggcgagttttcgggttgctccctggcctcccgggcgctcgccggcgtcggatccggccctgctccggaggagagcgcgggtctcggttcggctccgcccccgatttgctcgcctgggctggttgacgcggctgcggcggcggtggcgaccggcgactgaggcggccgcgt

SEQ ID NO: 66106 - DNA, 360 bp, Triticum aestivum
  Clone ID: PAT_TA_66106
attcatgaactgatgcaaagattattattatttttgccacttgaccgtttcaacaaaaaacaaggcagggtgggaggaggagattacatacgtcgttcaagtgtccaaacatggtatcaagacctggaaccgcattcatgttaatgttgtccctcgataaataagcccaagactgcggaaactttatcggagttcaggatccatgtccagggggtatcaaacaatgtgatacaaatggatgatcatttggtcattgatggccggctgaacgagttatcaactcactggacgctaacgatgcagcaggtcagcagcagctcatgtttctggatgtctggttcggacacttgccaaagcgtt

SEQ ID NO: 66107 - DNA, 279 bp, Triticum aestivum
  Clone ID: PAT_TA_66107
cttctctaatacttaattttaagaaatctgtttcatggtgaccaagtagaaattcttcatgttcttttgaaataggtgtagttaaaaagtaattttaagaaatctgtttcatggtgaccaagtagaaattcttcatgttcttttgaaataggtgtagttaaaaagttcaaaatcttgaaagccccgcccatgaactttggttgggtcatactcttccatgctacccatgcaggttttcctttttccttctttactcccccaccaaaactgtcgaataag
